United States Patent 10,724,096 (METHODS AND COMPOSITIONS FOR INHIBITING AND TREATING NEUROLOGICAL CONDITIONS) - sequence listing, part 133

SEQ ID NO: 2422 - DNA, 516560 bp, Homo sapiens
cctgactgctcggttaggacctcggagagcgccaggcgccgcgaccagagggcccagagaagcggccggagcccgcctacctcggccccctcagcttcccgggctggcaggcggctagaggcgtctgaggaaggtgcctaagtcctgggtcagatagtcatccctctgggacgccgccgccgctgccgccgtccagctgtggctccctcgcacctgtgtgtgtctgtgtgagtgtgtgtgtgtgtttgagagagagagagacagagagagacagagacagagagcgagcgcaccagcgcgcgaatgcccgtgtgagggtgtttgtgtgtgttctggctgggagcgcgaatgcctcggcgtgaggtgtttgtgtgttcgcgcgcccgcgggcgggcgagagccccgcgcctcagcgctgggcctgggggagggacagcgggagcggcggctctgcgcgcccagcaggctgaggcgggactcgggccgcagccgtcgccgccaccgcttcacgtcccccgagagcggctgccgtgcagcggggagagcggacggcgggcgggcgaacaggcgggagagcgcggcggcggctgcgggcagaggtggagggaggggagcaggagatggggagaggggggaaagaggacgcggggagggagatgagggggaggtgagggggaggcggagggacaagtggaaacagacggtgtcgccgttctcctcctccccccctccccggcagctgttgctgtgggtcactcgcagatgttttggggtccgggctgctgggggatggggactagaaaaagtacccccctccccgcctttcatagtgacaaaaaaggaagcgttgaagctgatgggggaagagcccggaaggtggtggcagagtaaataccggctcccccaacgtcgtttttctgaaaataaaatactctgagccgaacgtttcgaagaaggaaagtccgcccttaagagagagacagagtcttggtctgttgaactctggtttgattgtataataatgatgatataatgctaatgacgatgatgacactgccttttatttttaccccagtgctgataaagcgtagttacagctggggatacagtccttgaaaatctgatgtgtgaggagggaatactgttgcttttggagttgtgttatatttatctttttttaaaaaggatatgctttttagaattaaaatttggcaaaacgaatcctgactctttttttccagtcggtcgtaaccaatgctcataaaatggggactgacttgactaatgaaaagagaaaggcttttaccaaggtctaattgcacgtgttaagtcacctctttccctttttttcctttgtatttctcaacagtgtttaaaatgaagaagtttaatttccgaaaagttttggatggcttaactgcctcctcccctggcagtggtagcagcagtggcagtaacagtggtggtggggctggaagtggttccgtacatccggcggggactgcaggggttctcagagaggaaattcaggaaactttgacttcggagtatttccagatttgcaaggtaagttttgaattggcttaaagcctattatttctttattatactgttgtaaggaaacaaggggggaaaaacataccaggaacaggaaactgttgagatgtcagcatcagagtctgctgcagaaagctctgtgggtagatcagtttggcttaatagatattttaggcgtcaacttaaaaagcaatgatagtttaagtgggaaatgagcacacacaaaaagtagaatttgcaagataatgttaagatccaatagtggacaaaatttttaatatttgtgtattatattaactgaagaagcaaatagtcgtttggttttttgtgttatcagagaaaatattgttatttcactgttcagtatgaaatgaataaagctactagcatgttgctaggattaagtagataataggaaaatatgttcattttaagggggccaatgacattgctttaaaattccgaataaaaacaccttcacattcttaaactcttcataaatacacaaacagacaaatgcacaggcttataagaacttgcagttgtaggaactcaaaaatagcgggtgttctggtttagtaagaaaacattttatgtaattatactttgatattgaacttctaatgaatatgcaaaagagagtttctggtaggtagagaagatgagagtttataaaacaagcattaggttaatgcatagagatattgttattgctatatttgttatattttatgacataaagtgatttataattttattgcccttttttgagttgtcttggaatgtgcctattatatgcaacaaaggctactaagttatttatgtcatataaatgaatatagttttgtaaatgtgtttggctacataagaaatagaaaaattgcaaaattacagaaattaacaatttttaaaaatactttcacaaaagaaaagttttttgaaattattaaaattatatttgtggtaaacaagtgatatatgtataatgaggtatatttcaatcactgtctcagcctatattcctagcagggtcattataaaaacattaaatctatagttattagtttacataaaagcaagtttatttagagttaatttagataaacagatttaattctaagctactttgtgaaatttgtgtacagtaataatttttttcctcaataggaaataacagatattctgttcgatgagggaaggtcttaacagtggttatgagacaaatgtaaaagagtcctggagttcaaatttgaactgctaggcaggggaattatgccctgattctctaatctttgatgtgtttgcaattttcacgatcagattctgaaaattttttccaaattctctcaattcatgtatatgacagtgatacaggagaattttaccagaggtaaaactggtataggaaagatagacttctgaaacagaatggcattgggctgttgaggtcataaagcttgtagagaaggttttaaataaaaaacttcagggaaatgggtgaatgcaagagataatggaatacatagttatcttcccatttattcaggcaagagatagtcataggaagtaccagaagttaaatacatactactttaaaaacatatggcatggtaggaagagcactggcctaggaatcagaaaatttgtgttttatttaaagttctgctagttgacagccatatactcttgggtaagccatttatctcccttgagccttgatttctgcatctgcagtgtaggaataagtgtatctgctctccttaactaagagacggttattgggaggatcagacagaataaggtgaaggtaatgcataaatggaaaggatgataaaatatatacgaatattattgttaaagtttgtaaaatcacgtgttcatagtagagcgaatataactagtgggttataataatattagcttatgatttccaaataaattataagatagatagctatataagttgtccactaacagtactgaagtcttactaaatgtggaaaatactgtaacatctttggataggaatatagttaattttaaaaaatagttatatggatgtattataattacctggtctataacaaaacatataaaaatggactaaggaaatcccaaaattagaccgttactgaaatggggactttatttagactcatagactccctgattaaatgtgcaaaaaaatttctcttctgagttctaaggagctgtcatattctgggtgcttctaccttttcaacatgggcaaaactaaagtataaatctagacttggctgtttgaaagcctcctctcttctatctgattagtcatcacatcccctctattctatttccttagtatttctgaaatttatgaccttttctacatccccagtacttgttcgttccgtcatattttcttgcttggtcttttgaaatcactttctaactgatctctttacttctagttttactggattacacttcattttgttacaataatggctatttctgaaatacaatgttaattatgtcatttccttgctaaaaattctatattggtttcctacagcaatgatgctcttaaaatgaaagtcttatttgaaaccacagtaaataacatctattcaaacaaaaaaatgtggcaactcatgggcacacatttgtttcagaaattataagaataaattatacagccaattgataaaaaaactttttatatttgttttttattgtgtaatatcgcccataggaaggtagtaggatgttcgctagccttaaaaaagtgaaagtataaagctgtacccttcataataaacaaaatatctatgagatgttcaaagtcatagaaatggcagaagaaactttggttcaaggtcagccaaaaaaaaaaaaaagttaatgcattgggttactgcaatcgttcagaatgtgtatacattggaatgcctgcattgtccaggtatttgtgaaatacatgaactgcctttcctgaacttgaattctgtgaaatacaatttgaaactattgctctataaaataaatttcaaattgcttaccttgatgggtatagagtttccttcagaagagattcctgtttacctttccatttttatttgcttgattccctaagtatactgcattccctaaaagataccatattttctcatatctcaatgccttctctcattctttcgtttctgactagaataccttttctactttcatacgattggataattcccagccatcttttacctcataattcaaacatcacctctatgagactagctctgaccactgccacctcaactacccaccagggttcttttttttcttttttaaaaacctattctatgtttttctgtagcatctggcatatacctatagtgtgaatttagcatcttcctgtgattaaaaaagtttcttaaaaatctgtcactgccgttatactatgaactctttgaaaagcaaataatttttttttcttgtttccttcttattgctagggtatacactatctagctggccagtatttcttaactctggtgtctaaaatagagatttccagcacctccccattcttagagaatcaaaatctctagggatgagtcctaggcacttgcatttttttgaatggccccacaggagatttctatgcacagccattagtgaaaaccattatagtgggcacttgatacactttaaatgagtaaagatgcatatacatgattggtcgattaattgaaaaagatattaaagcagagagcaattactacttatatatgccttaaacattttattttaattgaaaacatctaaatatacaatttacaaatcatttgataaatgactacgtttttctgttgaatgttggttctgtgattggagttctgtgtggacttctcttccataaacctttccaaattcatatctacaactttcagttttggtttatttaaagcagagtaagaaattacatgcttttgaagcaaaccaagtgtcaagtccttctagattatatatacagtgatatgtataaagcaaggctttattttgttcacatctgtatcatctatgtatagaatggtgcctggcccattgaaggcagtcaaatatttgttgagcaaataaatgaataaattaaaggagggaagctatacagattgttgtgttaaaagcaaactagatattattttgaacagcttcttggagttgcttttatgaaataacttttatataaagaggtggagagcatctagtgaaagagttgataccactttaggaacatggtatatgcttttcaaacagatgtagaaaagaagattgtaggaggatttaattaaatttatttcagtttttattgaagaagatattaggaacattctcatttttaaatgatctttttgggggaacaactcagaagttctagattgacagtgacaaacacacagggtgttctagacctaattaacaaaagataaaaataagtatattaccaaaaaaagagtaaaataagtatattaccagaaccagatgacataatccctaaatttctgaataaactcttaaattagccaactcactattcataatcatttataaactgtttttataaatggtcacaatgtcagaaacaacatgtagttaactagtataacttctgcagggaaatggatttataacaatgatgctcatatctgacataatatcagatcgtaccaggtaaataggtatagatcagaaatacaggcatgaactgtagagagttgggctttccaggaccctagcaagatgaaaggagattaaatgcccagatatccttgaatactatctcttcctcaagattttcattgtctccacattctcctaatttcactccattttacttaagcggttttgcaactgagattgggaaaagatcatgatcacagttccacagttataaagttttcatccataaaaagaataatagaagattccctgagatgtgtggatttgttacattctcctgtcaccaaaaagcacagtagaggcatctttaagaatggtaatggaggcaaggaagaattaatctaccattaagactaagatgctaacaagcgtaataaccagaaagaattaaagatttttttttcttttaagaaccagaaaccaaagccagatgactcagtactccaggctgtctgctttgcttatcctgagagcataagggtgtaggggcaggcttgagtaaaggattatagatgtgtagaagtacgtttgtaaaattttaaagttacctagagggcaatcacattttctcacaaaaagtcctttggtgctagtatttgtcagcaaattgggttgttggtcttgtatagtgtggtggttcttaaatgttcttaaaaacaaacagtgccgtcatactttttgtatttctcatacatacagagctaagttaaaatcttaacataatttccaagtatgtttttctgtaggagtattatcactaagtaaacgaaatttctgtttcttaaaatttagtgcatttctgtagatatttctctagcctcatttgacgatgttcctgtgaaaaatctcaggattaagttcatatttacttttaataataggatgattgtactgatttcctgtattatagttctgtaaagccacttacatattggtttaatagcaatgacttttgactatatccattaaaagtatcaagtagaagccctgctttaaactttcaaattgagtttgtttttctcataagagaaaaatggaactttttgttcctacttaagtatcaaaatgatgatctttataaaaatgcttttgtttatagtgacagttattttcttttttagtcttaaaaggaggataacttttcttaattctttttagtatttgaaaggctaatcttttaatgtgcacaatatactagcgtttttatttaaaaatatagattaagtattctgaataattgttcctaatttcctaggtaatactaaactgtctttataaggactaggaaaaaaatcattgattaagttttatacagccaaaaatagaaataacatttaaaggatttagagaaggtagttataaagaatagaatataagccctccaaaaagtatatagtgggttcaccatgatacttagggagagacttgattaaatgaagcattcatagtcactgaatgaatgcagcaagaaggtattttgacatgtttattattgaaaatatattgtatttattatacacctttaaaaataattaagacataaactgttctcagccaactgactataataagaatgaaataatgctttctgggattgatttatcagcaaaatcacctatgatatattctggacttatctaacatattagaaagaagaatatgatttgagttttattggaagcccaaaattaccagttaatattgatggtttatagaattattttgaatataatggtatataatgatgctatataatcaatataatgaatttgaaattgaaaatattgtatttgttttagtttcagttaagtgttttatatttatttttatcttattttatttttaggtggagttttgctcttgttgcccaggctggagtgcaatggtgcagtcttggctcactgcaacctccatctcctgggttcaagcgattctcctgcctcagcttcccaagtagctgggattacaggcgcccaccaccacgcccggctaatttttgtatttttagtagagacggggtttcaccatgttggccaggctggtctcaaactcctgacctcaggtgatccgcccaccccagcctcccaaagtgctgggattacagccgtgagccaccgcacctggcaagtgttttataattcaataaatatctctttgaattgacaatagcataaaatcgacatcttatttggacatgtaaattttattataaataaaactgatcattttggtggttttagatgcagatttaatacctggatttagaaagtaaagattggaattgagagaaaattgttatacttcttttatctttcttttatttttactttaccaaaatgaacacaataaaattagttacactctgaagaaaactagctggattggttaatgttcagtttactttgttcctataaattgactaaaaacttgtctataaatctgtaaactgtaaaagtttgaaaattattagtagtataataaattttgaagttagattgagtctgggggaaatgcttacagttggtaaacatccatgtagatggaaaatgtgaaactagaaaaggagacagagaagaaccgagcagaataatatgaggaaaattcaagagtagaggcaggtaatctgaagcattctttagagagaatagtaagagagaaactcaggcatgtcccagctttgtggagtggtcaaagatagtaaaaacaaaacaaacttcaaaacaacaaacaaataacacagaattgtcagagacaagtgaattaggccaagaggaaattgattagggtaaacatattttcagtaaggtgatggatagaattaaggtcaacaatataatagagaatataattagtagcatcagtaccaagagtagaagtaggggagatgtgtgaggaattgactttatagaaaagaaaagtggtgaaaaaatagcagagacagtaggttttaatatcattttggtacactgtaggggtggtgatgcaattaatccacagaaaagcaattgaggctaccagaaagggaatggtagggtggggaatagaggtaagatttgccttttaaaatagcaaggggtggccatggtagcacatgcctgtagtcctagctactgaggaggatgagggggaggaacccttcaggataggagttcgaggctctaatgcactgtgatcatgaatagccactaatagtactccagcctgggcaacatagcaagacccctgtctctaagataaataaataagtaagtaaaataaaacagtaggtatctaatttggaatttttctccttacctgataagaatacatatttcatttgaattctcagtgaaatctgtgctttatgtcctttcaggtaaataaaagcatgtgattctatgagaagatcatatgacttttgtattgctgcttcaattaccaaaaacttattggcttaaaacaacacgaatttatcatcttattgttctggaggtcagaagtatgacatggatgtcactgggctaaaattaatgtgttcacagaactgcattcctttctggaggctgtagaggagattttgttttcttgactcttgcagcttttagaggctgatcacaattccttggccgatggccccctcccatcttcaaaaccagcccccttccattttcaaagccagttgatctttccaacatgtcaccaccctgactttcctgcctcccttttttaatatttaaggatgcctatgattacattgggcccaccaggataatccaggttaatctccccattacaaggttagttgattagcagtcttcattccatctgcaaccttaattcccctctgccatataagctaacatattcacaggttctttgggggctgttattctctgtacctagatgttcatcacctcacctgtttttgttttttgagttattttatggaaaactttaaacacacaagaacagagagaatagtattgaacccccagcttcaacaatgatcatccttggcaaatcttgctgatttatattctcttatttgctactcttacatttcattattttaatgcaaatctcagacattgtacccttccacctgtaaaaaccttacagagcagataagcacttctcctcaccctgtgcttacactattaatcctaaagaccattatcatagtgaagaaaattaacatttctttatataatctaacatgtagttagtgtttaaattcccttagttgtcccatattgtctttttgtagttgatttgtttagattggcatccaagcaaggttcatgttgcattttcacttggcttgaagttatcttaattcagtttgtgtaaagtcacaggttttttgataagatcagctatcttgtgcttttgtgtatattaatgaaaaaaataactctttgtcctgatttctttatgaactagaaggctatatgtgaggaagtgggtgggttgttcagtgtaccacaagatgccaaatagagaacttttaaatgttttctagacatggtaacattctttaaggaatgggaaaaagaatatttttaggtcatcctgagagctgttgtactattttgtgatgctactataggataggctttgctgagaatgttagaaaagagaaaagtgtcataaaagacacagtatgtgtcaaagtgaataaaagtgaggtggattctcaacgttactgatttttacccatgaaataaataaataaataatttgagggataggatgagattcagttttgtatagctcttcttttaagtgaaagaacagaacatttgataaggattcactctacagttacttagaatagaattatatagcaaaaagctgaaattgaattggacaaaatctgttttattagtaacttagatttcttcacttgggttaataggctaaatatacttgaagaactgagttggaaggtggtaggaagaggattaaaatactgatgaggaacacattttgatgtattgagttccatttataaataatctgtacattacatttattgaatatttacataattcaaaaggtaccttattctgattctctgccatcctatggtagtttattgttggctctttctttgctttttccagtttcatcttaaccaaaactcctttgctgtttgaggtaatattcaatattcttgtgctctgccacagctccccactagctatttggtgaattcagttacttattatttaaacatttattgaaagcatattttatatatgattctaaactagactttttaattgggcaacccttttttaggaatgactttgcaaggcaagcacacactctgtgaaccatttatattttaatgtgattaacagaataatttacatcatgtgaactttaattcatgttttataacttttatgaaactccctcttattcttttttcaatggctcaggtttttttgctccctgtctctttctttcttttttccttgtatttctactatttttgaattattttataatgtatttgatatctttctctttgtccttagcctatgttaatttccatttatatcttcttggctaaaagctgctttattctaaaataaaagaacctggaaaatgtctgaaatatatttcttttggtacaatttcatttccctaacaagtctaatacttattgagactattaacatacgaaagtaactctttaagtcacagtttctcttttattcaccaatttctttttgaaaggattggaaagtatttaatctgggtcagctcagtataattatcaaataattatctttaaatcatgcttctttgttctctgctaacagactcaaatttcttacaaattttttttttgaaaaatgatttggggtactttcctgcttcttaaaaatttaatacttttaaattgatgcataatagatgcacatatttttggggtacatatggtaatttaaaacatttatatggtttgtaaatatcaaatcagtataattgggatatacgtcaccttaaatatttgtctttgctttatgctaaaaacattagaattattctcttccagctattttgaaatgtacaatagatcattgtaaactatagtcaccctactgatctattaaatactagatattatttcttgattcaaaatatatatatttgtacccattaatcaacttgtcttcattttcccaccctccttccaggcctctggcaaacaatatactctctgtcttcatgagatgtactttttagctcctacctgagtgagaacctgtgatatttgtttttctgtgcttggtttatttcatttaacatgacttctcattacattcatgttactgcaagtgacaagatttcattcttttttatgactgaataatattcccttgtgtatatataccatattttctttatccattcattcattgatgggcacttgggttgattttatattttggctattgtgagtagtgctgcaataaatgtaacagtgccaatatctctttgatatattgatttcctttcttttgaacatataccgagtagtgcaattgctggttgttctatttttagttttgaggaacctccatacagttttccttagtggctgtactaatttacattcacaccaacaatgtgtgagttcccctctctccacatccttgccagcattcattattacctgtctcttttataaaagccattttaactggagtgagatgatatctcattgtagttttgatttgcatttctctgatgattagtgatgttgagcattttttcatatgcctgttggccatttgtatgtcttctttgagaaatgtctactcagatcttttcccatttaaaactcagattatttatttatttttgctattgagttgtttgagcttattatatattctggttcttcaccccttgtcagatgaatagtttgcaaatattttctcccattctgtgggttgtctctttaccttgttgatggtttcctttgctatacagaatatttttagcttgatgcaatcccattttccatttttgctttcgttgtgtgtacttttgaggtcttacaaaaaaatcattgcctagactgatgtcttggaacatttctccagcattttcttctagtagattcataattttagttcttagatttaagtctttaatcaattttgatttggtttttgtatatagtgacagggcctagtttcattattttgcatatagatatccagttttcccagcaccatttgttgaagaaactctccccactgaatgttcttggtaactttttcaaaaattagttggctgtaaatgtgtggatttatatctgggttttctgttctgttccattggtctatgtatctttgtttatgccagtatcatgctaatttggttactttaggtctgtagtatattttgaagtcaggtagtgtgatgcctctagctttgttgttttgctcagggtttctttggctattcaggatcttttgtggtttcatataaattttaggatttttttttgtgtttctgtgaagaaacattggtattttgatagagattgcattgaatctgtaaattactttgggtagaattgtcattttaacaatattaatttttccagttcatgagtgtgaaattctttccacttgtttgtgtcctcgtcaattcctttgtcagtgttttaccttgtagagatctttcacttctttaattaaatttattcataggtattcataggtattttatattctttgtagctattctaaatgagattgcgttttgatttctttgttcagattgttcactgttggcgcatgtaaatgctcctgatttttttgcatgtttattttgtatcctgcaactttactgaatttgcttatcagttataacagttttttggtggagtttttaggtttttgtaaggtaaggtcatatcacctgtgaacaaggctgatttgactcccttcttccaattggatacccctttatttttttctcttgcctaattgctatagtcaggactttctgtattaggctgactaaaagtggtgaaagtgggcatccttgtcttgctccagactttagaggaaaggctttcaaattttccctgttcagtatgatggtacctgtgggtttgtcatttatagcctttattattttgaggtatgtttttttctatccagtttgctgagggtttttctcataaagggatattgaattttatcaaattctttttctgcatctattaaaatgattggtttttgttcttggttgtgttagtgtgatatatcacgtttattgttttgcatttgtggaggattgtcacatctgtgttaatcagggatactggcctgtagttttctttttttattgtgtctttgtctggttttcataattctggtctcataggataagtttggaagtattccctcttcaatttttttgaagagtttgagtagaattgctatttgttctttaaaatgttaggtagaattcatcaatgaaaccatcaggcttttctttggtgggagactttttattactgcttcaatcttattcctcattattggtttgttgaggttttctatctcttcttggttcaatcttggtaggttgtatgtgtccatgaatttattcctttcttctaaattttctaatttgtttgcatacagttgttcacaatagtgtctaataattcctcgcatttctgtggtctcagttattatgtctctaattttttttgtttctcatggtatttatttggatattctttttttcttagtctagctaaaggtttgtctatttacattttcaaaagcaagcttttcatttcattgatcttctgtagtgttttttttattctcaactttattatttcttctctgatctttattatttctttttctatgaatgttgggttggattgttcttgctcttatagttccttgaggtgtatcttaggttgtttatttgaagtctttctgcttttttgatctaggtgtttaatgctatcaacttctctcctagtactgcttttgctgtatctcatagatttcagtatattgtatttccattttcatttgtttcaagaaaattttaaatttccttcttaatttttttcattgactcatttgtcattcaagagcatgttgtttaattttcctgtgtttgtgtagtttctgaggatcctcttgttactgatttttagttttattccattgtgatcataaaagatatgtcatatgatttttactttcttgaatttgttctaacttgttttatggcctgagatatggtctattctggagaatattccatgtgctgatgaaaaaaatgtgtattctgcagcagttgggtgaaatattttataaatgccaattaggcctatttggtctagtgtgtagtttacagtgatgtttgttgactttctggctggatgatctgtccgttactgagagagattttttttttaactgaatattcaacacatttgtaggaacagaaggaatgcaacaaggattagaattttataattacattatacatttatgtaaaagatgtttcatttctcaaagacgtttctcctacgtccctatcttttctatctttctcaaatcagtagttattactattctcatggacaagcttatttcattgtgttagacagtaattataccagtatgtttcacatcattatcatcttcaaaaattctacccttcatttcaccacacaatcccactgcattgtttcacagtacaattgtattccacttaaattagaaaagcccaaagaaattagagcaaaaacagtcaaattcatgtgaatgaatgctagagggcaaaatattttaaagtattgatttagtaacagttactaaatctacaggcataagacttctatttattcatattattaaaactgcaataatagaaatgaaatctacattaatgaaaaacaatctaaggaattagatcagtaatatttaaatatagatatattttgtgattagtatcaggtaaatatctaaactatctatcttaaattctggtctcagagaaaaatgtcagagacaattacaaagaagatgcttcatattatcaggtccatttttctaactagtgagatcctttgggagaatggctttagtctttcattttgtcagagatttccattggtcctgttgttggtaatccatttgtttacatccttacagtctacctcgtctttattttatttatttttatttatttatttattttttgagacagagtctcgctctgtcgcccagggtggagtgcagtggcgcgatctcggctcactgcaagctccgcctcccgggttcacaccattcttctgtctcagcctccccgagtagctgggactacaggctcccgtgaccacgcctggctaattttttgtatttttagtagaaacggggtttcaccgtgttagccaggatggtctggatctcctgacctcgtgatctgcccacctcggcctcccaaatgctgggattacaggcgtgagccaccgctcctggcccttgtctttattttaaattgttgtattcctgtatagctttataggctatatataactaacaaaaggagaaataagagggtatatgcatggatctagaattcttttgtatttccagaacagaattgaaatgatgatacaaggaatgcacaccgttgcctgggcttcacctcctaaaccgcaaccatgaagccctaatgacaatgtccacacttctggaggaagggatgaggagcagcctcgagtgggttgctgaagtaccctactattattgtattgcagtatacctctctttctagatttattaatgtttgcttcatatacttgggagctctcgtgttgggtgcgttgttatttataatcattatatcctcttgctgaattgactcctttattattatatagtgatcttctttgtctgtttttatagtctttgatttgtagtgtatttcatctgatctacatatagctactcctgctcttttttggtttccagttgcatggaatatctttttccaccccttcagtttcagaatgtggatttattgtaaggagtatatagttgggtcttgtatctttatccattcagccaccctatgccttttacttggataattgagtccatttacattcaagataattattgataagtaaggatttactactgccatactattgcatgttttctggttcttttgtaactcttttcttcatttcttcctttcttactgtcttcctttgtggttaagtgattttctctagtaatatgtcttaatttgttgctttttatttttagtgaagctacaggattttgcactgttattgccatgaggcttacagagaacatcttatagatataacaagtttatttgaaagagatgacaacttatattagatcatacaaagaataggacaaatgaagaagagtgggaaaaaatctctatactttaactccctcttccctcattttgaattttgttatctccatttatgtttttaattgcttatctcttaacggattgctgtgggtattattgtctttgataggtttgtcttttaggtttcatagtagaattataggtggattgcacactacagcttcagtattagagtattctgggtttgtctgtgtacttaattttaccagtgggttttatgctttcccatgttttgtttttgtaagttaatttttttttaaattttagatggaagaactccctttagcatttcttgtaagatgggtctggtggtgttgaattctctgagcttttgtttctctgggaaagactttgtctctccttcatagttgaagaacatgtttgctggatatagtattcttggatggcagttctttttttttttttttctttcaccactccctgctggcctatatagtttccattgagaagtctgaatggattaaacctcctttttatgttatttgcgtattttctcttgctgcttttaggatcctctctctgtctttgactattgagagtttgattatgccttggggtagtcctatttgagttgaatctgtttggtattccaccttcctgtacttggatgtttatctcttttctagttttagaaagttttctgttattatttctttgaacatgctgtctaccccttacccttgctcaactccatcttgactatcagtaattcttagatttggtcttttgaggtaattttctatattttgtaagcaatcttcattctattccatttttctcctctgcgtattttcaaatagcctgtctttgagctcacattatccttcccctgcttcatacatttagctgttgagggcctctagtgagtttttcagttcagcaaatatatttctcagttccaaaatttctgtttgatttttaagaatcatttcaatctttttgttaaatttctctgataaatttctttcctttcttttttttttttttttgagatggagtctccctctgtcacccagactggagtgcagtagcacgatcttggctcactgcaacctccgcctgccaggttcaagcggttctcctgcctcagcctcccgagtatctaggaccacaggtgcatgccaccacaactggcaaattttttgtatttttagtagagaaagggtttcactgtgttaaccaggacggtctcaatcttctgacctcatgatccacccaccttggcctcccaaattactgggattacaggtgtgagccactacgcccagccaatttttctgataaatttcttaattgcttttctgtgttgtgtgggaaggctggctaggggttcatgcccagcagacctgatggatgaacttcctatagcatgatactgctgaacagcctctaatttggtgtctcctttggctgagttacagagcagaatttccaaggctaggatggcagtcccacctcccctctttgtttctctttgtcatcagggatatttcttacttcaggtactgctaatgctttccctgggttggggtagagacagggctcctgttagggaacccaaaatatgggggaagctggttgtctaccttgagctcactttttacaaagtagaaatcatgagttgggggaaattttcttagctcttggtgcaaggcagattggtgtgagtgggatcacagatatggaaatcttattctctttactgtctgcttggagttttttcacttccctgtgaccctagaagctgacttgttcttatatttgagttttggggtatttctggtaataatctcagtgatgtatatttgtttaggttttctgtatgggcagtgaaacaactttggttgtatgctgccattttggaacctgtagtctccctaatacaacaatttctgtcttcatacaaagcaagattatatatttagtagaaataattttatttattgttaatgttttttacagtgctcatatattttattctgtgaagagctatagatttaaagaacttggaacaaagataaatattgagagaatagggtgctaagagctgaacatttgggagttgacaattgaaagcaaaataagaaagatcagggagggaagtatgtgaggtaaaatttacacataaaaatcagattttaagtactcatttcaatgagttttgataattatacacatctgtgtaaccatcagtcaaaacaagatataaaatatcttacattttctaaaaatttcttcctgacactttccagtgaatttcccatccttatccttttccagaggcaattaaattctgacttctttttttttcctcctgagatggagtctcactctgtcatccaggctggagtgcagtggcgaaatctcggctcactgcaacctccgtctctggggttcaagcaattctcctgcctcagcctctggagtagctgaaactacaggcgtgtaccaccacgcctggctaatttttgtatttttagtagaggcaaagtttcactatgttggccaggctgctctcgaactcctgaccttgtgatctgccctccttggcctcccaaagtgctgggattacaagtatgagccaccgcacctggcctaaattctgacttctatcaccatagcttatgcttacatgttctgagacttcatataaatagaatcatatggtatacagagtgtgtgtgtgtgtgtgtgtgtgtgtgtgtgtgtgtgtcttatacaacacaatgtgttaagatttattcaagttgttgatggtgtcagtgatttgttctttttttattgctgagtagtaggtagagagaaaaaaacttcaaaagtatccatacttcaaacatgcagatgcaggcaatgattattgatttttttgggtgcatttcattttagtatttttttatgtttagttttttgttatgtggaaattaacaaagaccacccaaatgaggacataggctattcagattttgctgtggcaaaacccaccatcgtttgtatttggcagagtcccaaacgcaggcagaagagtgggagagctttgtggtgaaaaaagggtaagctttaagtatgttcttattgtaagttgttggcatgggaagctggaggcaggctgtgtacaagggaggcattctatgtgattggtttgggaagcatatttggctttctctagtcagtattgagttggaagtgttgtgaatgagggagctgcggaagttagggatctggtagtcattggccatttcctgattattctgggctgatgattgcagagattgtggtttgacttcccagactggttgctgcagggattgtggtttggcttccttgtctggttgctgcagaggttgtaggttagagttctattatcatatgtagtttagtaattgtatattatattgtatagtcagtctcttggttatattttggtatgtgttatggatcttatatagaattttacatcctattttttttcacttaacattagaatataaacactttttggttgttaaggatttttttctttatataaatgtaatggctgtataacaatcagtttaggggatgtacttttattactggaaatttaattttcattcagtttttctcttcttacagtaatgcttttacgaacatctgtgggcattaaaccttcagcatatttaatattacttcccgagatgaaatttctagttgtaaaatagttaggttataagtctttatatatcttgttgaattactttctaaaagggttcacctagtagtatataactgtcagttcagtggtattcttaccagctttcgatatttagaaatatttttactaacttagtaaatgaaaaatacacttttgtaattatttaatttgtattttatgattactggtgagcttgattattttccagtatacttactagtcagttgagtttttttttatgaattgtcctttcatatcccctttcttcctatttattggttcctagtaatttctattagcttttatacattttaatatattaaattgatcaatcttttatctgttatagttttgtaaaatttttcccagttcattatttgcatcttgttcatgatagttctaatttgcataattcatatttttttctattgtcaaatctattgacttatccttagtgatttcttttttatcctctacaatccagagtttgaatattcatttctattttctttttttttttttttatgagaaaataaacttattttatttaagccatccagactctggtactttgtcatagcagacccagcaagctaatacaaagtcttatctacatagtgagcacaacagttattacataccattctctcttaactgttatttaatcatagtcctataagtacctgtgtgtttagggcttatattatttccttatattgatgtgttttggctgtgttttagctctttctgtagtagattcctcaggaagagttcatggaaacagtatttcttgagaaatgcattttgatactagtttgtaaggcgctttatattttttacttgaaagtcattttgcctggttataaaatccttgacttttttttctttctttggatgtcttaaatatgctactaatttttccctggcatgaggtattagtattgaaatattttagtgttttgatatatcacattttgacatttttattttaaccaaattcattttagtatatagtatgactccaaaatgatgtttcccccaaacagcccgtcggttgcaccataccatttaacttctgcttccctcttccactgaatgtggtattcctttgtcatatattaagttttgaaatgtactaggatttataactgggataactatgtttttctatttaactgctgcttccctcttccactgaatgtggtactcctttgtcatatattaagttttgaaatgtactaggatttataactgggataactatgtttttctatctttctgcctgttcttgtggcaatcacataccaatttcttttttcagtctaaaggctgaccaaaatgctatgtagactaggttctggaatatttaaaaggaaatacagtttgtgtgcctatcagccaaagactgcatacctgtagttaaacaaagttgggttttctctttttttttttttttagaataagggagactatataccatagggagggcttgttacaggatttgaacttgtgttaggtcattttagacaaagttcaaagaaacacgaattagatattgtcagaaagtggggtaattctatcatttgttatcctaagacgttttaactagaaggtaggaagagtggcatgaggctacataataggtaaagaagaagcagttgcatatgttagctggataaggggagcctttagctattagtgtggtttgtacaatattcttacagttatcactacccagacatgattccacagtggttttatttttgtcttgctttattacggtcatagagtggctttgtttgatgttggttttctgtgaaattattcatgttccaaaagagaaaaccatgacccagcccttagtgccaggtaaactgcagcttacagctgttagaggttgcttattttttcttttgttaaaaaatcaatttattacttttaaagtagtttttgtagataaagttgctagaatatgttgctaagcaggtatgctttaagaactagataagaaaaaaaatttctcattattaggcaacaatttgtattggtcgatttgcagcaaccagagaaggaaaccaaaccacaatccctgcagcaaccagtctgggaagtcaaaccacaatctctgcaatcatcagcccagaataatcaggaaatggccaatggctgccatatttgtatttgttatgtaattgttggataacagctattgttacagtgtaattatatacagtcacatgtaacttaatgatagggataggttctgagaaatgcattggtagacaatttggtcattgtgtgaacgtcacagagtgtacttacacaaacctatatggcatagcctaccacacacttagctatatagtatagcctattgctcctgggttataaacctatatagcatgttgcttgtactgaacactgtaggcaggtataacagaatggtaagtatttgtgtatctaagtatatctcaacatagaaaaagtacagtaaaaattatggtattataattttatgggtccacccataataagtagtccattgttgaccaaaatgtcattatgcagcacatgatggtatgaacttgaaatagtgttcttggaaacaactctcctaagtatataaatttcttatgctcttattatttacatgatttctctatttatttacatttctttccctctccactttgagaaagtaatgcagatgttatttcctccatataatagtctagcaggcagccatttttaattctagcagataaatagaagatttgaagtagcttttatttttctgagagtagttcaacccagcaaatcgctttagtattttttgtgtagctaggtgaatccacaaaattccagttactgtagaaataaagtgaattttaaaaaattaaactgtttataaaagctattatagaaataaaattaacactgttgggactgtaaactagttcaaccattgtggaagtcagtgtggcgattcctcagggatgtagaactggaaataccatttgacccagcaatcccattactgggtatatgcccaaaggattataaatcatgctgctataaagacacatgcacacgtatgtttattgcggcactattcacaatagcaaagacttggaaccaacccaaatgtccaacaatgataggctggattaagaaaatgtggcacatatacaccatggaatactatgcagccataaaaaatgatgagttcatgtcctttgtagggacatggatgaagctggaaaccatcattctcagtaaactatcgcaaggacaaaaaaccaaacaccacatgttctcactcataggtaggaattgaacaatgagaacacatggacataggaaggggaacatcacacaccagggcctgttgtggggtggggggagggggagggatagcattaggagatatacctaatgttaaatgacgagttaatgggtgcagcacaccaacatggcacatgtatacatatataactaacctgcacattgtgcacaggtaccctaaaacttaaagtataataataataaaaaaagaaataaaattaaattccaaaaatcctacaggaagctctgttgtgtatgaattaggctgagtgagataagttgactataatattctgattttttacctaaactatgcaacattagctgacgcagttattttaactgtatctcagaagctaaattatctggccaacatcactgcaaacattctatactgatggagtagtgtcactgctgtttttttcaaccctttgcttttagtcattctgtcatactggcaaacataaattgtgtgatataagaaaattttatgaggtaaaataatatctttaacaaatatatattttgatgagagcattgtattaatatttggtaataagatagccagactgttgaattaatcatactcagaaacttactgcattgggtggagattcagacaaggaagtgcatagggcatagtcacagaaggaatctgtctaaaaattgtatttacttgctttcatgtgattaagcataggcagagattaatattcaagatgaaaattccagatcctagaagagcagaggaaagagtgatatgggaggaactatgatagtggacaagaatttaaatagcttgatcttgaagaactaggattaaagatcatttaggaaccagtagcaaaacgaattcaataccaggtctactgaccaaagttttaaaaaaatctcctttatctagagagtggattacttttaaaggaatgattgtagtttgctgaaaccttcaatttcattttgaatgaaaccaccaatcattttcttcttgtaacttcacactgcaaaaaattttgagctttttttttgcccttcgtattctctctgcctaggttagctctaatttatttctttccctagttttctttttctttttttttttttcatttctctttgttcagtctttcttttcactgtctcagttgtacattctgcctgtgttccaagattaagaataatttctggtgctaaattgtcttgaggcatgttaagatttcagtatattgtaaatttctcatatgacttctttgacccatgtgctatttagaagtgtgttgtctaatctccaagtattttgggggtttccagctatctctctgttattgacttctagtttaattacactatggtcttagagcatactttgtttggtttctattcttttaaatttgttaaggtatgttttatggcccagaatgtggtttacctttgcgaatgttgtgtgaacttgagaagaatgtgtgttctgctgttgttggataaaatattctataaatgccaatcagatccagttgatgatggtacttttaacttttactatatctttactaatttttggcctgtgagatctgttaattattgagagaggggtgaagtctccaacgattatagtggatttatctatttctccttgtacttctattagtttttgctttacgtattttgatgctctattgttagacacatagacattaaggattcttatttcctctggaagaattagcccctttatcattacgtaatgtccatctttatccttggtattttttttccttgtcctgaatttggcattatctgaaattactatagctacacctgttttattttaattagtgtttgcatagtatctttctctatccctttagttttaatcagtctgtgtctttatattaaagtgggtttcttgtagacaacatatagtgggggactggttttttaatccaccttgacagtctctgtcttttaattgatatatttaattcattgccatttaaaatggttattgatagagttgaattaatatctatcatatttgttaccatttttatttgttggctttgttctttctggtttttttttggtcttatactctttttctgtcttgtctaactttgagcattttatatcattcaattttctctcctctcttattaattctacttatttttatactttttttagtggttgcccttaggtttgcaatatatattcacaactaatccaagacccctttaaataacaatgtaccactacatgagccatgcaagttcccttataataaagtatttccagttttttcctcctgtcctttataactgcgttcattcattttacttatccataggttataatcaccaagtacattgttgctattactatttttgaaaaaaaaaatctgttagctcaattaagaatttaatttaaaaagttttttttacccttatttattatttccctaacagtctttctttctttgtatagatctacgtttctgacccatatcattttccttctttctgaagaatttcttttagcatttcttgcaaggaagatctactggtgacaaattccctcaatttttgtttgttcaagaaggttatttctccttcccttttgaagaataattttattggatacagaattctaggttggtgtggtgtttttctttcaacactttaaacatatcacttcacatttttatggtttgcattgttcctgaagagaaatctgatataattcttaccctaagtcctcaatagataaagtttagtttttctgcgtttttttttaaagatttttctctttgtctttgatcttctgtagtttggatataatatcctatgcatatattttttggtgtttatcctatttggtgagctgagcttcctagaattatggtttggtgtctgtcgttaattttgggaaattctcagtcactattgcttcaaatatttcttctgtttctttctcttgacctttctgatattcccattatgtgtatttacattttttgataatcatctcatagtgctaggatattcgattcttcttttttctctttgcatatcagtttgaaaatttctattgaattttcttcaagctcactcttttctttcttcagccatttccagtctataggtgagcccatcaaggacattcttcatttctgttagagggcttttgatttctagcatttctttttgattcttagagtttccatttctctgcttaaattacccacctgttcttacatggtatccactgttttttataaagcccatagcttattaatcatagatttaaaaaatctctgtcatgtctgatgcagtttttgacacttgctgtctctacaaactgtgtcttttttggtcttttagtacatcttgtaatttttaaaatggaaaaaaggatgcacaggataaaagggactgagatacataggcttttagtttgagattatgtttatctgattggggtcaagctgtgattgttctttgctgtagctgtagctgtaatgtcagatggcaaaatttttttctgtgtccttgtttttgtatcttcagttgtctttaggttcacttagagactctttcttaaataaagtctgatacatgcaggtttttttttttgacagagtctcgctctgtctcccaggctggagggcagtggcgtgatctcggttcaccacaacctccacctcccgggtttatgccattctcctgcctcagcctcccaagtagctgggactactggtgcccaccaccacacccggctaatttttttgtatttttaggcctcccaaagtgctgggattacaggcgtgagccaccacgcctggccacatgcagtttttaaaagttgttttcccctgttattataggagccctattgatgtggtgttgaggtgtgggggagggaaaacattctgtaggtctataattaggactcagtcttttagtgagcctgtgtccttgggctgtgaccttcacaagtgcttctcaggttgatttatttttcttttattaggggagacaggaaggctagagttggtatttcttctctcttcccctacctggaaggctggagatggctggaggtgggcatatctcttccttcagtttggttaggctgtgtgtaaaacctcacttggataaagttttacttaagtaaactagtttccactagttttaagtggaaactagtttctcttgaggacaggtcttgttaagaacagaatgctctgagtatatttcaaaatgactcctttttccctccctctgctggaagcaggttgaaattttgttctgatcttcactgtaataacctcacaaaagtgagttgcaggtaaaactcacaaaagtgtagggacacctctaaccctccccactccaccagagtttttaactctcaaacttgttcacattaaacctccagcaatttgtcagttaaattttaggctgtaatcactgtagctcgaaccctgttactgcttcccacgcggaagtttctgtccttaggtttctgctcaggtatgttgtgatccctatatctgcctgtctgtctctctgtttttgggacagcaatttgtcctgtgaccttagttttctgatggatctaaagaaagttgttgattttcagtttctttgcttttttcttgttttgtggaggagagcgatgacttctatctaagcttccacatgccagactagaaatggaaatttcagtatcttaaaaaacaaacaaacaaaaaaacttaaaatcttagggtctatgttggaattaatttatatacttaaacaagggtctcagtatcataatagtagtaaataattgttaatgatttacaactttctgagttacttcgtagactcaaatctgattttgatacacaataataggggcataagtttaaccttttaattatattgaggtttactatgagttattttaaaattgagaagtgtttagtgagtgtttaagatgtatccagcattctttttcttttaaaagtttttttttattttacaagtaatgtatcttccatgtaaaaaagttagaaaatacaggtaagcaaaaacagaacaatctattattttacctagatataaccatcattaatgtttcacagtatttatatgtgatgtttttctatgtttatgattacatgtaaaaagtttttatataaaaatgggattgatacattcttcttggtaatatttctacttaatatattattaacatcttccttgtctgctcatttatttattttttatatatggttaagtggttcatagaattctattaagcatcctggcttatttaaatcattactcaattatttctaatattttactttcctaaagatactacattaaatgtctttgtgcatctttatatacttagaattcttccttgggataaattcctaggagagcaacttcacagctagaaagttagcatatttttaaaggtttttgatatatgcgaccaaattgtcccactgaaaggttgtacaggttgagcaacccaaatccaaaacatttggttattatcctgtggttcctttaactcaatggttgatcttgactctacaccaagctataattcttttgaaagccatttttgtctctggtcttaaattcatatagggcaaatcaagttctttcatctcgagatgggatcaaactactgaaatgctatatagctctcattctaaagctatcagtcacaccatgtgtattcactaggttggtgaccttgaacagttgattagcctttctttttcttttttcttcttagagacagaggcttgctctgttgcccaggctggagtgcaatggcaaaatcatagctcactgcagtgtcgaactcctgggttgaagggatcctcccacctcatccttcccaagtagctggaactacaggggcgaaacaccattcctggctaatttatttttattttttgtagagatggagtctcactatgttgcccaggctggtctcaactcatagcctcaagtgatcctcccaccttggcctcccatagtgctgggattacaggcttgtgtcaggactcctggccttgattagcctttgtaagcctcaatttcatcatttgtaatcataccacccatctcatggggctatagaaataaataaaaattaaatgatataatccacgtaaagtgtttttcattgtgtctagtacgtagtaaacaaatggtagggatatcagccctgggtgcaaggattgtatacatatagacttcttggtttattgctaatgtagcaagaggacagctgtcattttcaagttctttgcaactggcaacaaataagctaagaaagaaagacatggactatattacttctttggtaggggacaaaaatactgtttctgtaagtagattgtgtatttagattttattttatttatgatggaggctcaaaatgttccccctcccctgtctactactggaaattgaagaagtcaccatctgaggaaaagaggtaacccacagatacctaaaagctattcatatttatagaaataacaacagtacctgatatctcagtggactgtttgaaatgcaagtgtgtagctcatgagggaatcagacgaaagcaacagcaaatcgtctttagtagtttaacaccataattagttagataactaatctttttcaatcgtcgaacataacgttaaacataaccccattcttgtttcttttaagaaatacactattactgagaaatatagaaatacctatcaagtgtctataggtatttaatcaggtgtttaacatggtttccggtacaagtatttgtattagaagtacagatggaattggaaggggaccttaaaatgatctagttcactcttttattttatagatgaagaaactgagagattgagtaatgtgtccaggttagattgccagtgacagacctgagaactgaactacgtctcctgacttctaacaaaatatttttacatgtcattctatttctgtaattttgtttcacaagattttcattttttttaaaagtggtttttattttacccaaaagccaaattattttctatgactgctaatttccatttttattatatatcaatgagaaagatcattaagttcatataaattagtttgatagctatatagacacataaaatagattcaacaaaagatgtatttatgtttttcaaatgtgatacagtattaagttgcaatgtgtttacatgttaaatactctggggagagaagctagtgtagctaggaagaaaataaaagtttcagacaagcaggagaatttaagtggaagtactagggcaggaagaaagatggagtggaagccatgaccataaaagatactgcgaaatggaataccaaatttgagttcttaagagtctagaagagtatgatgacgaggctgtgttcatttgaggctgatattaattagtgatgatttgttgagttgaaagagaggacagaatgatgaggtcaaagtgtatgataaattgaagcaaggatattgaagactctgaggctgttgatagggtccagagtagagagaaaatatataagccagatggtaaaatcacgtaagaagatgaaaatgagtcctaggggtggaaaaaaaaaaacagtggaatttatttgtagagcactatctggctacatgagagattgttctttcagtcttgtgttctttattgaataataaagatgataggattggatatcctttaggggttatgcccatggttagttcatgttattagtgtgctggtattcgtattactctgtcactatatattggtatgtatatatacttttcaatggcaagaattgggcctgttaatatatataatttgatgtgtttctttgaaggtatgttttaacatatatatatataatattatgaaaggaagtgatagtatgagagatgatgagatagtttagagatggtaaatgaatttaatttgaacttgattctctcgtgttttgaaaggacacttttcttttaagtttaagtactataaatttgtacttacataatatgttcaacttacagagcatattaacatgcattatctcaatcatgagttttggggtaagattaacagtgtgaattacagaataagttactcatatatatgaattttgataaaaataagtagtattttgaatgcttataaggctcttgagctttaaacaatagaatctctgatctcaagtaattaatacggtagggaagaaacacaggtagtaaagaataatctacttttaatctgtaataatcactagatttaataatacattagtatgcataacatattggcaattatataactgcataaaatattgtaaaaatgtaggtgctcattctgttctaacatcctagcattatataattcagtttaatatggtgacagtagtcacaaggatggtcagtgggaaaagggtgagaatgaaagctactgtacttttaaaaaaaattttaaatgtgccttcattactatagaaagttcagacaacagctctgaatacagagataattatatattgatttaaacattattctagataaggaatttatttaaatatttacaaaatactttattacaattatttacctttcttaaaatatgacataacagtttttgaaggaaaaactgcttatatacacaaatcatatcaatgaactggaaaacactacctattaatatttaatcgtggcactaggctcagtgaagggggcaaatggaaggcatgatgtctgtttataaaggagtttagaacttatttggggagaccaaagtgccatatcattcgtcaataactttgaataaaaatggaaaaatcaaaaaaggaaaaattaaatgtcttcacagtgagctgaatattattttcaaggagaattcagtacacatatgctcctataagcatttaaacacaagccatttaaaacacctaagctgtggtgttggcttagcattttaacaaatattttatgtagcagtaaggctttgacttggaatttgagaagataaataggtgaatattttatttgtgaaaaatgctaacatttaggacctcattcgtttaatcgctgtgtataaataattttatgactattaggtttttgaagatactttgaaaagatattttattagcagctccaatcaaagcaaaatattaaaattgttcttgagatatataaacaaataattacttcttgaatactaaattctgatgggattttattgtcacagctacagtagaaattgatgacatcggctctgtatttctaatagaattataacaatggtattgtaatttctgtagtattcaataaacattgagatatatgaatataatactgctattaatgaagattatgaaaacaggttaatctaagttccaagctagtgaaaagtattttgtctttctaaccactttatataatagaaaatatattattcaatgttactgaataaaacctttgttttgaggcttttaacaaatttaacagacttcaaatttacaactagaaatataaataagaatttcctccctttttttttggtaattgcttattgctagtataggtaatagctactgatttttttttgttttaatcttctacctagataatttaccacattcttttatttccaaaacatttttagtaatttgtttctattttcttgtatttatatgcattatttcaatttattgtcttgctgaattagcttgaatttataaaacaaagttgaataataatgggaatagcaaatatatatgttttattcctgattttaatgggaatgactgtagttttttgttgtttagcatatgtttgttattttcattatgtcattttcttctaatcctatttcacatatttacctggtttgactgctaaatttcatcaaatgcctttccagaacctaatgatataatcatggttttattctttaatttgttgattaatgaataatgtcaatacaaatccttattcaacttcttgttgaaatctaacagaaatatgttttaaattttatttattttcccttccatgaaaaagaaaaagtatgaataattttctggctttgtaaataaaattaactcatatttatatttttctgaaaatgctatgtcaattaaaaattattatcacaggaaaaaattaagtaaaacaaacaatcagaattacagattccttagagactaaagattatattcacaagaggtagcagcaatctgtaaagtacagctgtcttgtaagactcctttttagagacaacatttgcaaagacatttatatgatgaagaatatcatttgcttttctgtatctgtatcttgccaaggtttattttgtaagcagttagaagttctcacaatttgaaggctagggtctggaaaactcaaaatttaaattaaggaaaggaaaaggataaaataagttagtaactaataagagtatgaggtatatatatttagtatctatacttacatttgtggaataaaatgtgtttggccatggtttatcattgtttgaatatatcacttggttttgatttatcagtatcttatttagtgttttgcacctatatttataagtcttcatttgctttataatgcttaaaacaatctgatattatgtagactataaaatatgatgagtttcctgtgaaattactactatattcaaaatagcccttttgtggctatttcatcctttgtggccctttgcagcagcccatccatcttttctgccttggacccaggaaacaactgttttcttcttcttcttcttttttttttttaaactggatcattagtatcttatatagtttatttttctctctgtctcgctttctctctttttctctgtctcttctgtttgaatatatgtatctgatgtttaacatattgaaagatgagggcaattgggggaagagtttgggactgaattagtgataagcacataaaaactaaggaaatgaagaaaatttaaaaaaattagccccagggaacaaaaacatttgtgtggcaaagtaaaagagtagtagttagtagagactgaacagttaggatttttttttggaggatggggatgtgggaagtatgcttgtatgtgtaatgggggtaggtgagaaagagaatcctttttttttccctttggaaaagtcagtaagtagcaatgtaaaaatgttattttgagacacattaagtaaaaatacaaaaataaagagcaaaaaatattgaaaagtggttgcatctgggaagtaggaaatgggagagggaaggagacatatgacttttaattatcttaatatgtcctatagaattatatgacttgttaaactatgtgcatgatagactatgttaaaaataaaactagcatgagaagagaaaaaagttagatataaaatttcaaaaaataagttaatgaacaaatatcccatttctattatatatatttccaaatataaaatgggagtggattagtgctttattcttttaacaatttaatataactaccttttggatctttgaatgtgatagtttccttgttatttcaagagatttgtaagtcttactgagaaactagtaccaatacttccatcgccaatgaccagtggttgtttacgtgagcaggtaatttgccactcttgtgcatacagaacaatcttacttttttatttttttgaatcacaatgtgatggagtttcatgggaacttgttatttctatcaccgttatgccactctatggtgtcatatgcattatagaccttttacttagtcttttctttcatccaagagagcaggaaattattcagcaatactttcagtgacccaagatgacatcagatttaggtaagagctgtgaacatacacacataatcctaaaaaactcaaggtttaaatgatttggctgttattgaaaacaagcatcattgaaattgagggacctttctcaacaatgagagttgctccatagttccagtaataattggcttttgtttaccaaagtggcaaaatatgttgtgtccatcacgttccttactacagatattttatctcaaattatatcaattcatgacttactgcataaattttgagacagtttatgtacaatttctgaattcaagatctggaatgatatgccccaatccacactttacccagagtgtaacatctgtagaccaaaaactcgacaagtaacctaatatcagaaaaggcatagcatatattaggtaatcatagctatttactggcaaatcttctacctagaataatttttaaataaaataaatgtatttcataattggaatattctattccctgttacatataggtattattattattttctatacatggtagtttccaatggttacattaatattattaagtgaaacctggtacaatgcttctaggagttctgtgttcaaatatagaaatgatagctttggcatatcagtattatttgaataggatatatatatgcaatgtcaaccaaaaaaatcagatgaaaaatatgtccaaatatgttgaatttatttgggaattagaaatgaagttttttttaacctgagatgcatagccatgccaagccatgtatgcatctgaagaggcgagagtaaaacgaagctggtattggcaaaaggagaagttcacataaactgcttggaaatagaggtcattggttttggagactcaaagccagagttggcatcagttcattggtggaaacgctattactgggcaagtgttctttcaagaggatcttatattaattatagcagtactgaaaaaagaatttctcttggagttgttttagaaagtccttgagacagtctttatctcagacatgcaagcatgaacccttcatgcttttcgcttttccagctctggtttgtttgggtctacaaaaaatgatttcattctggtatctgcaactttcacagcatgaaccattaatatgatagcacactagaagtctttagaatcaaaagccatatttatttttttcattttttaggctgatgatcaatactgggaagcattcctcataaattaacttggtgatctaatatttacttctttttaaaaatgaatggttggggtatgtattaggatgcaagttaggctactgtaacaggccataataactgtggcttaaacaatatagaaatttatctgtcttttatgaatatgtccaatcaaaagcaaccttgaactgattccatgattgtacggtgtcaataatccaacaagatctttctatcttgttctgccatcctcaacatatggcttccatttcatattctaagatggctgttctaactcctgctattgtatctattttccaatcagtcagaaggtaagaaaaatagaatatttgcctttaccattaagaatatattatatataatttcttctgttttcctttgttcacgatctggtctagcctgcagtggaggctgataaatatagtatttaactggattgttatctgctgaactaaaacttctattagtatagaagggaaaaatgcagacattggggaacagtagacagtccccatcacaggtggttttgaggctattttgccacattatgacagtattaagcctgaacaatcaggcctaatataaattctgctttgccaaagtactgctgttagttctatcctggtccctttgtgttcccaattatactaagaaaactaaaactaaaactacactaaaatattcagatttttttggtagctgggttctggttagattctgccaatgggaggcacttatgtcaaattaaaaagtagaggggaagcaaaagtcattttgtttccggtagtgcctcttgcaatatcagcactgagtacaggtttatgtatttcatcctcagaagaggtagcaacttccttaactcagggtagtatgactagccctcccacatatttgtaactaattctttctattacatatttatttgcttcaaatatctagatagatttgtgtaactattgatacgttggccacttcattcctgtaatattttgaagggagagtggaacaaaagaaaacaagcaaagcaaagtagcattaagaagagctagatattaagaaattcacttattttttactagctttgctaccattatcttacttcactgagcataaattataatatttcaagaacactttttgactttgtctaaaactgagaattttttaagcttaacatagttgtcttcaaactctgttctacattttctttgctccttttttcctactgcatctatatcattccagttgatgtccttgattcttttgaaatcaactaggtaccccaactgatgtcaactttttattgcatactttgtctcataatacgatttggtgttcttgagaagaaaaaattcttttacttcaaattgaaatataacccacccaccatacaattcacctatttaaagtgtacatttcagtggtgtttggtatgttcacagagttgtgcaacaacctccacgatcaattttagaacatttccatcagtccagaaaggcacgttgtattcattaacagtcaattcctattactctgaacccccatcccttggcaaccactaatataaattctgtttctatagattttcctattctatacacttcatgtaaatggaatcatacagtatgtgactagcttcttcagttagcataacattttcaaggttcatctatgttgtagcacatatcagtacttcattttttaaaattgaggaacaatattctattgtgtggatataccacattttgtttatttattcatcagtcgatggacatttgagttgtttctttttggctgctatgaataatgctgctatgaacattacaagagctttgtttatatttatgttttcatttctcttgggtttatgcccaggagcagaattgctgaatcatatggtaactctgtatttcatatattgaggaactaccaatctattttccaaagagcctgcattattttacatttctaacagcaatgtattagggctccaatttctttacatctttatcaacatgtgttaatatatctgttttttattatagttatcctagtgggtgcacagttgtatcttgttgatatgatttacagttccctaatggctaatgatgttgaggatctttcggtgtttattggccatttatatatattatttatttattatataataaatgtctgttaagatcctttgcccattttaaatttaggttatttgtctttttattgaattttaagggttctttatatattctggattaagttctttttcagatatttgatttgcaaattattttcccattctgtggattatcctttcccatttttatttcaatagtttttggggaacaggtggtttttggttacatagataactactttagtgctaatttctgagatttttggcacccatcacctgagcagtgtacactgtacccaatgtgtagtttttaactctcacccaactcccacccttcctcctgagcccccaaaatccattatatcattcttatgcctttgtgtcctcataggttagctcttacttatatgtgagaacatgtaatatttggtttttcattcctgagttacttaacttagaataatggtctccaactccacccaggtttctgtaaatgctattatttcattcctttttatgacagagtagtattttacggtgtatatataccacattctctttattcactcattggttgatgggcatttaggctggttccatatttttctgcgattggaaattgtgcagctataagcatgcctgtgcatgtgtctttttcatataatgattttttttttcttctgagtagatatccaatggtgggattgctggatcaaatggtagttctacttttagctctttaaggaatatctatactgttttctataggagttgtactagtttatattcccaccagcagtgtaaaagtgttcacttttcaccacatccacgccaacatctattattttttgatttttaaattatggtcagtcttgcaggagtaaggtggtatctcattgtggttttaatttgcattttcttgataattaatggtcttgagcatttttcatgtttgttgaccatttgtgtatcttcttttgagaattgtctattcatgtcctttgcccaatttttcatgggattattatatttatatttttattttttgctgatttgtttgagtttcttgtagattctggatattagttgtttctcagatgcatagttagtgaatattttctcccattctgtgggttgtctgtttactctgctgattatttcttttgctgtgcagaagctttttagtttaattaggtcccatttatttatgtttgtttttgttgcatttgcttttgggttcttggtcatgaactctttgcctaagccaatgtctagaagagtttttccaatgttatcttctaggatttttatggtttcaggttttagatttaagactttgatccaccttgaggtgatttttgtataaagtgagagatgaggatccagtttcattcttctacatgtggcttgccaattatcccagcaccatttgttaaatagggtgtcctttccctaccttatatttttggttgctttgttgaaggtcaaataccttgtcaaaatattcagctgtatttctgggttctttattctgttccatttgtctacatgcctatttttataccagtaccatgctgttttggtaactatagccttgtagtatagtttgaagtcagataatgtaatgcctccagatttgttttctttaactgtctttgatggtgtcctttatagcgcataagtttttgctttggacagagttcaatatgtctgttttttgtttcattgcttgtgtttttggtgttttatttaagaaaccattgtctacctttccacagtgtagacatacatcaaaacaccatgttctaaccataaacatttataatttttgtcaattaaaaaataatttaaaaaaacattacctaattgaagtcactaagatttaaacagatttctttattcttagagttttatagctttgacttttatatttaaacgtacgatccattttgagttaatttttgtgtatgttataagtaagggatttaacttgattcttttacatgtggatatagagttgctacagcaccatttgctgaaaggattagtctttcctcaatgaattgtcttggcactcttttcaaaaatcaatggactgaaaatgtgaggatttatttctggaatctcatttccgttccattaatctatatgtctatccttatgccaataccttattttcttgattactttaggtttgtataagttttgaaatagaaaaatgtgagttacctaactttgttctctttcaagattgttttgttattatgagtctcttggatatctatttaaattttaggattagtttgtcaattttttttattatactttaagttttagggtacatgtgcacaatgtgtaggttagttacatatgtatacatgagacatgctggtgcgctgcacccactgctcaatgaaataaaagaggatacaaacaaatggaagaacattccatgctcatgggtaggaagaatcaatatcgtgaaaatggccatactgcccaaagtaatttatagattcaatgccatccccatcaagctaccaatgattttcttcacagaattggaaaaaactactttaaagttcatatggaaccaaaaaagagccagcatcgccaagtcaaccctaagccaaaagaacaaagctggaggcatcacgctacctgacttcaaactatactacaaggctacagtaaccaaaacagcatggtactggtaccaaaacagatatagatcaatggaacagaacagaggcctcagaaataatgctgcatatctacaactatctgatctttgacaaacctgagaaaaacaagcaatggggaaaggattccctatttaataaatggtgctggaaaaactggctagccatatgtagaaagctgaaactggatcccttccttacaccttacacaaaaatcaattcaagatggattaaagacttaaacattagacctaaaaccataaaaaccgtagaagaaaacctaggcattaccattcaggacataggcacgggcaaggacttcatgtctaaaacaccaaaagcaatggcaacaaaagccaaaattgacaaatgcgatctaattaaactaaagagctactgcacagcaaaagaaactaccatcagagtgaacaggcaacccacaaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcggagaaatgcaaatcagaaccacaatgagatatcatctcacaccagttagaatggcaatcattaaaaagtcaggaaacaacaggtgctggagaggatgtggagaaataggaacacttttacactgttgttgggactgtaaactagttcaaccattgtggaagtcagtgtggcgattcctcagggatctagaactaaaaataccatttgacccagccatcccattacggggtatataccgaaaggagtataaatcatgctgctataaagacacatgcacacgtatgtttattgcggcactattcacaatagcaaagacttggaaccaatccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggtgggaattgaacaatgagaacacatggatacaggaaggggaacatcacactctggggactgttgtggggtggggggatgggggagggatagcattgggagatataactaatgctagtttgtcaatttttgcaaaaaagccagctgggattttgacagagattgcattgattttaatatcaattcggagagtattgccacattaatgtttaatctatagatatctgggatgacttttatttagatcttcaagttttaaaagaatattgtgtagttttcagagtacaaattttgcacttcttttgttcattttattcctatatattttattcctttggattctacttattataaatggggttctttattttatttttggatagtttattgttagtatgcaggaatacaattgactttttatttttttaatatttcacttttaagtcctcataaaagcctttattatagcctaatggtaaagcactggatttataatggtgattttgcaacatggtgaatcaagacatttatcttcataaaaacactttgaagcagtgacttcaactcaccgtttctatagttctgacaacaattaatgtcatttttcttcttttggcattgatggatgcttgatcatgcaactatataaagtacccatgcccttatcaataaacaatatccttggtcaatgaataagggtgtgtacaatttttaaaattttttccgtatagtttcttttgtaccctgtcacccaggctggagtacagtggtgtgatcatggtttactgcagcctcaacctcccaggctcaagtgatcctcctatctaagcctccagagtatctgagactataggcatgcaccaccatgcccagctaatttttttttttcttaatagagacaagatctctctatcttgcccagggtggtatcgaactcctgggctcaagtgatccacctgccttgacctcccaaagtgctgggattacaggtgcaagtcactgcacccagcccattttccatatagtttctaagcaattgtcaggcattgttctaacaagaaatggatcttacagacatgcttgaaatagattcacttaaagagctgttgaacaaatatgatatgaaatataaacttggagtggggaaaactactcattataaataagcagcagtggaaatctatacagtaattttttgccagtagctccaatagccttgaaagatctcacaattgactttttttttttttttttttttgagatgaggtcttgttctgttgttcaggctggggcgtagtgacatgatcatggctcactgcagcttcaacctcctgggctcaagtgatccttctgccttagcctcctgagtagctgggactgcaggtgtgcgccatcatgcctggtgaatttttccttttttttttttttttgtagagatggggtcttgtaatattgcccaggttggttttgaactcctgaactcaagcaatcctcctgctttggcctcccaaagtgctgatattacagacatgggccactgtgcctagcccacaattgagttttttacattaattttgtaactttagcttgcagagctcctttattagttctaataattttttagtgtatttcttaggattgcatttatacaaaattgtgttccttgcagatagttttagttcttccttcctatctggatgtgtcttacttctttttcttgtctaattgctctggatgggatagaaccttcagtacaatattgaatagaggtggatagagtggaaatacttgtttgattcctaaccttagaaggaaaacattgattctttcactaatttttatgatgtaggttttttatacatgccatttattagatgtataaggcaggaacagaaagaaaagttgaaagaattatattgtgaacactcactaatatgtatattcttaccactaatatttgacagttatcattcacttatcatgtatctatctatccatctgtccacccaggtatctatattattttgtggatgcattttcaagttgcagatgtcagtatactttaccctttaacacctccgtatacataacattgaatagattttaatatttgtttctaataatttcttaacattttttgaggtgtaatttatatgcagagaaatcacaaattttattgtaccattttatgagttttaactaatgtatatgcttgtgtaatccaaattgctatgaaaatacagaatattacatctttactcaaaaaagtttcttcatattccttcccaatcaataactcttcaagacaactactgttctgattttataaacttgtgtatggcttcttagcatagttttttttgagaatcatttgtgttgttgcatctatcagtagtttgtgtcttttaattgtttagtagtattccattgtatgattatatcatatcacagtttgtttttttaattcttttgttggacacctgggctgtttccagatttttactattttgaatacagctggtagggtcttacttatacaaatcattttatgaacatatgcttttaattttcctgaatatatgcataggagtggaattgctagattgtaagacagatgtatatttagttttataagaaactgcaagatattttaaaaaagtgtttgtatcattttacactcccatcagcaatgtatgagtttaggttactccatctctgtgttaatgtttggtggtagcttttttttttcctttaaactaattttagacattctggtggctatataatggtatcttgtgattgtaatttttatttccctagagacttattggtattatttgctctctttcagacagttcggcatggttttcctcatcagcccacagcattagcctttgatccagttcagaaaatcttggctattgggacgagaacaggtgctatacgaatgtatccttaaattttggttcattatctgccacagtaatgccaattacatttctttaaatattcaggtaagataaatatttatgaccaaataaagtttattattttttaagaaatgagtaactattgtgaaaaatctgcactttcaaatttattggcatatttttaatgtctttgagatcagtattgatgtctcttctttaactcctgttatttgtaatttgtatcttctcttttttccttatccatctgcctagaagtttatcaattgtattgattctcatgattctcacaaagaatcaacttttgggtgcgttgctcttctttattgtgtttctatattcgatttcattgaattctgctttaatcacttaaatttctttgcttttgcttacctggggtttaatttgatcttctttctctagtttttaaagtggaaacagttaattaatttgagaactttcttcttttctaatatgtgcctatagtactataaatttcctcccaaattctactttagtgtcatcttgttttttaaaattaaactttttgagataattaattgtagatgcacatgtagttataagaaataatacagagatatccatattctttcacctactttgctccaattgtagcatcttaaaaaactatagtgtaatatcacaaccaggatattgacattatacaatcaagatacaaaacatttctatcaccacaaggattcttcatattgctcttttatggtcacaccttgtccctccaaccccatccttgacccctaacaaccactaatttgtttttcatttcaataattttgccacttcaaaaatgttatataaatggaatcatacagtttataatttttggcgattggccattttcactcagtataactctctgaagattcattcatattgttgcatgtatcaatagtttattcctttatactgaattggataatattccatggtatagatgtaccacagtgtagccattcacctattcaaagaaatttgacttgtttctggtttttggctattcttactaaacaactatgatcatctgtgtacatatttttgtgtgaacctaagtttttgtttctctggtgtaaatgcccaggagtacaactgaagggtcatgtggtaattagatattttagttttaatttttttagtgtaccattcagcgttattaaatacatttatattatgcaaccatcatcaccgtccttttctgtaaatctttcactttgtaaaactgaaactctacacccattaaattataactctccatgtccctcttcttctagcccctggaaaccaccattctgctttctgtttctataatttttactactctaggtaacttatataagtgaaagcatacagtattcttcttttttgtgactggcttatttcattcagcataatgtcctcaacgtttatccatgttgaagcatatgtgagaacttccttcctttttaagactgaataatatttcattgtgtgtatatatcacattttgatatctgttcgttaatttatgggcacttgttttttccatgttttagctattatgaataatattgctatgaacatgggtgtacaaatatctctttgaaatgttgcttttagttcttttgggtatatatccagaagaagaattgctggatcatatgataattgtatttttaattttttgaggaactgtcattctgtttctcatagcagctatactggtttacattttcaccaatagtaattgccctttgatgcaaatattttaaattttaatgaagttcaagttggctatttttttcttttgttgcctgtgctttggtgtcatatgtaagaaatctttaccaaatccaatggaatgaagcttttaccctgttttcttctaagagttttatagttttaggttttacatttgggccttttatccatttctgagtgaatttttgtatatagtaaaagggtctaatctcactatttggcatgtggatatcccattttcccagaaccatttgttgacaagactgtcttatccattgaatggtactggcacccttgtcaaaaaattatttgatcatacatgttagggtttgtttgtgggctctcctattctattccactgatctataggtatgtttctatgttactactacactgtttttatttactgtagctttgtagattggaaaccagatagtgtgaaatttgaaattagatgaattttcagcacttattgaaatgatcggatagtttttgttattgattatgttactgtgatatatgatatttattgatttgcatatgctgaaccattcatgaattcctgagatgattcccacttgataatgataagtgatttttaaaaaatatgttgtcttgttgaaattgatttgtgagtattttgttgaggatttttgcatctaggtttatcgaggatattggcttgtagtgttcttttttgttctgtctttgttggttttggtattaggataatgccggcctcatagatgagattgaaagtattccctgcttttcaatttttttcttaagagtttgagtagaagtagtattagttctttaaatgtttggtagacttctgaattactactgagtacataacgaaatgaaggtagcaataaagatgttctttgaaaccaacgagaacaaagatacaacataccaggatctctgggacacatttaaagcagtgtgtagagggaaatttatagcactaaatgcccacaagagaaagcaggaaagatctaaaattgatgccttaacatcacaattaaaagaactagagaagcaagagtaaatacattcaaaagctagcagagacaagaaataactaagatcagagcagaactgaaggacatagagacacaaaaaacctttcaaaaaatcaacgaatccaggagctggttttttgaaaagatcaacaaaattgatagaccgctagcaagactaataaagaagaaaagggagaagagtcaaatagacacaataaaaagtgataaaggggatatcaccaccgatcctgcagaaatacaaactaccatcacagaatactataaacaactctatgcaaataaactagaaaatctagaagaaatggataaattcctggacacatacaccctcccaagactaaaccaggaagaaattgaatctctgaatacaccaataacaggatctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcattttatcaggccagcatcatcctgataccaaaggctgacagagacacaacaaaaaaatagaattttagaccagtatccctgatgaagatcaatgcaaaaatcctcaatataatacaaaccgaatccagcaacatatcaaaaagcttatccaccatgatcaagtgggcttcatccctgggatgcaagtctggttcaacatatgcaaatcaataaatgtaatccagcatataaacagaaccaaagacaaaaaccacatgattatctcaatagatgcagaaaaggcctttgacaaaattcaacagcccttcatgctaaaaactctcaataaattaggtattgatgggacgtatctctaaataataagagctatctatgacaaacccacagccaatattatactgaatgggcaaaaactggaagcattccctttgaaaactggcacaagacagggatgccctctctcaccactcctattcaacatagtgttggaagttctggccagggcaattaggcaggagaaggaaataaagagtattcaattaggaaaagaggaattcaaattgtccctgtttgcaggtgacatgattgtatatctagaaatccccatcatctcagcccaaaatctccataagctgataagcaacttcagcaaagtctcaggatacaaaatcaatgtgcaaaaatcacaagcattcttatacaccaaaaacagacagagagccaaatcatgagtgaactcccattcacaattgcttcaaagagaataaaatacctaggaatccaacttacaagggacgtgaaggacctcttcaaggagaactacaaaccactgctcaatgaacttaaagaggatacaaacaaatggaagaacattccatgctcatggttaggaagaatcaatgtcttgaaactggccatactgctcaaggtaatttatagattcaatgccatccccatcaagctaccaatgactttcttcacagaactggaaaaaactactttaaagttcatatggaaccaaaaaagatcccacattgccaagtcaatcctaagccaacagaacaaagctggaggcatcatgctacctgacttcaaactatactacaaggctacagtaagcaaaacagcatggtactggtaccaaaacagagatatagaccaatggaacagaacagaggcctcagaaataatgccacacatctacaaccatctgatctttgacaaatctgacaaaaacaagaaagggggaaaggattccctattttataaatgatgctggtgggaaaactggctagccatatgtagaaagctgaaactggatcccttccttacaccttatacaaaaattaattcaagatggattaaagaattaaatgttagacctaaaaccataaaaaccctagaagaaaacctaggcaataccattcaggacataggcatgggcaaggacttcatgactaaaacaccaaaagcaatggcaacaaaagccaaaattgacaaatgggatctaattaaactaaagagcttctacacagcaaaagaaactaccatcagaatgaacaggcaacctatagaatggaagaaaatttttgcaatctacctatctgacaaagggctaatatccagaatctacaaagaactcaaacaaaaatttaccagaaaaaaacaaacaaccccatcgaaaagtgggcaaatgatatgaacagacacttctcaaaagaagacatttatgcagcccaaagatacatgaaaaaaatgctcatcatcactgggcaacagagaaatgcaaatcaaaaccacaatgagataccatctcatgccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattacggggtatataccgaaaggagtataaatcatgctggtataaaaacacatgcacacgtatgtttattgtggcactattcataatagcaaagacttggaaccaacccaaatgtccatcaatgatagactggattaagaaaatatgacacatatacaccatggaatactatgctgccataaagaaggatgagttcatgtcctttgtagggacatggatgaagttggaaaccatcattctcagcaaactatggcaaggacagaaaaaccaaataccgcgtgttctcactcataggtgggaattgaacaatgagaacacttggacacaggaaggggaacatcacaccctggggcctgttgtggggtgggggcaggggggagggatagcattaggagatatacgtaatgtaaatgacgagttaatgggtgcagcacaccagcatggcacatgtatacatatgtaacaaacctgcacgttgtgcacatgtaccctaaaacttaaagtataataaaaaaaaaaggaattcagccatgatactatcaggtcttgggattttctttggtgaaagattttttttaaattactgtttaaatcttattactcatttttgatctgttcaggatatctatttcttcatatttcaatcttggtaggttgtatatgtctagaaatttatcaatttctttgaagttttaaaatttgttggtgcatagttgttcgtaatagtttctaatgagcctttgtatttctgtggtatgaaatataatatctcctttttagtttttgattttatttagttttttttttcccccgtgatacatctctttgttcactgaggtcaattagaggctatactttagtctttctttttttgttttttttttttaattatactttaagttctagggtacacgtgcacaacgtgcaggtttgatacataggtatacgtgtaccatgtttgtagctgcacccatcaactcatcatttacattaggtatttctcctaatgctatccctcccccagccctcgtcccccaacgaggccccagtgtgtgatgttccccgccccgtgtgtgagtgatctcattgttcaattcccctctataagtgagaacacgcagtgtttggttttctgtccttgcgatagtttgctgagaatgctggtttccagcttcatccatgtccctgcgaagggctagaactcatccttttttatggctacatagtattccatggtgtatatgtgccatattttcttaatccagtctatcattgatggacatttgggatgcttccaagtctttgctgttgtgaatagtgccaccataaacatacgtgtgcatgtgtctttatagtagtatgattgataatcctttgggtctatacccagtaatgggatggctgggtcaaaaggtacttgtagttctagatccttgaggaatcgccacactgtcttccacaatagttgaactagtttacactcccaccaacagtgtaaatgcattcctatttctccacatcctccccaacatctgttgtttcctgactttttaatgattgccattccaactggcatgagatggtatctcattgtgggtttgaatttcatttctctgatgaccagtgatgatgagcattttttcatgtgtcttttggctgcgtaaatgtcttcttttgagaagtgtctgttcatatcatttgcccacttttcgatggggttgtttgtttttttctggtaaatttttgtttgagttctttgtagattctggatattagccctttgtcagataggtagattgcaaaatttttcttccattctataggttgcctgttcattctgatggtagtttcttttgctgtgtagaagctctttagtttaattagatcccatttgtcaattttggcttttgttgccattgcttttggtgttttagtcatgaattccttgcccatgcctatatcctgaatggtattgcctaggttttcttctagggtttttatggttttaggtctcacatgtaattctttaatccatcttgaattaatttttgtgtaaggtgtaaggaagagatccagtttcagctttctacatatggctagccagttttcccagcatcatttattaaatagggaatcctttccccatttcgtgtttttgtcagatttgtcaaagatcagatggttgtagatgtgtggcattatttctgagggctctgttctgttccattgatctatatctctgttttggtaccagtaccatgctgttttgcttactgtagccttgtagtatagtttgaagtcaggtagcatgatggctccagctttgttcattttgcttagaattgtcttggcaatgcaggcccttttttggttccatatgaactttaaatagtttttccaattctgtgaagaaagtcattggtagcttgatggggatggcattgaatctataaattaccttgggcagtatagccattttcactatattgattcttcctatccatgagcatggaatattcttccatttgtttgtgtcctcttttatttcattgagcagtggtttgtagttcttcttcaagaagtccttcacatcccttgttagttggattcctaggtattttattctctttgtagccgttgtaaatgggagttcactcatgatttggctctctgtttgtctgttaatggtgtataagaatgcttttgatttttgcagatttattttgtatcctgagactttgctgaagttgcttatcagcttaaggagattttgggctgaggcaatggggttttctaaatatacaatcatgtcatctgcaaacagggacaatttgacttcctcttttcccaattgaatgccctttatttctttctcttgtttgattgccctggccagaacttccaacattatgttgaataggaatagtgagaaagggcatctctgtcttgtaccagttttcaaagggaatgcttccagtttttgcccattcagtatgatattggcagtatgtcataaatagctcttattattttgagatatgtgccatcaatacctagtttattgagagtttttagcatgaaagggtgttgagttttgtcaaaggtcttttttgcatctattgagataatcatgtggtttttgtcatttgttctgtttatttgatggattatgtttattgatttgcatatgttgaaccagtcttgcatcccagggatgaagctgacttgatcatggtggataagctttttgatgtgctgctggatttgttttgccagtattttattgaggatttttgcagcaatattcatcagggatagtggtctaaaattctcttttattgttgtgtccctgccaggcttttgtatcgggataatattggcctcataaaatgaatttgggaggatttcctctttttctattgattgaaatactttcagaaggaatgataccagctcctcttagtacctctggtagtattctgctttgaatccgtctggtcctggattgtttttggttggtaggctattaattattgcctcaatttcagatcctgttattggtctattcagagattcgacttcttcctggcttagtgttgcgagggtgtatgtgtcgaggaatttatccatttcttctagattttctagtttatttgcatagagttgtttacagtattttctgatggtagtttgtatttctgcaggatcggtggtgatattctttttatcattttttattgcatgtatttgattcttctctcttttcttctttattagtcttgctagtggtctatcaattttgttgatcttttccaaaaaagcagctcctggattcattgatgttttgaagggttttttgtgtctctatctccttcagttctgctctgatcttagttatttcttgccttctgctagcttttgaatttgtttgctcttgcttctctagttatattaagtgtgatgttaaggtgtcgattttagatctttccttccttctcttgtgggcttttagtgctatacataccctctatacactgcttaaatgtgtcccagagattctggtatgttgtgtctttgttctcattggtttcaaagaacatctttatttctgccttcatttcgttatttacccagtagtcagtcaggagcaagttgttcagttccatgtggttgtgcggttttgagtgaatttcttaatcctgagttctaatttgattgcactgtggtctgagagacagtttgttgtaatttctgttcttttacaattgctgaggagtgctttagttccaattatgtggccaattttgaaacaagtgtgatgtggtgctgaaaagaatgtatattctgttgatttggggtggagagttctgtagatgtctattaggtctgcttgttgcagatctgagttcaggtcctggacatccttgttaaccttctgtctcattgatctgtctaattttgacagtggggtgttaaaatctcccattattattgtgtgggagtctaagtctctttgtatgtctctaaggacttgctgtatgaatctgggtgctcctgttttgggtgcatatatatttacagtagttagctcttcttgttgaattgatccctttaccattatgtaatggccttctttgtctcttttgatctttgttggtttaaagtctgttttattagagactaggattgcaacccctggttttttttgcttgtttgttttccatttgcttggtagatcttcctccatctctttattttgagcctatgtgtgtctttgcatatgagatgggtttcctgaatacagcacactgatgggtgttgactgtttatccaatttgccagtctgtgtcttttaattggggcatttagcccatttacatttaaggttaatactgttatctgtgaatttgattctgtcatgatgttcactggttgttttgtcagctaattgatgcagtttcttcatagcatcgatggtctttataatttggcctgtttttgcagtggctgatactggttgtttctttctatgtttagtgcttccttgaggagctcttttaaggcaggcctggtgtgacaaaatttctgagcatttgcttgtctgtaaagaattttaattctccttcatttatgaagcctagtttggctggatatgatattctccattgaaaattcttttctgtaagaatgttggatattggcccccactctcttctggcttgtaggctttctgctgagagatctgttgttagtctgatgggcttccctttgtgggtaacttgacctttctctctggctgcccttaacattttttccttcatttcaaccttgttgaatctgacagttatgtgtcttggggttgctcttctcaaagagtatctttatgatcttctctttatttcctgaaattgagtgttggcttgtcttgctaggttggggaaattctcctggataataacctgaagagtgttttccaacttggtgccattctccccatcactttcagatacaccaatcaaatgtagaattggtctcttcacatagtcccatatttcttaaaggctttgttcgtttcttttcactcttttttttctctaaacttctcctgtgactttatttcattattttgatcttccatcactgataccctttcttccacttgatcgaatcagcttttgaagcttgtgcatgcgtcacaaagttcttgtgccatggttttcagctccatcaggtcatttaaggtcttctatacactgtttattctagttagccattcatcttatcttttgtcaaggtttttagcttccttgcaatgggttcaaacatcctcctttagctcggagaagtttgttattactgaccttccgaagcctacttctgtcaacttgtcaaagtcattctccgtccagctttgttccgttgctggcgaggagctgtgatcctttggaggggaagtggcagtttgatttttagaattttcagcttttctgctctggtttctccccatctttgtggctttatctacctttggtatttaatgctggtgacctagagatggggttttggtgtagatgacctttttgttgatgttgatgctattcctttctgtttgttagttttccttctaacagtcaggtccctcaactgcaggtcttttggagtttgctggaattcctctccaggtcctgtttgcctgggtatcaccattggaggctgcagaacagcaaatattgcagaacagcaaatattgctgcctgatccttcctctggaagcttcatcccagagtggcagctgtctatatgaggtgttggcccctactgggaggtgtgttccacttaggctacaagggggtcagggacccacttgaggaggcagtgtgtccgttctcagagctcaaatgctgtgctgggagaatcactgctctcttcagagctatcagacaggggcgtttaagtctgcagaagttgtctgctgccttttgttcagctataccctgcccagagagttggattctagaggcagtagagcttgttgagctgcagtgggctctgcccaattctagcttcctggttgctttgtttacctactcaagcttcagcaatggtggacgcccttcccctagccaggctgccgcttggcagatcaacctcagactgctgtgctagcagtgagcaaggctcagtgggtgtgggacccactgagccaggcacgagagagaatcgccttgtctgccggtttttaagaccttgggaaaagtgcagtatttggtcggggagtgtcctgtttttccatgtagtctgtcaccgcttcccttggctaggaaagggaaatttcccctccccttgcacttcctgggtgagacaatgcatcaccctgcttcagctcaccctccgtgggctgcacccactgtccaaccagtcccagtgagattaagcaggtacctcagttggaaatgcagaaatcacccatcttctgtgtcaatcacactgggagctgcagactggagttgttcctattcggccatcttcagttgtgtgattttctagagtagcgctaagctgcttggcctagcaagcctgggctgggatttttaggtctctcttttgttcttactctagctaaaggttttcaatttcgtttattttttcaaaacatcatttttattttgttgatatttgtttagtctcaattttatatctttatactctaatgtttattatttctttccttctactaattttgggtttgaatttttcttgctttccatttcttgaggtgcagtgttaggctgttcatttgaagtctttctaatttttatgatgtaggctttttattgctataaacaactttcttcttagaactgcttttgctgtatttcataggttttagtatgttgtgtttccattttaatttgtctcaagaaaattttcaattttcttttaaacttcttcattaaaccattcattgtttaggaatatgttgcttaataattatgattttgtacagtttctgatattccttctgtggtttacttctaattttatcccattatggtcagaaaagttatttaatagttttgacttctaaaaatttattaagatttgtttcgtgacctaacatatggtctgtcctagagaatgttgcatgtgctgttgagaaaaatgtgtattctgcggctattggatgcaatgttctataaatgtctgtttggtccatttggtcaagagttcagtttagctctgatgtttcttagttgattttctgttcagatgatctgtctaatgctgaacatggagtgctgtggttttctactgttattgtgtcacagtcagtctctctctttaggtctgttaatatttgtcttttatatttgggtgctctggtgttgactgcatatatctttataactgtaatatcctgttattgtattgaccccttcatcatcatataatgaccttctgtatctttttttatcattcttgactaaattttattttgtctgatataagtatagctactgctgctgtatgttggcttccatttgcatgtaatatcttattcatcccttcactttcagtttgtgcatgtctatactggtaaatagagtttcttgtagacagtatatagttggatgttttaaaaatccattcagccaccctgcattttaatttttaaaataaatttcaaaagctttgggggtacagattgtttctggttacatagataagttttttagtggtgatttctgatattttagtgcacctgttacctgagcattgtatactatacccaatatatagtcttttatccctcccccgttctgagtatccaaagtccattatatcactcttatgcctttgcatcctcatagcttagctctcacttaaaacatatgatatttgattctttattcctgagttacttcacttagaataatggcctcccgctccatctaagttcctgcaagaggcattatgtcattcctttttatggctgagtagcatttgtatatatgccattttttctttatctacttgttggttgatagacacttaggttagttccatatctttgcaattgtgaattgtgccaccataaacgtgtgtgcatgcatctttttcatataatgacttattttcctttgggtagatactcagtagtgggattgctagatcaaatggtaattttacttgtggttctttaaggaacgtctatactgttttccatagtgtttgtactaatttacattcctatcagcagtgtaaaagtgttccctttttaccacatccatgccaacatctatttttttttttaacttttaatttatagccatgcttgcaggagtaaggtgtaatctcatcatggttttaatttgcatttccctgataattagtgatgttgagtgttttttcatatgtttgttggttggttgtgtatcttttttgagaattatctattcatgtcctttgctcatttttcgatgggattatttgtgtttttttttttttttcttgttaatttgtttgagttccttgtagattctggatactagtcctttgttggctggatagtttgtgaagattttctttcactctgtgggttgtctgtttgctgattatttcttttgctctacagagctttttagtttaattaggtcccatttatttttggttttgttgtatttgcttttggagtcttaggcatgaattcttgcctaagtcaatgtcttgaggagtttttccaaagttatcttgtagaatttttatcgtttcaggtcttatatttaagtcttttatctatattgacttgatttttgtgtaaagtgagagatggagatccagttttatttttctacatgtggcttgcactcttttaattgaagacttttgtccacttaccttcaagattattttctgtttacattttattacttgttttctggttgttttgtagatactttctttctgttttcctctgttactgttttcctttgtggttaagtgaatttctctggtagtatgttttgattttgtgctacttatttttagtctattacaggtttttgcattgtggttactatgaggcttccaaaaaatcaggtcatttaaaactgattatgacttaacttttattgcatagagaagaaaagtattataagaaaaccaaaccctaccctttaacacccccccaataatttgatttattggtgtttcagtttacgtctttttatattatctgtttcttaaccagttattgtagtaattattgattttaataggtttttgtcttttagccttcatactcaagatgtaaatggcttacttattcaaattacagttttagaatattctgaattagtctttttttcttttatcagtgaattttacaccttcaaatgttttcttattatacactagtgcccatttattttagattgaatagcttttagtatttcttgtaagacaggtcacattttgatgaattctctcagcttctgtttgtttgggaatctttgaatgtgtttaaatgatacttttgctgggtacagtatttttggatggcaatttttcccatctctttttcaatataacatcccattatcatctggacagcaggatttctgctgagaaatctgctgcaatctgtattcaggatgctgttcaatatgatgtttcttttcttttgttgctttgagtatcctgtcttttcatttcactgattatgatatgccttagagatttctcctttgggttgaatttgatgggtggcccctgaacttcctatacctggacgatgtcttctttctctagattttggaatttttaaaccattattattattttttttacatgtgctttccaggtctttttcttcgtgtctcctgaacactggcctgctgtttttttccattctaggggaacttatattgagcacaggaactaaaacaattcactggaactaacttattgctcttccattgttgtctggtctggggaagacttacagtgaacaacagaacttaaatgctgctctggaattaaaaccctgccctgttgtttcctgaactggggaacacttacagtgagcaccaaatgttagacattgccccagaactgtattgtagccctgccattgtttcccagtctggggaagacttaagcagaaactaggacttaattctgacattttagttatttctctgtaggggggaggttccagattgagcatctgggcattgggaaaaatctggttagaaatttgggccttcctgcagattgcgttctctgcagccttatggtaccagtcagttgcttttacaattttatttatttaagaaaatttttttgtaaatttttcaagtgcaattttgttacatggatatattgagtagtggagaaattgaggattttgtacccgtcacccaagtagtgtacattgtactcagtaggtactattttatccttcacccgcaccccccccaactccttaactccatcccaccttttggagcctccaatgtctattattcaactctgtgtgtctatgtgtacccactgtttagcttctgctaaacatgtggttagtgagaacatgtggtttttgactttctatttctttctatttctgagtcatttcacatcttaggatagtggcctccagttccatccatattgctgcaaaatacacgactttattctttttatggctgagtagtattccatggcacatgcatacatacacacacacacacacacacacacatatacattcatctatatacacacatatataagcaccatggaataatacatatatgtacacacacatatatgtgtgtatatatatatcacattttatatatgtgtatatatgtgtatgtatatatatatatacacacatatatatatatgtctgtgccatggaatactggtataatatactattataatatccatgcgcacacatgcatgcacacacacacagaagtgtatatgactgttttttaaccaacccttcatatcattcattgatgagcacttagattgattccatgactttgctattgtggccagtgctgtgacctactgtgacaaacggggaatgtgatgtctctagctttattctttttgcttagaatttctttggctattgggacatttttttggtttatatgaattttacaattattcttattctatggggaatgatgttggcattggtaatttgataggaattgcattgaatatgtacattgatttgggcagtatggtcattttaatgatattgattcttccaatctataagcatggatgtttttccattatttgtgtcatctatgatttctttcattgttgttttgtagttctccttgtagagatctttcacctccttggttaaatgtatttctagatatacatttttctagccattgcaaatccgattgaattcttgatttgcttctcagcttcatcattattggtgtatataaatggttttgatttttatacaatgatttttatattctgaaactttactgaattcatctatcaaatctaggagtcttttggaggagcatttagggttttgtagatataagaatatgtcatcagtgaacagagataatttgactttctcttttccagtttgcatgcctcttatttctttctctcttttgttactctagctgggacttccagtactatgttgaataggagtgctggaagctggcattcttgtcttttccagttgttagggggaatgctttcaactctacctcattgagtatgatgttggctgtggatttgttgtatacagcttttataattttgagatatgctccttgtatgcctagtttgttgagaattgttatcatgaaggggtcctggatattatctaatgctttttcttcatctattgagattatcaggtagtttttatgtttttaattcagtttatgtggtgaatcaaatttattgatttgcatatgttgaatcgtccttgcaattctggaataaaactcactctattgtggtgtattatcttcttgatgtgctgttgaatttggtttgctactattttgttgaggagtttttgcaactctgttcatcagagatattgatctatagttttcctttttgttgtgtgtccctgcctggctttggtatcaaaatgatactggtttcctagaatgagttatgtaggattcccttctcgatattttggcataactttagtagaaccaccataagttcttttttgtaaatgtggtataattcagctgtgaatttgtctggtcctaggcttttattttcgtaggagattcttaaattactgattgactttactgctcattattggtattttcttgatttctatttcatcctagttcaatctcgggcagttatatgttttcaagagtttattcacttcctcttggtttttagtttgagagtgtagaggtgctcataatggtctctggtgatttttttttgcatttctataatgtcagttgtaatgtcagaaattgccatttctaattatgcttatttgaatcttctcttttttattcttggttaatctagctagcagtctatcattttctaaaatattttcagaatactaacttttcatttctttgattctttatatttttttattatactttagttttagggtacatgtgcacaatgtgcaggttagttacatatgtatacttgtgccattctggtgtgctgcacccattaacttgtcatttagcattaggtaaatctcctaatgctatccctcccccatccccccaccccacaacagtccccagagtgtgatgttccccttcctgtgtccatgtgttctcattgttcaattcccacctatgagtgagaacatgcggtgtttggttttttgttcttgcgatagtttactgagaatgatgatttccaatttcatccattccctacaaaggacatgaactcatcctttttatggctgcatagtattccatggtgtatatatgccacattttcttaatccagtcaatcattgttggacatttgggttggttccaagtctttgctattatgaatagtgccgcaataaacatacgtgtgcatgtgtctttatagcagcatgatttatagtcctttgggtatataccgagtaatgggatggctgggtcaaatggtatttctagttctagatccctgaggaatcaccacactaacttccacaatggttgaactagtttacagtcccaccaacagtgtaaaagtgttcctatttctccacatcctctctagcacctgttgtttcctgactttttaatgattgccattctaactggtgtgagatggtatctcattgtggttttgatttgcatttctctgatggccagtgatgatgagcactttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaatattctcccatgctctaggttgcctgttcactctgatggtattttcttttgctgtgcagaagctctttagtttaattagatcccatttgtcaactttggcttttgctgccattgcttttggtgttttagagatgaagtccttgcacatgcctatgtcctgaatgttaatgcgtaggttttcttctagggtttttatggttttaggtctgacgtttaagtctttaatccatcttgaattaatttttgtataaggtgtaaggaagagatccagtttcagctttctacatatggctagccagttttcccagcaccatttattaaatagggaatcctttccccatttcttgtttttgtcaggtttgtcaaagatcagatagttgtagatatgcggtgttatttctgagggctctgttctgttccattgatctatatctctgttttggtaccagtaccatgctgttttggttactttagccttgtagtatagtttgaagtcgggtagcgtgatgcctccagctttgttcttttggcttaggattgacttggcgatgcgggctcttttttggttccgtatgaactttaaagtagttttttccaattctgtgaagaaagtcattggtagtttgatggggatggcattgaatctataaattaccttgggcagtgtggccattttcacgatattgcttcttcctactcatgagcatggaatattcttccatttggttgtatcctcttttatttccttgagcagtggtttgtagttctccttgaagaggtccttcacgtcccttgtaagttggattcctaggtgttttattctctttgtagcaattgtgaatgggagttcactcatgatttggctctttgtttgtctgttattggtgtataagaatgcttgtgatttttgcacattgattttgtatcctgagactttgctgaagttgcttatcagcttaaggagattttgggctgagacaatggggttttctagataacaattcatgtcatctgcaaacagagacaatttgacttcctcttttcctaattgaataccctttatttccttctcctgcctgattgccctggccagaacttccaacgctatgttgaataggagtggtgagagagggcatccctgtcttgtgccagttttcaaagggaatgcttccagtttttgcccattcagtacgatattggctgtaggtttgtcatagatagctcttattattttgagatacgtcccatcaatacctaatttattgagagtttttagcatgaagagttgttgaattttgtcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattctgtttgccagtattttattgaggatttttgcatcaatgttcatcaaggatattggtctaaaattctcttttttttgttgtgtctctgtcaggctttggtatcaggatgatgctggcctcataaaatgagttagggaggttttcctctttttctattgattggaatagtttcagaaggaatggtaccagctcctcttgtacctcgggtagaattcggctgtgaatccatctggtcctggactctttttggttggtaagctattgattattgccacagtttcagagcctgttattagtctattcagagattcaacttcttcctggtttagtcttgggagggtgtatgtgtccaggaatttatccatttttcctagattttctagtttatttgtgtagaggtgtttgtagtattctctgatagtagtttgtatttctgtgggattggtggtgatatcccctctatcatttttcattgtgtctatttgattcttctctcttttcttctttagtagtcttgctagcagtgtatcaattttgttgatcatttcaaaaaatcagctcctgggttcattaattttttgaagggttttttatgtctctatctccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaattttcctctacacactgctttgaatgtgtcccagtgtttctggtatgttgtgtctttgttctcactggtttcaaagaacatctttattcctgccttcatttcgttatgtacccagtagtcattcaggagcaggttgttcagtttccatgtagttgagcggttttgagtgagtttcttaaccctgagttttagtttgattgcactgtggtctgagagacagtttgttataatttctgttcttttacatttgctgaggagagctttacttccaactatgtggtcaattttggaataggtgtggtgtggtgctgaaaaatatgtatattctgttgatttggggtggagagttctgtagatgtctattaggtccacttggtgcagagctgagttcaattcctggttatccttgttacctttctgtctcattgatctgtctaatgttgacagtggggtgttaaagtctcccattaatattgtgtgggagtctaagtctctttgtaggtcagtaaggacttgcttcatgaatctgggtgctcctgtattgggtgcatatatatttaggatagttagctcttcttgttgaattgatccctttaccattatgtaatggccttctttgtcccttttgatctttgttggtttaaagtctgttttgtcagagagtaggattgcaacccctgcctttttttgttttccatttgcttgtagatcttccttcatccctttattttgagcctatatctgtctctgcacgtgagatgggtttcctgaatacagcacactgatgggtcttgactgtttatccaatttggcagtctgtgtcttttaattgtagcatttagtccttttacattgaaagttaatattgttatgtgtgaatttgatcctgtcattatgatgttagctggttattttgctccttagttgaggcagtttcttcctagcttcgatggtctttacaatttggcatgattttgcagtggctggtaccagttgtttctttccatgtttagtgcttccttcaggagctcttttagggcaggcctggtggtgacaaaatctctcagcatttgcttgtctgtgaagtattttatttctccttcatttatgaagcttagtttggctggatatgaaattctgggttgaaaattcttttctttaagaatgttgaatattggcccccactctcttctggcttgcagattttctgccaagagatctgctgttagtctgatgggcttccctttgtgggtaacccgacctttgtctctggctgcccttaacattttttccttcatttcaactttggtgaatatgacaattatgtgtcttggagttgctcttctcaaggaggatctttgtggcattctctgtatttcctgaatgtgaatgttggcctgccttgctagattggggaaattctcctggataatatcctgcagagtgttttccaacttggttccattctccctgtcactttcagatacaccaatcagatgtagattccgtcttttcacctagtcccatatttcttggaggctttgttcgtttctttttattcttttttctctaaacttcccttctcactacatttcattcatttcatcttcctttgctgataccctttcttccagttgttcgcatcagctcttgaggcttctgcattcttcacgtagttctcaagccttggctttcagctccatcagctcctttaagcacttctctgtattggttattctagttatacatttgtctaaatttttttcaaggtttttaacttctttgcctttggtttgaatttcctcctgtagctcggagtagtttgatcgtctgaagccttcttctctcaactcgtcaaagtcattctccatccaggtttgttctgttgctggtgaggaactgcattcctttggaggatgagaggcactctgctttttagagtttccagtttttctgctctgatttttccccatctttgtggttttatctacttttggtctttgatgatggtgatgtacagatgggttttggtgtgtatatcctttctgtttgttagttttccttctaacagatgggaccctcagctgcaggtctgttggagtttgctagaggtccactccagaccctgtttgcctcggtatcagcagcggtggctgcagaacagcagattttcgtgaaccgcgaatgctgctgtctgatcgttcctctggaagttttgtctcagaggagtacccagccgtgtgaggtgtcagtctgcccttactggggggtgcctcccagttatgctgcttgggggtcaggggtcagggacccacttgaggaggcagtctgcccgttctcagatctccagctgcatgctcggagaaccactgctctcttcaaagctgtcagacagggacatttaagtctgcagaggttactgctgtctttttgtttgtctgtgccttgccaccagaggtggagcctacagaggcaggcaggcctccttgagctgtggtgggcttcccccagttggagcttcccggctgctttgtttacctaagcaagcctgggcaatggcaggtgcccctcccccagcctcactgccgccttgcagtttgatctcagactgctgtgctagcaatcagcaatactccgtgggcataggaccctccgagccaggtgtgggatataatcttctggtgcaccgttttttaagcctgtcggaaaagcgcagtattagggtgggcgtgacccaattttccaggtgccgtctgtcacccctttctttgactaggaaagggaactccctgaccccttgtgcttcccgagtgaagcaatgcctcaccctgctttggctcacgcacagtgcactgcacccactgtcctgcacccactgtctggcactccctagtgagatgaacccggtacctccgatggaaatgcagaaatcacccatcttctgcgtcgctcacactgggagctgtagactggagctgttcatatttggccatcttgactgccagctccgatcctttgtatttttgtttggtctcagtttcatttagttctgctctgatctttgttgtttcttttgttctgctacctttggctttgttcttgttcttgaggtgtgactgtagattgtcagttggagatcttattatctttttaaggtaggcatttaacactataagcttccctcttagcatttcttttgctgtatcctgtatgttttagtatgttgtgtttctgttttcatttgtttcaaaaaaatttaaattcctagcctaatttcattattgatgcaacaatctttcaggagcaggttgttcaatttccacatatttgtatctttttgatagtttctgttggtgttgatttccagttttaattccactgtagtctgaaaaaaatacttgatttcaatttaaaagttttattgacacttgttttgtggcctgacatatggtatattttgggggatgtttcatgtgcagaacaggagaatatatattgtgtggttgttggctagaatgttttgtaaatttctatctgttctatttagtctagagaccaatttaagtaaagactttctttgttgatttttctgcctcaatgatctgtttaatgctgtcagtggggtgttgaaatcccccactattattgttttgctatttatctcttagttctggtagtgtttgttttatgaatatgggtgctctatgtatatagaattgttatattttcttgttgaatttatcactttatcaccatataatgtcctgctttttttttttttaactgttgttgatttaaaatctattttatctggtgtaagtatagctattcctgctcatttttggtttccatttgcataaaatatctgtttctactttttgactttgagtctttaaatatctttatgagttaggtgggtttcttataagaagctatcattggatcttcttttttaaaattcattctgccaatctatatctttcaagttaggcatttagttcatttacattcaaggttaatattcatatgtgaggtttttgtccctgtcataatgttaattgttacttagatggtttgcaatcttggttgtgtaattgttttataagttctataagttttttatattcctgtgtttttatgatggcattgcccattcatttccacgttttgaactccattgaaaatttcttgtatagctggtctagtagtgatgaattcccttagccgtttcttgtctaggaaatattttattttattttcattaatgaagcttaatttagcaggatacaaaatcctttgctagattttttttttcttcaaagagactgaaaataggaacccagcatcttcttgtttgtaaggtttctgctgagaagtccactgtcagtctgatggtatttccttcatagctgattagccccttctttctttccacttttaggactttctctttcatgttaactttggatcttctgatgagtatatgccatggtgaagtttgtcttgcaatgtatcttccaggagttttctgactttcttgtatgtgaatgtcaaatctctagcaaaaccagggaagttttcctaaattattccctcaatttttttaatactttttacatcttcttctgaaacaatgataactcatagcttagtaagtttaaataatcccatgtttctcaaaggctctgctcatttttattctttaattttttttgtctaactgggttaattaaaaagctctgttttctagctctgaagttgtttttgtttgttctagcctattattagggctttgatctctatattgtggttcctttaatgaatttttagttctagaagttcttttttaaaaaataattatccttagtaagttttcgattcatattctgaattgttttttctgattactttgtattggttttcaactgtctcttggatcttattgagctttcataccatccatattttgaattctttatctttgaattttcattttgaataagatccattgctagaaagctgatgtgatcctttgcaggtggtacaacactttgttttttcatattgccagtgttcttatgctggttccctctcatctgaagaagccatcacttcttatctttgagtttagttttgttttgatgggacattgtttttcctccttgaaggtatgattgtcctgtatgttgtgtatgattgtttggcttcaattctaggtgctttcaggtatcaaggtactgtatgagttccttggttatagatagcctttgtgcagtggctttcttaaatgccagttttagtagtgatgtcctgggtatttgagcaggctaattgccttctgcaataacaggattgtatttgtctcaggaagcttatctcattcctcaacactgtggacttccattatcaggttttgtattgtgttgtgcagttcaacccccaagctagtaagtaggtagcatctatgtgtaagagtggctgtggcagaagcagatgggtatgggcttgatctttgtttactgggaggtgctctctgttgtttcaggtgatgggccggtctgtagaatgcccagtttccaggaattccctgctgagcttccataggtggggggacaaagctgggtggaactggacatccaagctcacccatgaataccctattgacaagagaagacatcagcactgacatgagtggcagggagagctcctggtgaaatgtactgagctctctgaaggaggggagttggctgcaccagcttcacatcctaggcaggtgggaatgcaatccatttccctgttatacccctgtcccagggctcatgactctcagtttagtcagacatggttgtctacctccaggccacagtgtaactgagggctgcagaaaattcctgtcctatggctctctgtcgaagtggctttggagtagaacctcttatctcagctttgtggtgttcctggcctccaatgcaggaacactgctgctttgtatatagagggggagtggctccactttttggcatgtgcaagtgcatgccagctgtgatgttgtcagctggttgggttggcctgacttagaccctggactgatcaggtgccagttgtggtggactgggctaggcagtcccccaatttccaggcccctagatggccccttggatggtatgcatgagtcctggttggactggactgctggatttgtcctcaggtccctagggttcaggtgctgcctgtgatagggaggagtgggctggtccccagtcctgcagcagaatgctcaggcagggtggctgtgctgtggacctgccaccaagggaggctggacctttctctgccttgagcagtggaggcaggcagctgtgatacacatgttttgctcacacttccatctgacagcagtggtagtggtatctgtccttgaggcatatgaaagtgcctgacctgcctgcttctttctggcctgagggtggcagaggcagcagggatggcaggagtctaagggcagaacacaggcgtctggggtctggcctctcagagtggtgctggcttcagtggagatgctcagatgggggcagggtggcagcactgtgggtctgccatggcatatgtatatcggggcaggcgtctctcagtgggatcagcaaagtcaagcagttatggggtgctcagtttgctcacttctctgtcccacagcagtggtggtggtatctgtttttggggccttgtgaaggtgtttgagtgccctgctttctctctggccttgtggctggggcagtgatactgatggcagacccagggtaacacacaggcctctgggggttgggctctcagactgggactaggctacagctgctcagggctcaaaagcctgtgggacttcacatgagttcgaaaatgcctttgtgtaatttctaggcagttcccttttatcctggaggcctgggaggactgagggactcttctacagatagaattgaaaaaatctattataggagtgtggagccctaggggtctctcactcaccttttccccacatcagggagcttctatcagtttcacacctatcccagcccagtaggctgcttggattcattcttatttgctttctgtgattcttgtcacttctctgttgaattccagtgttctctcttagacaatccattcaaagtgtgtatatttacttgatattttgatttttcttaatggaagaggcacctactagctgcatctggccagccattttgaaccctccttccagtcagtctcttaactgtggcatccctggtgatcagagtgcagagtagctgctgagtttcacacgtcagttgctgtgatcagcatcctgctctttgttcctagttcaccccggatgattcagccactccactctcagtggttcccatgggatgggactggagtaggcttcctgttaagactcttctcttagactcatgaagaggttaaagattcacctccagttctcctctttcagctcagaaatcacaggtctagagtctctgtgagtgacattatgccagcttgggggataggctgatggagcctaaaatgactttttcttttaccagtaatggcttctcttgattttatggacgcagatattttctccacttctcctccaaacccagagttctggtgaactcaggatagtattctcatttttgaatagtttcttgaatttttgtgttgggaagtgatgccagggcatctactattctgctatcttgctgataccctgagatctcctgcatgctgactttgtgtcctactattttgctcaattcatttattagttctaacgggattttttttttggtggggggaatctttagggttttacatatgtaagatcatattatctgcaaacagagattacttacttcgttctttccaacttggatgcctttcatttctttctttccttttttttttttttttttttttgcctaattgctctggctagaacttctagtaagtaccatgttgaatagaagtggtgaaagtaggcatccttttcttattgttgattttaaaagaagagttttcagtctttcaccactgagtatgatgtatgatgtatgctgtgggttattcacatatagcctttatcgtgttgagttagtttccttttcttccttatttgttgagagtttttattataaaatggtgttgaattttgtcaaatgctttttctacatcaattgagatgttgtgtgttttttcccattcagtctcttattagatattacattgatcaatattcatatgttgaacaattcttgcatctcaggaataaatcccacttggtcatggtgtataattcttttaatatgctgctgtatttggtttgctagtatttttctgataatttcatgccagtgttcataagggatattgttttgtagctttttttttctagtagtgtatttgtgtgactttgttgttagggtactgttggccttacagaatgagttaggaagtactccctcattttcagtattttggaaaagtttgagaaggattggttttaatccttctttaaatgtttgttataattcctctgcgaagccatgggggcttttctttgtcaggagatgtcttttgtatatagttatgggttacaatatgatattttgatgtatgtatacatggcaaaatgattacatcaagctacttaacatatccagcacctgaaatatgtatcttttttgtagtgagagcatttaaaatgtgctgtcttagcaattttcaagtatacagtatactattatcaactatagtcaccatgctgtgtaatagatctctaaaactaattctcctaaatgaaactttgcattttttcaccaacatcagagatgagatttttttgacaactgagtcaatttctttattgttgtaggtctattcagattttctgtttctctgtggttagtgttggtagattttgtgtttctaggaatttgtccatttcttctagattcttcagttggttgatgtgtaattgttataggattgccttatcatcctttttatttctgtataatgagtagtaatattccatttttcatttctgactttagtaatttgagtcttctcttttttttcttcgttcatctagctaaaggtttgtgaattttgttcatctttccaaagaaccaacttttggtttcactgattttttctattgtttctctatttttaatttgtctctgctctaatctttattataccctttgttctgatggctgtgtgtttattttgttgttctttttctagttccttatgttataaagttatttgtttgagacttttttaaaaagtaaactaaaaattttggccttagcactgtttttgctgcatcccacgagttttggtatgttttcattttcatttgtatttaagtattttctatttcccttcatatttcttctttgatcaattggttgtttaacagtgtattgtttaatttcttcaaatttgtgactattgcagttttacatctgttgatttctaacttcatcccattgtggctggagaagatcctttgtatgttctgtatttttgaaatctagtgagacttaattattggcctaacgtatgatctgtcctgaaaaatgtgcacttgattagaatgtatatgctatggtttggtcgagtgttctgtatatgtctgttagattagttgatttattgtgttaaattctctctttatattctatctggttgttttatttaatattgtgagtttgacattgaagtatgcaactactatcatagaactgtctacttccttcaattttgtcagtttttgcttatattttgatggtctgtcattagataagtaaatattgttgtattgaaacattttgttaatatgtaattactttctttgtctcttgtaacctttttacatttaaagtacattttgtctaatattagtatagacacacctgttctgataacatgttgaaaaaactaaaggaagatatggagaaagtcaagaaaatgatgtataagcaaaatggaaatattgataaagaaatagcaaacaaaaaaatagaaatttgagagctgaaaattacaatactttaaataaaaaaattaccagaacaattcaaagacagatttaagcagacagaagaatcagcaaacttgaagatagcgcaatgaaaattattgagtctaaagaacgagaaaaggtggaacataagtgaatggaacagaagggacctgtgggacaccatcaagtggaccaacatgtgtatagtgggaatcccagaaagaaaaaagaaagttatagagagaatatttgaagaaataatgaccaaagctttccgaatttgatgaaagaaatgaatataagcatccaagatgctcaacaaactccaggtaagatggattcatattgagacacattataatcagactttaaaaagtcaagcaaagaaagaatcctgaaagcacatttaattttctaagaagatgccaaacaattttccagagtagtcgtacaattttgttcccaccagcagtgtatgaatggtctagtatttccacattattaccagaatattgtattatcagtatttttaagttttagtcgttttgataatgctgtagtaagaactaattgtggtactaattttcatttcatgctggctaatgacattgaataaacatgttatttgccatctgtataatatcttccttgaaatatgtatttatattttttgcccattttatattttgattatttcttttttgtaaagttgtgtttcaagagtttttatatattctagagactagtcctttgttggatatatggttttcatttattttctttcatttcttaacttgtattttcaccctcttaacttgacagggttcttcacagaggacggcttatcagttttttaaaaaatagattgtgctcgtggtttcacctcttagaattctttgcttagctctgaatattgatgattttttcctttttttaaaaaataaaatttacatttctacattttatacttaaatattagttttattaatattttatttgtgttgtcttaatttgattttgttatctgggtaatactatcttcataaagtaaattaggaagtattccttttatttgctttctggaagtttttgtgacaaattcttgttaattctttgttaaatgtttggtagaattctctggtgaaaccaactgggtctggagataatttcatgagagatttgatattccaaatttaatttacttagtaaattataggactattttgtttgttgccttcatcttggtttagtttttgtagtttgtcatcagtcttacctgatggtttttcaggtatatttatttttttttcaagaactagcctgttgctgcagttgattttctcttttttttttcctgttattatttcttcctttctctgcttttagtttattttgctctttttttctagtttcttgaagtaggaacttagattattggtactctgatttggtgctctgtcttttgtaaggttttactaagtgttattaattattctctctgcactgctttagctgttttaatacaggtgtttttttcatttagttatatttatttttcaaaatttcctttcagacttcttctttgaatcatgagctccttagaagtgtactaattaatttgcaagtgtttggaaaccttcttcttgttttgttattgatttctagtttaattccattgtgttaagaaaaaacactctgcttcacctcaattgttttaaattttaaagtttttgagatttgttttattgcctagggtatggtttgtcttgggaatactctgtgaactctggagaaacatgtatgttgttcttttgttggatgaaatattctatatttgtcaaatagatactgttggttgattgtgttgttgagttctatatccttgctaattttctttaaaaaatttttttagagatgaaaggggtacaagtgcagttttgttacatgagcatattatgtagtggtttgcctaggcttttagtgtagccatcacaaatagtgtccattgtacccacaaggtcatttatcatccctctccctgttcccactcttccacttttctgagtcttcactgtgaattatttcactctctatgtttatgtgtacacattatttaattcctacttacaagtgagaacatgtgatatttgactttatttctgagatatttcacttaaaataatggactccagttccatccttgtttttgcaaaagacatgatttcattctttttttaaggccgaataatattccatggaatatatatacaccacactttatttctcttactatccatcgatagacacttaagttgattccatatctctgctattgtgacttgtgctgtgctaaatgtataagtgcagttatcttttgatacaatgatttctcttcctttcggtaggtacccagtagtgggattgctgagtcaactgttttatgttttccatagaagttgtgcaaatttacattccaacaagcaatgtataattgttcccttttctgtgcatcctcatcaatatctgttgttgattgacttttaaataatagccattctgactggtgtaagatggtatctcgctgtggtttaatttgtattattctgatgatttgtgatattgagtatcttttcatatgtttattcgcaatttatatgtcttcctttgcaaaatgtctgttcatgtaatttgcccactctttaatgggtttgctttttttgctgttgttgagttgtttgaattccttgtagattctgcatgtgacttaacctgtcggatgcatagtttgcaaatatttgtcccattctgtctggtagttctataatatgctgagagtggagtaaattggggactataactcgaattttatgtttctgcatttctctttcccgctctactagtttttgttttacgtattacgtattttgaggctgtgtggtttggtttgcactcatttaggattgttatgtcccactggtgaattgatccttttatcattacataatgttttcatttgtcacaagtaatttttctctctaaaatctactctacctaatatccatatacccacagccaatatcatactgaatgggcaaaaacttgaagcattctctttgaaaactggcacaagacagggatgccctctctcaccacttctgctcaacatagtgttggaagttctggccaggacaatcaggcaggagaaggaaataaagggtattcaattaggaaacgaggaagtcaaattgtccctgtttgcagacgacatgattgtatatccagaaaaccccattgtctcagcccaaaatctccttaagctgataggcaacttcagcaaagtctcaggatacaaaatcaatgggcaaaaatcacaggcattcttatacaccaataacagacaaacagagagccaaatcatgagtgaactcccattcacaattgcttcaaagagaataaaatcctaggaatccaacttacaagggacgtgaaggacctcttcaaggagaactacaaaccactgctcgatgaaataaaagagggtacaaacaaatggaagaacattccttgctcatggataggaagaatcaatatcgtgaaaatggccatactgcccaaggtaatttatagattcaatgccatccccatcaagctaccaatgactttcttcacagaattggaaaaaactacttcaaagttcatatggaaccaaaaaagagcccacatcgccaagtcaatcctaagccaaaacaacaaagctggaggcatcacgctacctgacttcaaactatactacaaggctacagtaaccaaaacagcatggtactggtaccaaaacagcatggtactggtaccaaaacagagatatagaccaatggaacagaacagagccctcagaaataatgccggatatttacaactatctgatctttgacaaacgtgacaaaaacaagaaatggggaaaagattccttatttaatagatgatgctgggaaaactggctagccatatgtagaaagctgaaactggatcccttccttacacgttatacaaaaattaattcaagatggattaaagacttaaatgttagacctaaaaccataaaaaccctagaagaaaacctaggcaataccattcaggtcataggcatgggcaaggacttcatgactaaaacaccaaaagcaatggcaacaaaagccaaaactgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaacaaacaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacagtggtggtgggactgtaaactagttcaaccattgtggaagtcagtgtggcgattcctcagggatctagaactagaaataccatttgacccagccatcccattactgggtatatacccaaaggattataaatcatgctactataaagacacatgcacatgtatgtttatggtggcactattcacaatagcaaagacttggaaccaacccaaatgtccaacaatgatagactggattaagaaaatgtggcacatatacaccatggaatactgtgcagccataaaaaatgatgagttcatgtcctttgtagggacgtggttgaagcaaactatcacaaggacaaaaaaccaaacaccgcatgttctcactcataggtgggaattgaacaatgagaacacatggacacagggtggcaaacatcacacaccggggcctgttgtggggtgggggcaggggggagggatagcattaggagatatatgtaatgttaaatgacgagttaatgggtgcagcataccaacatggcacatgtatacatatgtaactaacatgcacgttgtgcagatgtaccctaaaacttaaagtataataaaaaaaatccatatagtgattgctgctttttaaaaaaattaatatttatatggtatatttctttccatgtttttgctttaaattgacctatgtcattgtatttgaaatgatttattgtagagaacatttttttggatcactaaagaaaatctatgtcaatctgcttttttctttaaaaaaacttatttatttatttatttttagattgattcttaatatttctctgtatttatggagcataggcaatatttcattacatgaatacaatgtgtagtgatcaactcagaatgtttagcatatccattacctcaagtgtttattatttatatatgttgggaacattttaagtcctgtctcctagctattttgaaatataaaacaacattgtttttaattataatcaccctactctgctattgaacattagacctcattccttctatctagttgtatatttgtacccattaactaacctctcttgtccttcccccatgcagccttcctcacctctgttaaactaccattctacactctaccttcatgagatcaattttttttatctactacatatgagtgagaatatgtgatgtttatatttctgtgactggctgattttacttaacatgatggacgtgcagttctatccatgctgctgcaaatgacaggattttattctttttttaaataactgaatagatttcattttgtatatataccacatttttcttattatttatccattgatggaaacttagcttgattctatatctttgcatttatgaatagtgctgtaataaacatggaactgcagatattcctttgttacactaatttcctttcctttggataaatactcagtagtagaatgctggataatatggtagttctatttttagctttttgaggaaccttaatattgttttctgtaatgcctatactaatttacactgccgccacccgtgtataagagttccttttctccacatccttgccagtatctgctatttttgtctttttgataatagacattttaactggagtaagatgatatctcattgtggttttgatttgcatgtatctgatgtttagtgatgttaagcatttttcgtgtgccttttgaccatttgtatgtcttcttttgagaaatgtctgccctggtcttttgcccagtttttaatgggattatttatttgtttgtttgattttgctgttgaactatttgagttccttatatactctggatattagtcctttgttagatggatagtttgcaaatatgttctcttattgaacaggtagcctcttcactctgttaattgttttcttggctctgcagtaggttttcaatttaataccatcttatttgtctatttttgtttttgttgcgtatgcttttacagtctttcttaataaatcatttcttataccatgtactgcagtgtttcccctatgttttcttctagtattttcagttccaggtcttatgtttaaggctttaagcatttggagttgagttttgcgtattctgagatttaggggtctagtttcattgttctacataaggatatgtccagttttcccaaccctgtttattgaggagactgtcctttccccattgtatgttctttgcaccaaatgagttggttgtaaatatgtggatttatttgtgaattctgtgttctgttccattggtctacatgtctgtttttatatccatatcatgctgttttgtctatattgccttgtaatatattttgacatcaggtagtgtgatgcttccagctttgttctttttctttaggattgcttttgctactcaggctctttttggttccatataaattttaggatttttttctatttttgtgagaatatcattgatttttttaatagagattgcattgaatgtacagatggctttgggtagtatggtcatttagataataataattcttccaattcatgagcatgggatatgtttccatctgtttgtgtcctcttaaatttctttcatcagtgttttgtagttttccttggagaggtctttcaactcctttgttaaatgtattcctttttatttttgtgactgttgtaaacgggattgctgtctcaatttctttttcagctttttcataattgatgtatagaaatgctactgatttttgtgtgccaatttttttttgtcctgcaactttaatgaatttgtttattagttctaagaattttttggtgcagtctttaagtttttctgaatataagattatttctgcaaagggacagtttgacttcctcttttctaatttggatgccttttatttttttctcctgcctaattgctctggctagaattttcagtactatgttttatggatgtggtgaaaatggatatccttttctttttctgtgtcttagaaaaaaggctgtcagcatttccacattcagtatgatgttagctgtgggtttatcatatatgacctttttcatgttaaggtatgtttcttcaatgcctagtttgttgagcattttttattttgagagttgagatgttgaattttatctagtccttttctctgtttagatgatcatatgatttgtgtccttattttgttgatgtatttcatttactgctttgcaaatgttgaagtacccttgcctctctgagataaatcctacttgatcatgctatattatctttctgatgtgccgtttaattgggtttgctagtattctgttgatttttgcatcttttttcatcatgagtaatggtctgtagttttcttttttgttgcatggttttctggtttttttaatcagggtatttctggccttatacattgaattagggggaatttactcttcaattttttggaatagtttgaggacaattggtgttagttcttcatacatttggtagaacttggcagtgaagccattgggtcctgggcttttctttgttggaagactttttattactgattcaatcttgttatccattattggctgtccaggttttctattttttttccaggttcaattttgggaggttttatgtaaccaggagtttatccatttcctcaacctacttttaaaaattgatatattaagacatttaccattaaggtaattatattttagggattaagtctgcaaattaaaaaagtgttttctgcttgttttctctttttgttttcttttcctattttgaaacagaatttttctctgtcatccaggctggaatgcaatggcatgatcatggctcacagcaaccttgaccttctaggctcaagcgatcctttcacttcagcctccccagtagctgggatcgcaggagtgttccaccatgcctggctaatttttttattttttgtagatgtagggtttccctatgtcaaccaggctgatcttgaactcctgggctcaagtgatccttctgccttggcctcccaaatatctagaattacaggcataagccaccacacctggctgtttcctgtttttcttgttcttctgtttctcttttcttaccttcttgtgcattaattgaacatttttaatgatttaatgttgatttatttatgttgttttgagtatattgctttgtagaattttcttaatgatttctctcggtagtacaataaacatgtaaattatcacagtctacagttatcaacatttttttttactcttagtgaggcatggaaaccttacttccacttaagtctccttaccctagaataatataattttcttaagtattttttacatacattgagcgccatatcagataatgttataactgtggattcaacaatcaaatatgacttacgaaactaataagaattagaatagtttattatattgaaccacattttccacccgttcttatgttactatttcctctctgaagtttcaagacttcttttcttatcatttcctttctgctggggaaattcctttagccattttcaagggtaggttttacagaatcaaattatcttagtttttcttcatctgagaatgtctttatttcactctcattcctgaaggatatttttttctgggtgtagaatacacaattagcagttttctttcagaacctgaaaaatgtaacgtctccttctggcctctatagtttcagaagagagacatgctatcattcaaattcatttttatttgtaatacagtatttttttctggctgctttccatatttttgttttgttttgttttagtttttaaagcttaattatgatgtgccttggcatgcatatctctgggtttatcttatttggtgtttacgcagatttttgaatctataagtttacattttcaataaaattgggaaatttttagtgatagttatttttaatttaaaaatttaaattaatataatgtatatttaaggtatacaatgtcatatatattttttgaactgattactatagtcaagtcaattaacatatctttgtcttcatatactcacatagttaccattttgaggagtgttgagacttaaggtctgttcttttagcaaacttcaagtatacaacacagtattagtagctatagtcatcatgctctaaattaaacctctaaaactcattcatcctgtataactgaaactttgtacactttaactaatatctccccattttcccagcctccttggcactggtagccaccattttaccctgctcctatgaattcaacttttttagatttcacatatatgtgtaatcacacactgtttttctatctgtgtctggagtttttcacttatcttaatatcctccacattcatccatgttgttgcaaatgagagaaattcccacttttcttgctttccaacttttattctaggttcaggggggtacatgttcaggtttgttacatgggtaaattgcatgtcatggggatttggtctacagattatatcatcactcaggtaatgagcatagtagtcaatagtttttcaatccttatcctcctttcactgaccaccctgaagtaggcactggtgtttcatcatttttatccatgtgtactcaatgttcagctcccacttatgtaagtgagaacatgcagtattggttttctgttcctgtgttgacatgcttagtataatggcctctagctccatccatgttactgcaaaggaaatgattttttttatggctgcataattttccatggtgtatatgtatcacacttcctttatcccattcaccactgatagacatttaggttgattccatgtctttcctattgtgaatagtgcttcactgaacatatgcatgcatgtgtctttatggtagaatgatttatattgtcttgggtatatacccactagtgggattgtttagttgaatgatagttctgttttaagttctttgagaattctccaaactgatttccacaggagtggaactaatttacattgccatcagcagtgaataagcattcccttttctccataactgtgccaatatctgttattttttgacttttcaatagccattctgactggtatgatatattttattgtgattttaatgtgcatttctctaatgattgaacattttttcatacgcttgttggccatgtgtatgtcttcttttgagtagcatctgttcatgtcctttgcccaatttttagtggggttgtttgttttttgctttttaatttgtttttaagcttttgtagtctggatattagacctttgtcagatgcatagcttgcaaatattttctctcattctgtagattgtctgtttactctgttgatagtttcctgtgctgtgtagagaggcaatgaaaaaagaaaacttcaggtcaatattgtctttgaatgtggatgcagaaatataagcaaatgaaatagaagcaaactgaattcagcggcacatcaaaaagctgatccactaagatcaaatacactttatacctagaatgcaaggtttgttcaacatatgcaaatcaataattttgattcatcacataaacagagctaaagacaaaaaccacatgatcatctcaatagttgcagataaagctttctatacaattcaagatcccttcatgttaaaaaccctcaacaaacaaagcattgaaggaacatacttcaaaataattagtgccgtctatgaaaatcccacagccaacatcatactgaatgggcaatagctgtaattattccccttgaaaaccacaacaagacaaatgtgcccccttttaccactccaattcaacatagtactggaagtcctagccagagcaatcagggaagagaaagaagtaaagtcctccaaataggaagagaggaagttaaatgatccctgtttgcagacaatatgattttatacccaggaaaccctgtaatctgtgccccaaaggtccttgatctgataaacatctttggcaaagtttttttttaatattatactttaaattttggggtacatgtgcagaacgtgcaggtttgttacataggtatacacgtgccatggtggtttgctgcacccatcaacccatcatctacattaggtatttctcctaatgctatccctcccctagctgaccattccccaacaggccccagtgtgtgatattcccctgcctgtgtccatgtgttcttattgttcaactcctaattaggagtgagaacacgtggtgtttggttttctgtttttctgttagtttgctgcaaagttttaagatacaaaaattgatgttcaaaaatcaatagcattcctatacaccaaaaacatccaagctgagagttaaatcaagaatgcattcctcttcacaatagccacaaaatgaacaaaaatctaggaatgcagctaacctgggcagtggaagatctgtacaatcagaattacaaaatattgctgaatgaagtgagagctgacagaaatgaatggaaaaacactccaatctcatggataggaagaatcaatattgttaagatggtcaatgaatttcttgatttctgcttaatttcattgtttactcaaaaatcattgaggagtagattgtttaattttcatataattgtatgttttgtgagatcttcatattgatttctgtttttgttgtcctatggtctgagtgatggagtctcattctctcacccaggctggagtgcagtggcatgattttggctcactgcaacctcttcctcccgggttcaagtgattcttgtggctcagcctcccgagtagctgggactacaggcatatgctaccacgttcagctaatttttgtatttttagtagagatgtggtttcaccgtgttggccaggcttgtcttgaactcctgatctgaagtgatctgcctaccttggccttccaaagtgctgagattacaccttccttgttacttttgatgttgtggtttaaagtttgttttatctgaaataagaatagcaaccccaattcttttttcttttccatttgcatgatagatctttctccatccctttaatttgatcctatgtgtgtcattacacgtgacattggtctctcgaagacagcgtacagttgggtgttgcttctttatctaattgactatgctgtgcctttaaaatgagtcatttagcccatttatgttcaagattaatattgacatgtgccaatttgatcctgtcattgtgttgttagctggggtttttttttgtggactttattgtgtagttgctttatagcgtcaatggtctgtgtacttacatatgtttttgtgatgggtggtaagtctttcattttcaggattagcacttccttaaagagctcttgtaaggcaggtcttgatggtaacaaattttcttagcatttgcttgtctgaaaaatattgcatttctcctttatttgtctcctttatttgcttgtctgaaaaatatttcatttctcctttagtttggtgggatatgaaatttgtgattgacatttcttttctttaatgatgttgaatataggcccccagtcttttctagcttacagggtttctgctgaaagttctgctgttagcctgatggggctccctttttaggtgacctccccttctctctagctgtctttaatattttgtccttcacattgagcttggggaatctgatgactgtgtgttttgggggtggtcatcttgcatagtatcttccaggggttctctgaatttcctgaatttgaatgtgaacctctctagtgaggttggggaaattttcatgaagaaaatcctcaaatatgtattacaagttgcttgctctctccccctctctttcagtgacactaaggagtcatagatttggtctataaaaattccatatatcttatatattatgttcattcttttacattcttttttccttatttttttcttgactgaatagatttgaagagccagtctttgagttctgaggctctttcctgaacttagtatattctgctgttagtatttccaattgaattatgaaattcttgtggtgagtttttcatgtctatcagatcagttaggttctttcttaaatggctatttcatctttctgctcttgaattgttttactggatttcttagatttcttttgtattgaatttcaacttcctcctgaatcttgatgatcattgccattgccatccagatcctgaattctatgtctgtcatttcagccatttcagtttggttaagaactattgctgggaagctaatatggtcatttggaggtaagaaggcactccggattttacagttgccagaggtcttgcactgattctcatctgtgtgggctgatgttcctttaatctttgaagttgctgtcctttggatggggctttttctttttatattctttgctacctttgaatgttcgactgtggtataagttgggtttagttgactggcttcatttctggatgatttcaggaggccatggctcaactcagcactcttgggctgtgcactttaatcctggggttgctgggatcaagcctatggctttgttctctggcttctcaaagttaaccatttgatgtactcagccggggtggcggggggaagggggtaagtgtttctggtcctctggcaatgatactgcattggtggatgctggcaaaagccctttgtcaaggtgatggcaacatgatccatgcccacatgcatgtgctgggagtggcaggtggcagcagcatggcagggtctgtgcataggcatgtgtactggcatagccattggggaggctgcaggtggatgcatgctggcaaggcccatgtgaaaaaactctcttacagttaggctgggtcttccagtaaaagagctatagcagtagctacttggaagtgccctggttgagcatctgaggctacactgcaagtggatgtggccaggcagagatcctcgggaattcttgcagaaaggggatactcagatcagactggtcacatcccacaggcacgatagctctgttctgtgcaagtttgacagtcaaaaaatacctaagccacctggaacagtgtggtgagccttggaggatgggtatccctggctgtgctccactgcagccattcccacgtcaaaccctctgggctttgcaggatggagtcctgtctctgctaactcccaagcagctcccacttggagctcatggagtctcctgcatctaggtgtccttggttacatggcaagagtgggccactccatgcctatttaactcattctttctccaggagcttcgtggggccaggaatgagtcctagtgctctgcaaccctgtatagggttcccagcttcctctcccttcagcgcagattctgcattctctgtccattcactctcaaagccttccttctgaagatttcattggggtgtgctgatcttcatggtctggccactcagtgagagaagctcttcctagctgtgtctagtcagccatcttggctctttcctctttttcaaggccgaataatattctattgtatgcattcaccacatttttttatccattcatccattgacagacacttaggttgttctcatattatggctataatgaataatgctttaatgaaccttcaagtgcagatatatctatgacatactgattttatttcctttttcatatatacccagaagagagattactggatcatatagtatttttaattatttgaggatcctttttactgttttccaaaatggctgtaccaatttatgtttttcactaatagtgtacagttgtttctttttcttcacattctcatcaacacttatctttcttctctttgataataggcattctaatcgatgtgagataatatctcattgttgttttcattagtgcttccctgatgattagtaatgttgagcgcattttcatatatctattgtccatctgttgtgtgtcttctttggaaaatatctattcaggtcatttgcccattttaaaatttgagggttttttttgttattgagttatatgagtttcttttatatatgcatatcagatatatggtttgcaaataaatatgatctgctaatcttcagtggcctttaattttgttgatgattttatttgcagaaactcagtttgatatagtcccatttgtttattttgttgttgtttttgcctttgcttttggtatcatattcaaaacaatcattaccaagatcagtatcaaagtatttttactatattttcttttaagagattaacttgtcattttacattaggtatacctcctaatgcaatccctcccccagccccccaccccacaacaggccccagtgtgtgatgttccccttcctgtgtccatgtgttctcattgttcaattcccagctatgagtgagaacatgcggtgtttggttttttgtccttgcgatagtttgctgagaatgatggtttccagcttcatccatgtccctacaaagaacatgaactcatcattttttatggctgcatagtattccatggtgtatatgtgcaacattttcttgatccagtctattattgttggacatttggcttggttccaagtccttgctattgtgaatagtgcctcaataaacatacgtgtgcatgtgtctttatagcagcatgttttataatcctttgggtatatacccagtaatgggatggctgggtcaaatggtatttctagttctagatccccgaggaattgccacactgacttccacaatggttgaactagtttacagtcccaccaacagtgtaaaagtgttcctatttctccacatcctctccagcacctgttgtttcctgactttttaatgattgccattctaactggtgtgagacggtatctcattgtggttttgatttacatttctctgatggccagtgatgatgagcattttttcatgtgtcttttggctgcataaatgtcttcttttgagaagtgtctgttcatatgctttgctcactttttaatggggttgtttctttcttgtaattttgtttgagttcattgtagattctggatattagccctttgtcagatgagtagattgcaaaaattttctcccatgctctaggttgcctgttcactctgatggtagtttcttttgctgtgcagaagctctttagtttaattagatcccatttgtcaattttggcttttgttgccattgcttttggtgttttagacatgaagtccttgcccatgcctatgaactgaatggtattgcctaggttttcttctagggtttttatggtttcaggtctaacatgtgagtctttaatccatcttgaattaatttttgtataaggtgtaaggaagggatccagtttcagctttctacatatggctaggcagttttcccagcaccatttattaaatagggaatcctttccccatttcttgtttttgtcaggtttgtcaaagatcagatggttgaagatatatggcattatttctgagggctctgttctgttccattggtctactctgttttggtaccagtaccacgctgttttggttactgtagccttgcagtatagtttgaagtcaggtagcgtgatgcctccagctttgttcttttggcttaggattgacttggcaatgcaggctcttttttggttccatatgaactttaaagtagttttttccaattctgtgaagaaagtcattggtagcttgatggggatggcactgaatctataaattaccttgggcagtatggccattttcatgatattgattcttcctacccatgatcatggaatgttcttccatttgtttgtatcctcttttatttcatcgagcagtggtttgtagctctccttgaagaggtccttcacatcccttgtaagttggattcctaggtattttattctctttgaagcaattgtgaatgggagttcactcatgatttggctctctgtttgtctgttattggtgtataagaatgcctgtgatttttgcccattgattttgtatcctgagactttgctgaagttgcctatcagcttaaggagatttggggctgagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccatttggtatgatattggctgtgggtttgtcatagatagctcttcttattttgagatacgtcccatgaatacctaattttttgagagtttttagcatgaagcgttgttgaattttgtcaaaggccttttatgcatctattgagataatcatgtgggttttgtcattggttttatttatatgctggattacgtttattgatttgcatatgttgaaccagccttgcatcccagggatgaagcccacttgatcatggtggataagctttttgatgtgctcctgtattcggtttgccagtattttgttgaggatttttgcatcgatgttcatcagggatgttggtctaaaattctcttttttggttgtgtctctgccaggctttggtatcaggataatgctggcttcataaaatgagttagggaggattccctctatttctattgattggaatagtttcagaaggaatgttaccagctcctccttgtaactctggtagaatttggctgtgaatccatctggtcctggactttttttggttggtaggctattaattattgcctcaatttcagagcctgtttttggtctattcagatattcaacttcttccttatttagtcttgagagggtgtatgtgtccaggaatttatccatttcttctagattttctagtttatttgcatagtggtgtttatagtattctctgatggtagtttgtatttctgtgtgaacggtggtgatatcccctttatcatgttttattgcgtctatttgattcttctctcttttcttctttattagtcatgctagcggtctatcaattttgttgatcttttcacaaaaccagctcctggattcattgatgttttgaagggttttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcgtttagtgctataaatttccctctacacactgctttaaatgtgtcccagagattctggtatgttgtatctttgttctcattggtttcaaagaacatctttatttctgccttcttttcgtcatgtacccagtagtcattcaggagcaggttgttcagtttccatgtagttgagtggttttgagtgagtttcttaatcctgacttctagtttgattgcactgtggtctgagagacagtttgttatgatttctgttcttttacatttgctgaggagtgctttacttccaactatgtggtcacttttggaataggtatggtgtggtgctgaaaagaatgtgtattctgatgatttggggtggagagttctgttgatgtctgttaggtctgcttggtgcagagctgagttcaattcctgggtatccttgttaactttctgtctcgttgttctgtctaatgttgacagtggggtgttaaagtctcccattatttttgtgtgggagtctaagtctctttgtgggtctctaaggacttgctttgtgaatctgggtgcccctgtattgggtgcatatatatttaggatagttagctcttcttgttgaattgatccctttaccattatgtaatggccttctttgtctcttttgatctttgttggtttaaagtctgttttatcagagactaggattgcaatccctgcctttttttgttttccatttgcttggtagatcttcctccatccctttattttgagcctatgtgtgtccctgcacgtgagatgggtttcctcaatacagcacactgatggatcttgactctatccactttgccagtccgtgtcttttaattggggcatttagcccatttacatttaaggttgatattgttatgtatgaatttgatcctgtcattatgatgttagctggttattttgcttgttagttgatacagtttcttcctagtatcaatggtctttacaatttggcatgtttttgcagtggctggtgccagtttttcctttctatgtttagtgcctccttcaggagctcttttagggcaggcctggtggtgacaaaatctctcagcatttgcttgtctgtgaaggattttatttcaccttcacttataggcttagtttggctgtatatgaaattctgggttgaaaattattttctttaagaatgttgaatattggcccccactctcttctggcttgtagagtttctgctgagagatcacctgttagtctgatgggcttccctttgtgggtaacccgacctttgtctctggctacccttaacattttttccttcatttcaactttggtgaatctgacaattatgtgtcttggagttgctcttcttgaggagtatctttgtggcgttctctgtatttcctgaatttgaatattggcctgtcttgctagattggggaagttctccagctttttaaaagttattgaaattatacttttacatttttaaattctacttgtatgttaaactacattaattttgaatagatattgaagttactttacatttctgtgataagcccccttgattatgatacattatctatcttatatattgttctttttgatcactgaggattttgttgactgtttttcttgtttctaaagaatatttgtctgtagctttcttttatgataatagttttggctggtgtagttattaataaaattctggcctcaaatttaattgagaattatttgcatctattctatatttgggaagagtttgtgtgaaattagtgtttttttaattccttaaatgtttgctggaattcaacagtgaaaccatttgggtatgaatttttttcttggaaagttttaaactagaaattaaaattctttaatagatatagcagcattattctcctcaggaatgagatattcaactctgttaaatcattacttgacgcagcaggagataacaggatgagggtgggatattattcactagtacttctgatctgttgtttacataggcagaatgagcatcagtggttagagaaagcctttaactgcttgtagttgaagcttgcactgcttgtagttgaaggttaccctgcctgcatagaaattgtaatggtcaaaagaatgtggtcaggatactgacagcatcttctacagatacacatcttttactacacagttactcttatgctccatgttaagtttactatgtaaactaatacttacaggtgttattcatttatgacattaaaaaaaatttataatgggagagttagtggaaaaaactatactttcctgctgctatggttaattctaaggttgtaatagatatttatcattttttcttttaccgttttttatagattttccttactctcatccagcacttctgctattttaggtttctttcctactgggtttatgtaggccttttctgggtgtcagagtacttgttaagctgtgctttctccatttgcttataagtgattagtactgggcatcgacgcctcaataataagcttctcctggaccacttttagtagcaacaactctagcccctcataataatcagggtcagttcccagtataataactcattcctttgccagctggtctagtgtcatgagaggttctaaagtatccaagtggtagccttaggtttactgtaattcttatatccccttgtagaagcattccctcccctggaactaatgtctctagtgcaacagtgactaaatttatatagacaggaagtgcacatttccaaaatagacattgagaatgatggtatgaggaaaccatttctacttctactttttggttctcaaacctatatattacaactaatggggatacaacaccaaataatggacattgactggaagtattaatcctcatcttgaataataacacacttaaaactatatagtatcatgtttaagctggttccttacaatggtttaagaggctattccagcacactcttaggctgctagcttttagcttatgtgataatagtactactagtatattcaatggtaatgtgtcctttatttcatctccttcattgtcaactgggtcctttggtttgaggcaattttatatggaatttgttgaggctaaatcactttatgtttctgagatagtggtccagcacaaggaaaatccatatttagaatatgtagcaattgtaataaataaaatatctatcttttccaggatggaatagtttcttacggtttaatataatcaattttttttttttaccaagtgggtggttgatcttttgaggaatgatatcatattgatggtttagcttggattcttctgactggttggatatgcagtagagacagtgagtagatgaactttaaagagaaggatttcataacattggttccatgcgtagcctccattcctgccacctggtcactctgttcctcattatgaaggcagtggggtggctgaggacagacaatggctgacttatcttcaccaattggtcatcctacttaactgggtttttagtgtctcttcagtggtagatgtactatgttaggcattgacataagaaataagaatccacataccttgcatgcactcccctagattcattcacatgcttcttccccctcttggtctctaatcttccaatttattttctagactcctgaccaaccaatcatgccatttgcaactgcccaacagtctgcatttatccttcctcacattacttctctgtccataccaagtttatgactaagtgtactgcttggatccttgctcagtgggaggaattcccttcaccactgttttaacacaaccacatctgaatgtggtagcagttcatttattactgtaccaccttatggagaggacccatttatttaaaaagcgcattcttatttctcctctttgtggtagttataaggaaacacctacatgttcatagctatgagcagaggaagcaataatggtgcaattagagaaaggtgaaatggggatctgagtcacttatatatgaacttagttgggcctaattctgaatgtaccacttctatcatgtttttgctattgtgccaactcttcttatttggtggatcgtaatgtttttttctagatcatctatttagtgtctacaagggcctagtagcatgtcaggaatttctttttgaatgatgaatgttccctatgcagacatcatggccttgctcaagaactcgaaaggcatctgcttggactcctactgagttttaaaaatggggatattttcaacacatcaacagttgcacaccacatgctagaggctatgttgacatgttctagtaaagatacttcatctgatattacaagtgtgattgaaataccacttggttaaatttgtaggaatttacagttgtctgctatgattcatatcatttttggagaactcagacctattaattaattgggcatatggggggccatgatagtgttttaagtctccaagttcaacagtccttaagagattcgagtcttcccctttcagcagtacataattatttaggtaaatgactatatatatctttggggaaggagtgagggaatcactactacacatagttgttgtggcactgcagcatcttcttcaagaggaattggtctccccttcaattgataggctctggatctgagaactggctcatttatggaaactgggcaaggtattttaattttccctttggtgtctaatattagtcttctgctattccagaattctgttttttttctcactgatactagagaacctagtgttacagcattattccctaccatcaatcctggcaagcagaagaaactatcactgagcttctcactagcagataatagttgacccttgaacaacacgggggttaggggaactgatctgccacaccgtcaaaagcctgtgtacaacttttgactctacaaaaactttactaatagcctactgttgactgcaagccatactaataacataaacagtcaattaatacctatctcatacattaaatgtgttgtatactgtattcgtataataacggaagctagagaaaggaaaatattaagaaaatcataagaaagagaaaatatatttattcatttagtggaagtagattgtcataagggtcttcatccttgttatctttactttgagtaggttgagaaggagatggaagagaaggggtttgtcttgctgtctggggtggcagaggcaaataaaaaattcatgtttaagtggactaacatagtttgaacttgtgttgttcaagggccgattgtacttattgctttggtgaaagaaatattatttgggttcagtaggggaatataatcatttggttgtctttcttgtattatgttttaaatctagtatgtctacctcttggagtttcaggactgctttctttgtacttcgccgaggtagttacagcatctcaacctcattatcatagtcatttttaagccttgaaactatcccggtaacatttaggcttggctgcaggtgtacttcctaccatgttaaatcctcagttctagaaaagtgtctctgaatcagtaaaatccccgtccccttattcgttcttatatgctatactctccccagttcagtgcttctaacatccatttctcagtatggtctcctggttgttgccagtacctattagatgagtcctgcaaccctttatttttatagcaaggacaatattttcccaatttgagcattctgagattttcagataattgggagttagcctagtggacactcaaatggtataaggacaagtgatactagtgcgccactatcagttcttggtaccctctattcctctcaagcttcatcctcatttacctgcttaccattatagctaaatatacttagaaaatacttagaatgctgtaacaaagtctaagaaatctgccatccaaaatgaacagatgttactcctggtaatattcacttttaaaaaaaaaaagttattacagatacaattaagatcccaaatcctctttttcagcccctttcccatccaaagctggacacttataatgaatttgttatatctttttttttgttttgttgttaaactttttaagctgctttattgacacataacttggctaccacataatttaatcatttaaagtaaacaattcagtgattttggtatgttcacggggttgtgcaataattactacagtgaattttagaacatttccatcactccagaaagaaactctgtacctattagacagtcactttctattttctatttcccccaaatcctcctaatcctagctactatggatctattttctgtctatatagatttccttattgtggaaattttatataaatgaaatcatgccatatgtagtcttttgtgactgacttatttcatttaatataatgtttgcaaagtttatgcatgtatcaatacttgatttttttattggcaaataaaattctattttatggatataccacattttattatatattcattacagtagttgatggatacttggattgcctttctacttcttggttattataaatcatgcttctatgaacatttgtgcacaggcttttgtgtgcatatgttttcatttgtcttgggcatgtattcaggaagggaattgctgcatcatgtggtaactctatgttttacattatgaggagctgctattattgaattccaaaaaggttgcatggtttcacattcccaccagcaatgtgttagatcttaaatttctttatatcttccatatggatatctttaccaacacttgctattgtttatttttttgaatatagccatcttagtggctgtagagtggtatttcatggtggttttgataggcatgtccctggactaatgatgttgaccttcttttcatgcatttattgtcagtttgtatatttcctttagagaaatgtcgatttaaatattttgctcagttttatttgggtaattattattgttattattattcttagatttaggggatacatgtgcatgtgcaggtttgttacattggtatgttgtttgatactgaggtttgggcttctaatgatcccatcacccaagtaggaaacaaagtacctgataggtagtttttcaacccttatccaccttccatcttccctccacccttttgatatctccagtatttatggttcctatctttgtgtccatttatactcagtgtttagttcctacttacaagtgagaagatgcagtatttgattttctgtttctttattaatttgcttatgataatggcctccagctgcatccatgttgctgcaatggacacgattttattctttttttttatggcttcatagtattgcatggtgtatatgtaccacattttctttatccaatctatcattgatgggcacctgggttgattccatgttcttgctattatgaatagtgctgtaataaacatatgaggccaaatgactttttggtggaatgatttattttcctttggatatatacccattaatgggattgctaggttaaatggtaattctgtttttactttgagaaatctccaaactactttccacagaggctgaactaatttgcattctcaccaatggtatataagtgttcccttttcttggcaaccttgccaacatctgttattttccgactttttaataatagtcattctgactggtgtgagatggtatcatattgtggttttaatttgcatctttctgatgattagtgatgttgagcattttttatatgtttgttgggtgcttgtatgtcttctttggataagtgtctgttcatgatctttgcccactttcaacggagttatttgtttcttataggttttgggtattagtcctttgttggatgcctggtttgcaaatattttctcccattctgtaggtcatttgtttactctgttgatagtttcttttgctgtatggaaggttttagttcaattaggtcccaactgtcaatttttggttttgttgcatttgcctttgaggttaatatctagaagggtatttcctagattttcttctaagattgtgtagtttgagatgttacatttaagtctttaatccattttaagttaaccttttttatggtgagaagtaggggattagtttcattctacatatggttagtcagttttcccagcatcatttattgaattaggatatcctttccctgttgtttatttttgtcaactttgtcaaagatcagatggttgtaggtatacagcattatttctgggctctctcttctgttccattggtctgtatgtctgtttttgtaccagtaccatgctgttttgattactgtagccttgccatatagtttgaagtcaggtaatatgatgcctccagctttgttctttttgcttagaattatattggctattcaggctcttttggttccatgtgaattttagaatttttttttctaattccatgaaaagtcatgttggtaaatagataggaatagtgttgagtctgtagattgttttgagcagtatggacattttaatgatattaattcttccaatccatgaatatagaatgcttttctatttgtttgtgtcatctacaatatctacctcttacatcaacatccaccgtaggaaaacactactaaccttctgtcaccacatagcagggttgtctttttttgagttccatataaatggaattatacagtatatattgttttctgtctgaggtatttccttcagcataatgatttaatcttgtagttcaagacttatttatcagtagttcatgacttattattgctgagtagtatacaaatgtatagatatgtcacagtttgcttattttttcacttgttcatggacttgtttttctatcttttggctattatgaataccaaacattaggtgtcttatggcaaatatatatttaacttcataggaaattgccaagctattttccaaaataggggtacaattttacactctcaccagcaatatgtcactgtttcagtagattcatattctttccagtacttatctgtatttgcagatctacatattgattatgtaaaaatctcaatgaatctaaaaagcaactattagacctaataagtaaacttagcaagattacagaaacaaatatttaataattatatttttatgtgatatgagtaataaattgaaaaactaaataaaaattaactttaatattgataaaaataataaagtacttagggataattgaacaaaggatattcaagacctctatactgaaaattataaaacacagcagatagaaattatagaagactgaaatcagtggagaaaaagatcatgtttgtgtgttgaatgactcagtgtcattaagaggttctttccaaattgctagagattcaatccaatcctaatcatgatctcagcatggtttgttgtttttgtttttatttttggtaaatattgacaaggtgatttaaaactctttaacaaaatagcaagaagttgacccagctagggattaatataagaatttatgattggcttaataattttaaaaatcagttaattagatttctggtttcaacttcaacatgcaaagagcttggaagttgttactcccattcttaaaacaataagatgttgatcagtcttaaaattaacaacttttcttggacctattagagaactgagatttcagtgaaaacctacagccagaagcctgaagagaaaagcaaatccagataatcacagatagtgcagaagccactaaagccataaacttacagaaacactcaaatagtaacttttttcaaattggtgggtgctgaatgtgggactagcatgagaatgagaaactgctggttactgaaatgttcgggaacccccaatacttttccttttagggaacccaccaggttctcatggtagagatctgagaaagattcctttatgactctggcagggtgcttattcttccgaataagcattgtaaaatatactcagagcattctccctaacaaaaaagtattttcctggaaaaaaggctttactagagccttatccaaggtaggggaagggcattgctcaactttagccaccttggccttcctgtctcatcagatgggggcaaaaggtgttacaactggagaaacacttgtgaatgtcacagcccagacacacagacccattatatcaagactgagatttaatcataaaatcattgagcattttccttctcccacatcttaccataacatgctaaccagtcttcatataataacaagtgcagactctgtctgaggaggaatatttcaagaagtccaaagtcaagaacaaaggcacaaacgaagacactagagaaatttgaagtctctggcatatatggctatagcacacatcaagtgcacttacacagattaacgtaaatactctaaaggtcatttacctcagttcctattaatcaatacaaacgtgtggttttcaacaaaaaattacaaggcattccaaagaccagaaaaaatacaatcatctaaacagatacagcagttaacagaaccagagtcagcaatagcatagattatggaattgttagaaaaggaatttaaaataacaatgaaactatgtgaaaagatttaatgtagagattagacaaaatgtatacaggtaagcaacatggaagatgactaatgaaagcctagaggtggaaactctaagattcaaaaggaaattctagaaatcaaaaacactgtacagaaataaatgactttgatgtacgtatctatagattagactcagacatagaatgagtcattgagtttgaagatagataaatagaaacttctcaaatggaaatgtaaagaaggaaggcaattgggggtgggctggtgaatagaatatccaataactgtgtgacagtttcaaaaggtgtaacatagatgtgcgtttggactaccagaagcagaagaaagagtgagcaaaacagaagaactatatttgatctttgaaagacataatgtagcaaactcacatgaggacagatagataatctgaataggcctgtatctattgaagaaattaaaccaattattagtaatcttccaaaacagaaagcaccaggcccacatgtgtttactggtgaattctaacaaaacattcaaggaaaaaattatatcagttctctgtaatctcttctagaaaatagaagcagatggaatatttccagttcatccctggaggattagcattacccaagtatcaaatccagacaaagacattaccagaaaggaaaactacagaccaatatgtctcatgaacataaatgcaaaaatcatctacaaaatattagcaaatcaaatccaacaatgtacaaaaagaattatacactatgaccaagtgggatttattccagttatacaaggctcatttagcattaaaaaaattaatgtaaaccatcacaccaacaggctacagaaaaaacaattaaatgattatattagtagatgcagagtaagcattgcatttgacaaaatctcacacccacacatgataaaaaccctcaacaaactaggaatggaagggaacttcttcaacttgataaagaacatctaccaagaacctacagcaacattatacttaattgtaaggaactagatgcttacctgctaagatcatgaacaaggtaaggatgtatccccaaggatttctatttaacatcttagtggaagtcctagctgtaatacagtaagatcagaaaagcaaacaaaagatatacagattgggaaggaagaaataacactatctttgtttgcagattacatgattatgtagcacatcccacagaatcaacaaaaacacttctggaactaacaagtgatttcagcaaagttgcaggatatgaggttaatatatgtaagtcagttgctttcttatataccagcaatgaacaattaaaaacacagtaccatttacattggcatctaaaataactgaaatacttatatataaatgtaacaaaatacatgtaagatctatataacgaaaatcagaagactgatgaaagaaatcatagaagatctaaataaatgggggggtggtgaaggtgatggttcatggctgtaatcacaacattttgggaggctgaggcaggaggatttcttgaggccaggagttcaagtctggcccggggcaatgttgtgagaccccagtttctaaacaaaaccaaaaaaatagccatgtgttgtggcatgcacccgcagtcctaactacccaggaggctgagttgagaggatcacttgagcccagaagttcaaggttgcagtgagccacgatcacgccactgcactccagcctgggtgacagagggaggccctttttcaaatgaatgaatgaatgaatgaatgaagagatattccaggtacatggatagcaatattcaatattgtcaagattgagttctttccaacttgatctatagattcaatttagtcccagcaagttattttgtagataagagcaaagtgattccaaagtgtatatggaatggcaaaagacccagaataaccaacacaatcttgaaggagagcagttgggagactgtcattactggacttcaagtcttattataaagctacagtaattaagacagtgttgtacaggtaaaagaataaataaatagatcaatgatacaaaataggtaacaccaaaatagatctgtataaatacaatcaactaatctttgacaaagaaacaatggcaattcagtgggggaaagtatagtctttgaaacaagtgatgctggaacaactggacatccatataccaaaaaaaaaaaaaaaaaaaaaatgcagacacagtccttacatctttcacaaaaatcaacccaaaatggatcataggcttaaatgtaaaacacaaaattataaaactcttagaagataacagaagaaaacctaggtgatgtggcttttgtaatagctttttaggtacaatagtaagaaaagaatcggtaacttggattttattaaaataaggcacaaaatggcagataggaggcggaactaacttgcagctaccacttggatggacagaacagcatgtggagacccacatcatgaacttttacttcatgaattactgcaggaacataccaacaaagacaagagaatccacagaccctttgaaggaggtggattgctgctgcaggctctatgggacagccaagaaaccgtgagcctgcttgctttctcagcttagaggcttgtagcctggggcagattctcagccctgctcaccggctgccgggaaataaactctgtgctgttgagggggcacagtgggagtgaaactggcctttcggctgcaggctgcctgggaactgggtcaggcctgtggctgcaggcttttccccacttcccgggtgacctgtgggatgcagcagaggcagccgtaatccccccggaatgtatctccattggcctgaaaaccacacccccattcctcacaggagccacagcaagccctgcccaaggagagtctgagctcagacatgcctagccctgcccctcaactgatggtctttgtctacctaccctaattgaagacaaacgacataatgccttgggagctgtattggcctgcacactacctgagaaacctgaacacttatccaaaggtgaccacagggcaagcttgtatcctccctatacaaccgcagctgatgtgctcttgaaagccccacctcatggctggaggccaaccaacacaaaaccaacacacttaccaaaaatacaaccaaggaccttcacagagtccacttcactcccctgccatctccactggagcaggtcctggtatccatggcttagagacctgataatggatcacatcacaggactctttgcagacactccccacccagtaccagcccagagcccagtagctccactaggtgattagatctggaagagaaataacaatcgcacagtttggctctcaggaagctccaccgcaggagaaagtggagagcaccacattaagggatcactccatgggacaaaagaatctgaacagcagcccttgagtcccagatcttcccactgacataatctacccaaatgagaagaaactggaaacacaattccggtaatatgacaaaacaaggttctttgacacccccaaaagatcacactagctcaccagcaatggatccaaaccaaaacaaaacctctgaattgccagaaaaagaattcagaaggtcgactacttagccaatcaaggaggcaacagagaaaggtgaagtccaacttaacgaaataagaaaaaatgatgcaggatacaaatggaagaatcgccagtgaaatagatagcataaataaaaaacaatcacaacttcttgaaatgaagaacacacttagaaaattacaaaatgcactggaaaggctcggcaataatattgaacaagtagaagaaagaacttcagaacttgaagacaggacttttgatttaatccaatccaacaaagacaaagaaaaaagaaaaaaaatgcctccaagacgtttgggatgttaaatggtcaaaccgaaaaatattggtgttccccaggaagaggagaaatctaaaagtttggaaaacatatttgagggaataatcaaggaaaagttccccagccttgctagagatctagacatccaaatacgagaagctcaaagaacacctgggaaatttattgcaaaaagataatcacctagacacatagttatcggttatctaaaatcatgatgaaggaaataatcttaagagctgtgaggcaaaagcatcaagtaacctataaaggaaaacctatcagattaacagcagatttctcagcagaaaccatacaagctagaagggattggttcctatctttagtttccttaaacaaaacaattatcaggcaagaattttttatcaggtgaaactaagcttcataaatgaagggaagatacagtctttttcagacaaacaaattctgagagaatttgccactaccaagccagcaccacaagaactgctaaagggagttctaaatcttgaaacaaatccttgaaatacaccaaaatagaatctacttaaagcataaaactcacagtacctataaaacaatacaatgaaaaaaaaaaacccaacaaagtattcaggcaacaaatagcacaatgagtacaatagtaccttatatctcaatgctaacattgaatgtaaatggcctaatttctccacttgaaagatatagagtggcaaaatggataagaatttaccaaccaagtatctgctgtctttgagagactcaccttccacataaggactcacataaacttaagataaaggggtggaaaaacatagtccatgcaactggacaccagaagcaagcaggagtagctattttttaatatcagacaaaacaaagtttaaagcaacagcagttaaaaaagaggggcattgtataatgataaaaggattagtccaacaggaaaatatgacaatcctaaatatacaggcaacccacactggagctcccaaatttataaaacaattactactagacctaagcaatgagatagacagcagaacaataatagtgtgggactttaatactctactgatagtactagacaggtcatcaagtcggaaagtgaacaaagaaacaatggacttaaactataccctagaacaaatggatttaatagatatttacagaacattctacccaacaactgcagaatataccttccattcattagcatatggaacattctccaagaaagaccatatcataggccacaaaacaagtctcaacaaatttaagaaaatcgaaattatagcaagtgctctctctattatagtggaatataactggaaatcatcttcaaaaggaaccctcaaaaccatgcaaataatggaaattaaataacctattcctgaatgattgctgggtcaacaatgaaatcaagaggaaaatttaaaattccttgaactgaacaatagtagtgacacaacctatcaaatctcctggaatacagcaaagctgatgctaagaggaaagttcatagcattaaatgcctatataaaaaagtctgaaagagcacaaatagacaatctaaggtcacacctcaagaaactagagaaacaagaacaaaccaaaccaaacccaaacccagcagaagaaaagtcataaccaataacagagcagaactaaatgaaattgaaactaaaaaatatacaaaagacaaattaaacaaaaactggtactttgaaaagataaataaaattgataggccattagcaagattaaccaagaaaagaagagagaagatccaaataaaccccattagaaatgaaacaggagatattacaaccaataccacagaaatacaaaagatcgttcaaagctactatgaacacctttatgtgcataaactagaaaacctagaggagatggataaagtgctggaaatacacaaacctcttagattaaaccaggaagaaatagaaactctaaacagactctaaatagtaacaagcagcaagattgaaattgtaattaaaaagttaccaacaacaacaaaaaaagtccaggaccagatggattaacagctgtattctatgagacaatcaaataagaatctgtaccaatgctattgacactattctaaaagataaaagaggtaatcctctctaaatcaaatcctaatatcaaaaccaagaaaggaccttaaataaaaagtaaactatagactaatatccctgattaacatagatgcaaaaatcctcaacaaaatactagctaaccgaatccaagaccatattaaaaatataatccaccatgatcaagtgggtttcataccagggatgcaggcatagtttagcatacacaaatcaataagtgtgatataccacataaataggattaaaaaccaaattcacatgatcatctcaatagacacagaaaaggcatttgacaaaatccagcaccgctttatgattaaaaccctcagtaaaattggcagagaagggacgtatcttaaggtaaagccatctgtgacaaacccacagccaacattatactgaatggggaaaagttgaaagcattccccctgagaactggaaaaagataaagatacccacttttaccacttctagtcaacatagtactggaaatcctagccagagcaattagacaagagaaagaaagaaagggcatccaaactggtaaagaggaagtcaaactgttgctgtttgtgatgattgtatacctagaaaactctaaagactcatctaaaaagctcctagaactggtaaatagattcagcaaagtttcaagatacaaaaataatgcacacaaatcagtagctcttctatacaccaacagttaccaagttgagaatgaaatcaagctcaattcctttgacaatagttgcaaaaaaaaaaatacttaggaatatacttaaccaaggagattaaaggcctgtacaaggaaaactacaaaacactgctgaaagaaatcagatgatgcaaacaaatggacacccctcccatgctcatggatggatagaatcagtattgtgaaaatgactatacttccaaaagcaatctacaaattcaatgcaattatcatctaaataccaccatcattcttcacagaactagaaaatacaatcataaaattcatatggaaccaaaaaagagcccacctagccaaagcaagacaaagcaaaaagaacaaatatggaggtatcacattatcccattgcaaactacactacaaggctatggttaccaaaacagtggtattggtataaaaatagttatgtagacaaatggaacaggatagagaacccagaaatacagccaacttatctttgacaaagcaaacaaaaacataagatgaggaaaggacaccctatttaacaaatggtgctgggataattggcaagccaggtgtataaaaacgaaactggattctcttctctcactttatacaaaaatcagctcaagatggatcaaagacttaaatctaagacctgacaccataaaaattctagaagtctcactccgtcgcccaggctggagtgcagtggtgcaatcttggctcactgcaagctctgcctcccgggttcacgccattctcctacctcagcctcccaagtagctgggactacaggtgcccaccaccacccccagctaatttttttttgtatttttagtagagatggagtttcaccgtgttagccaggatggtctcgatctcctgaccttgtgatacgcccgccttggcctcccaaagtgctgggattacaggcatgagccaccgtgcctggcctaaaaatgtattcttaaacaaaaaatgaaaaataaaaattgccctgcgaaagacactcttaaaggaatcaaaagagaggccacagacttggagaaaatatttgcaaaacatgtatctaaaaaagtattgctgtccacaagcttaaagaactttaaaaactcaacaataagaaaacaacctaatttaaacattggtaaaatttctgaacagatatcaccaaagaggctatatggatcacaaataagcatatgaaaatatgctttgcctcatatgccattagggaattaggatgggtctagagtggctttactttaggaattctttagtcctaccactaaggtaaaatctttttggggttactactgaatgcctctggttgagcattgagatatctctactcttggtgtttgaaattcaaatacctttcagtgttctgtcagctctcggatacattcagctctggaattcaggtaacttcgagtgctatgtaagctgtcaagtctaaacatctcttgggtttccacttcttttctgtgaagccccatgcaggtaaaataaaaatattaccatcaataacatttataaactcattctaccattaatgtcatttgttaatttaatttgcaacactcaagtagaaaacgttaagaggttggagaaaatttttccttctctacaacatctattccatgatatatatcccataaatgtataaacacaagtatatagatttgatccttacagaaattaaaagataataaagacaacaaaaatagtgcataaagcttgagcaattgatttagaaaaccctggattagaattctacttctatcatgccctggttttttgatcatgaaaaatcacttaatttctcaatgcttagaacagtatcattctaatattgtatataacagaatgttaaaatgatagtttaaattgaggtctccaaaactaggtggcaaatattccccaaattccaaagcaaggcactaaatcaccttggcaaggcttgaagagaaaatgaaaaagtaatttatgactcttaggtaaccacccaactcaattaataagagaagttagagaggccaagagagatgttagagattataaatatttctttaaagggagttttggtggtttttaagcctcccctatttttgaagaagtaggaaatgcttccctatctccctatgctggacctagtgaaaaggagttttcaaaatgattccttggacagcttaggatgtacacagtagattgagggagtagttgggatagcaagaaatactattgcttataactcaaccctatatggtttgctcttttaaagtatacattatatataagtgggttttctctaaatataaatattataatgcaaatattttctcttgaataatcagatctgagcctgagttctcatatagcaattatcagctgaagctgaagcatagctgcttctttaaattgtacagactttccagtttactaaaggttttactgttccatatatttcttacactttattcacttaagttaatttttaactgtctaaattttgcaggtatttgaatttccaaaacctgctcttggctctcaaattccaatagtttctgtaaaccgtgaactgttgactcagatatatttttacctggtacatgggattatattagttgtcttatctggcatttaggaataaattgcttaatgaataaacatcctactaaaaccagccttactgcctctgtttttgaatccctctagagcattacttatataaagtaatttttaaaagtatatcattaaattatattataattatttatatatttataatatataaattatataaatttataaatatatctataattttataaattatatcaatatatcataatgtataatatattaatgttaataatatattagtattatcaatatattatatataaatatatttataattttataagttatatataattataattaaattatattataattaaattatatttaattcccatgcttaaaagccttcagtgacttttcattacatctaaaataaaattcaaatgtatcaccttgatttaaaggtgtctatatgatcaagtacttgcttcttctccaacctcaatcactgtgttccaagcaccattaaccttttacagttcttttaataactcaagttaattcacaattaaatgtctttgttctagatcacctggattattgcctggttaaatcttttatattcatgcctgagctttaaagtcacctactaacagagcctttccttaagagacaaccacaaaacactctttatcacatattcctattttattttcattataacacatcactagcttatattttctcattttgcttatttgtttgctgttgcttcccttcaagtaaaatatagcaatatgagagcaagggcttttatgtcttgttcactgatatatcctcatatgtacaacagtgctcaatggtttggcagttaggtaatttatgaccttagctaatgtagtttcagagaaaagatggatgacaaagtttgatgaacatagggcaaagactgaatgcaagttgaataagcagagaaagcatccgttagtgattcaagaaatttgacactgaaagaataggaataagagaaaagagtaactaaaagaggaagaaaaagtaaaatcaggaagaggtggcagatatataatatagttatatacatatgtaacaaaccttcacgttgtgcacatgtaccctaaaacttaaagtattattaaaaaatatatatatatagttatatttctaggttgcactacaaaaagaggttattccaagcagccctcacttccataagtttctgcttttagtcagacaagggaagctctgagtagacttctttctacatctgttgattctcagttgccttcagctcaaaataatccatatgccaaagtggcatatattggtgtggcatattctgatcctcttcaaaatgaatgtaagtttttctatttatgtgtatatatgtatatatatatgtgtttgtatatgtgtatgtgtgtttatatatatgtatatatccattggattcctaaatcctataagcacatgatcaaaatatgtctcattccatttcagaatacttttgagagccatgtaaatccaatgtgttaatacattctgaaagagagtactcaaattcatatagttaatcatgatttaaggaaattagtgtaagaaaaggaaaaagtcacccccgtgggatatcagggtcaagaggaactgaaaggttaacttaatagcatccatgtagggtaagtcctttgaatcttacagttttggagatcagaatcccaaaatgagtctcacttggttaatatcaatgtgttggaagagctgcacttctttctggaggctgtagggaagaatttgttttccttcctttttcagcttctaaaggctgcctttgttctttggctcttggcccctttccatcctcaaagtccacagtggtcagtggagtctatttcatgttgcattaccctgacactaactccctgtgtctttttttgtttgtttttttcacttataaggactcttgtagttacggtgagcccacctgaataatccaagataatctccccatctcatggtcagccaaacagtgaccttcattccatctgcaaccttaatttcaccttgtcatgtaacataacatattcaaaggtttcagggatcaggacatggacatcttcagggctggtgcattattctacctactacactgatagtcaccctatattttattcttcacctttcctttcatatatcctcagctctcagctattagtttgattttttctacttttctctatcaccataactttttgagtactctgtaaactgtcacttgatttatttggtgatatgcaatagggccagaaataatctgttctggaaataaaaattcagtcagttaaatttcttcagaaatcacatacgcaatatacatttgttaaataaattaattaatacaagtatgtattcaaaaattgtatctaaattaatagaaacattagaattaatttgttttcacagctgaattatttcaaaatcactgactacattttcattaagtttagaagtattaagtggattgtttgctgtgtaatacatagattattatgctattaataaatagaaataataactttttcaggctatagcagaaatttttgcagtattttcttttctctagttgatattattagtaatggaaaaattaattggtactctataacttgcttgatcaatggctgtaagttactagaatatcctcaaaaacttagaaatttttatgtaggtcttctttcctcaaaaatcattgcaagagtcttgtagtgattatatgatattcaaaagtaaagctatccactgctgtgtgttcccaggttgtcccttacattttctatagtagaaacatcaaaaatattctaaggagatcttttagaaatattgcttcatttatatttacagtcagttttcaaaaataagattatcattttctttggagatcttgtataagccattggaaccatcatttttttctggtagtagcaaagaaaataaaagaaaacctaccaataatttaaatttaaatagtaatcagtgcagtggctatatcctcacttctgttactttgcttccttcactgagccaaaattccacattcaggttctgtttttgtaccacttaattcctgacaacaactgccatataagttgtggttcttaattgctaacaatagaaactagttggctgattgattagaaagggagtttattctcccattcacaattgctacaaagagaataaaatacctaggaatacaacatacaagggatgtgaaggacctcttcaagacgaactacaaactactgctcaagaaaataagagaggacacaaacaaatggaaaaacatttcatgctcatggataggaagaatcaatatcgtgcaaatggccatactgaccaaagtaattcatagattcaatgctatccccgtcaagctaccactgactttcttcacagaattagaaaatactactttaaatttcatatggaaccaaaaaagagcccatatagccaagacaatcctaagcaaaaagaacaaagctggaggcatcacgctatgtgacttcaaactatactacaaggcttacagtaaccaaaacagcatggtactggtaacaaaacagatatatagaccaatggaacacaacagaggcctcagaaataacaccacacatctacaaccatctgatctttgacaaacctgacaaaaacaagaaatggggaaaggattccccattttataaatggtgttgggaaaactggctagccatatgcagaaaagtgaaactggaccctttccttacaccttatacaacaattaatgcaagatggattaaagacttaaacgtaagacctaaaaccatgaaaaccctagaggaaaacctaggcaataccattcaggacataggcatgggcaaagtcttcgtgactagaataccaaaagcaatggcaacaaaaggcaaaattgacaaatgggatctaattaaactaaagagattctgcacagcaaaagaaactatcatctgagtgaacaggtaagctacagaatgggagaattttttttgaatctatccatctgacaaaagactaatatgcagaatctacaaggaacttaaacaaatttacaagaaaaaaaaaaccccatgaaaaagtgggcaaaggatatgaacagagacttctcaaaagaagacatttatgaggcccacatacatatgaaaaaaagctcatcatcgctggtcattagagaaatgcaaatcaaaactacaatgagataccatctcatgccagttacaatggtgattattaaaaagtcaggaaacgacagaagctggagaggatgtggagaaataggaacacttttacactgttggtgggtgtgtaaattagttcaaccattgtggaagacagtgtgatgattcctcaaggatctagaaccagaaatactatatgactcagcaatcccattactgggtgtatacccaaaggattataaatcatgctgctataaagacacatgcacacatatgtttattgtggcactattcacaatagcaaagactcggaaccaacccaaatgcccatcagtgataggagtggataaagaagatgtggtgcatatataccatggaatattatacagccatagaaaaggatgagttcatgtcctttgcagggacatggatgaagctggaaattgtgattctcagcaaactaacacaggaacagaaaaccaaacactgcatgttctcactcagaagtgggagttgaacaatgagaacacatggatacagcatggcgaacatcacacaccggggcatgttgcggggtgtgggactaggggatggataacattaggagaaatacctaatgtagatgatgggttgatgggtgcagcaaaccaccatggcacgtgtatacctatgtaacaaaccagcacgttctgcacctgtatcccagtacttaaagtataaaaaacatataaattcccagaattcccaggccccaccctagaactactgatcagaaattctcagtgtagggctcagccatctgtgtattaacatgtcctgtagaagattttgatgcatgataaagcttgagaatcaatattttaggaaaattcaatggctttttaaacctgatcaattaaagcaatagctcccctctcctcaaaaaagaaagggagtttattaaatggatattgggtaacttactgggagagctggaaaaatgagttcaagacaagcttccaagagcaacatcgcaaaccatgctatagaagtgacctaatgtggatgtattgacactcttaaaacaaattatgatctcttctcccactgtatctttattgcatgtgagaattactcagagaaggaaaaggctgaaagataagcagcaagcagttcgtgaaacaccccataaaccacatgattaaaaccccataaggaatttgaatattattctcgtggcaggagacttttaaacaggaatggcattatgagattttcattgtagaaagatgactgaggatgcattgtggaaaataggttggaagcaaggtcagaatacacaacaataggatgtttatgtacatgtatgtgcatacatatatgtatatgtatatcctattggcaaccaataggatgtatatgtatatatctatgtatgtgtatatatttctatttctgtctattcatcaatcaatcaatcaactatctagattgttttaagaaattggctcacacaactatggaggctggcaaatccaaaatctgtagggcaggttggcaggctggagacccagggatgattgatgttgctgtcttacatctaaaggcagtctggagtcagaattctttctcagggaacttggtcttataaggccttcaacagaaggccaatccatattatgaagggtaacctgctgtattcaaaatctgctgatttaaatattaatcacataaaaaatatcttcatagcaagatttagactggtatttggtcaaaaactgggtacctaagtggacataaaattaaccactacacaaggagaccagttaaggagttgcaatgtgaaagatttgatagtagcattaagaatgggcaaaaatagatgtactcaagagatgcttcaaagtagaattgactaacataatatgctgaatttggaatagaataacagatgataggcctgaccatcatagtggaaggttttgccactcactgagataggatacagaaaaagcaaagcaggatttggtaggaaagataaccagtttgttacgtgctaagtataagatttttgtggtacatgcaagtagagtgatctactgagtatttagatacattttctgaaatttggggaagaattctgagctgcagataaagattttggaatcataaacatataatggtaattgaaggctgagatggcccaggaggagtgagtaaggtatgaaaagaagtaggtctagaaaagaatgtaggaaaatatataagcagtagagaaaaataatttcccaagggaactttagaagtgatgggcaaaaaaaaaaaagaaattggagagtcttgttattataaaaagccaaaggaagaagaatgtatcatgaagaaaggtttgattataaagtcaaatattgcaatagggatcaaattagagaaagactgaaaagtgatcattgaatttagctactagaaagttgttattcgtgaccttattagccactaggtaataaattcatgtgtttttcataaaaaccctagaagaaaacctaggcattaccattcaggacataggcacgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacatcagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaaaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagtgcaccagcatggcacatgtatacatatgtaactaacctgcacaatgtgaacatgtaccctaaaacttaaagtacaattaaaaaaaaaaaaaacattaaaaaataaataaataaataaattcgtgtgttttttatggtatatttacccacttggtgttaaaccaatacattaccaagtagtctgtaattgtatttgtaattttagcattaactgctatatattcttataagtaagaactttttttaataattgaaagataaattatagtgttttatataaaattatatactttgagttttgtgaacatttgttataattatataaactaaatgtcacagctgaaaagtatcaagcagcctgtgaaaacatgaattaaactgattaatacattactgctttaagaaatacttaaaagatcttgaaatattttaactcttattaaaaatagtattttctcatgccatttctatgtttttaaaaattgattctatgcaagtcttttggatagtaactactaaaatagcactaggaaactaagctttggatattattttaaaatgagcatctataatatgccactctctaggtagcaaatggaggttagtgatataaacaaaacataaaaccattgttttctttatttttttctgaaatttatatacatttaaggggtacaattgcagttttgttgcatgaatatactacatagtggtgaattctgagttcttagtgtaaccattacccaaataatataccttatacccattaagtaatttctcatccctcatcctcctccttcccacctttctgagtgtccaatgtctattatttcacactttatgtccatgtggacacgttatttaactcccatctataagtgagactgtaatatttcacagtttctgagttgatctaacttaggataatggcctctaattccatttatgttgctgcaaaagatatgatttcattttctatggctgaatagtattccattatatatctctctatatagctgtacctatatcatctatctatctatctatctatcatctatctatccatccatccatccatccatctatctatgtatctatctagctcacattttctttatcgaaccatccattaatggacacttagattgattccatgtatctgctattgcgaatagtgctgcaataaacttataagtggaattatctttttggtataatgatttcttctcctttgggtagatacctaatattgggattgctggattgaatagtagttatatttttagttctttgagaaatatccacactattttccacagagtttgtactagtttattttcccaccaacaatgtgtaagtgttccctttcctccacatccttgccaacatgttattttttgactttctaataatagtcattctgacataagatgatatctcattgtggttttaatttgtatttctctaatgaatagtgttgtagagcattttttatatacttgttggcaatttgtaggtctttgtttggaaaaaatgcctgttcatgtcctttgcctgttttttaatggggttatttgttttactgttgttgagttgtttgagttctttgtagattttggatgtcagtccccagaatagtttgcacgtattttctcccattctgcaggttggctattcgttctgttgattgtttcctttgttgtcagaaggttttattttaattaagccccacttgcctatttttgtttttgttgcttgtgcttttgaggtcttaataatgaatcctttgcctaggccaatgtccagaagagttttctcaagttttcttctagtagttctatagtttgaggtcatacatttaagtctttactccatcttgagttggtttttgtatatagtgagagataggggtccagtttcatgtttctgcatatgacaatccaattttcccagcaccatttattgaaaaggatgtcctttcccagtgtatgttttcattgactttattaagtatcagttgggtgtagatatgtggctttatttctgggttctcgattctgttctattgagatatgtgtctatttttatatcaatatgctgtttgggttactgtagctttgtagtgtaatgtgaggctgggcaatgttatgtcttcagctttgttctttctgcttaagattgctttggctattctggcacttttattggttccatatgaattttaagattttttctaattctgtgaaaaatgacattagtattttgatagaaattgcattgaatctgtagattgctttgggaagtattgtcattttaatgaatctagatcaatttagggaaagttgccatcttaacaatattgagtcttgaacatcttcatttattttggtctttaatttctctttgtaatattttatagctttcagtgaacaggtcttaaaacatcttttgttaaacttattccaaagtatttcttggtgctgttttaaatgaatttttcttaatatataattggtctttgctagtagatagaattacaatttatttaaaaatttgggggctgggcatggtggctcacaactgtaatccagcactttgggcggctgaggtgggcagatcacttgaggtcaggagtttgagaccagcctagccaacatggtgaaatcccatctctactaaaactgcaaagattagctgggcacggttgtgggctcctgtaatcccacttacttgggaagctgaggcaggagaatcgcttgaacccaggaggcagaggttgcagtgagctgatattgagccactgtactccagcctgggcaacacgagtgagactccatcttaaaaaaaattgattttgcattctacaaccttattatttgtttcagtaatattttatggctttcttatggttttcctatataaatttgatgttttctgcaaatagagttgtcttcctttccagcctgcatgctttttatttttctcaccttaatgcacttgatagtacttctagtatctagcatgatagtaaatagaaataatgatagatgattcttgctttattcattatcctaggtagaaagtattgttcctcttgctgttaagaataatgtacaaattttccttaaatgaacttaatcagattgaggaagttcacttttcctagtttactgggagattttattaagaaagcatcttaaactttgtcaaatgctttttctgtatctatcaaaatgattggttttgttttcagttgataggatgacttacattgattgattttttttttttttttttttattatactctaagttttagggtacatgtgcacattgtgcaggttagttacatatgtatttttaaatgttcaaccaacattgcattcctggcataaatcccactggttatattatataattctttaaaaaattttaaaaatatatattttttagagatgaggtctttctctgtcacccaggcttgagttcagtggcatggtcatagctcactaaagcctcaaactcctgggctcaggcaatcctcccacttaagcctgctgagtagctgggactaccagcacacattatcatgcacagctaatttttcaaaaatcttatctgtagagatgggggtctcactatgttggccaggcttgtcttgaactcctggcttcaagcaatcattctgctttggcttccgaaagtattgggattccagaagtgagccaccacacctggttttttttttttctgtctttttcttttcttttttttttgaaaggctctactctgtcatccagatgggagtgcagaggtgtgattatagctcactataaccttaaatttctggacttaagcaatcttcttgcctcaccgtccttactatctgggatcacaggtatgtgccactgaacccagctaattttattatcttttaaagttttgtagagatgagatcttgctatgttgcccaggctggtcttgaaatcctggcctcaaatgatcctcctgccttggccttatgaagcactatagtctttttatatgttgttgtattaaatttgccaacattttttattggtattttttgaatctatattcatgagagatattagtctgaagttttcttgttttatgatatagtttgtcatgatttggtattagagtaaaagtatttttatagaatgagtcagaaaatctttcttcctctcaatttttctgcaggaattttatagaattggcattattttttcctctaaatgtgtcatagattttattttataagtaatggtatcttgacctggagttttctttgaggaaataattttaattagaattcagtttcattaatttgtatagtgctgttaaatttcctacttctccttgtgtaatttatgtctttctgggaatttgtccatttcatttagattgtcaaatttattggcataattttttaaataatatttgtttgttgtctttttaatttctaaagtttttatggtaatattcctttccttataaaaggaaatgtgtgtactttctttttaccttgatcactctggcggaaggtttattaatttcattgaatttttcaaactaggttttggtttcactttttttaaattgttgatctgtttctattttattgatttatctgatcatctttattattgttctccttttttctggttttgaaattaatttgctcttctttttctaccttcttaagatgaaagcttacataatttaagatctttttctttgctaatataggtaataaaagctctaaatttttctcaaagtgctgctttagctgcatctcacacctttgatatatttttattagtttattaaattatctactgttttttatcaatgcttatttagtagtttataatttaattttcaaacatttggagggttttctggatgttattaatttcaaattcaattgtggtcagaaactatactctttatgatttcaatacttttaaatgctttgatacttgttttatagttcgaaatattttatctcttagtaattgtttcttttatatttcaaaagtatatttattctgctctttttgggttgtgtgttttataaatgccaattgggacaagttggttgatagccttttacttatgtcttcttcatttttactgattttgtcttatattagttatcgagaaaggggtgctaaaaactcgaactataattgtgaattcatctgtttctctttgtggttctatcaattttgtattatgtattttaagctctgtaattaggtgtataatttaggatttttatgtttttttaataatttaacccatttattattatgaagtgaccacctttaaccccggtaatgttctgtattctgaaatcaactttactgtatattaatatatctttccacctatatcttaattaatgttagcatggtgtataattttctatgttttaacttttaacctatttgtatatattaacctatttgtatatatttaaaggaggtttctgtacaaagcatatacttaggtctgcatttttgtcttttctcacaatcactgcattttaaatggggtgtttacactgtttgcatttagtgtggtattggtatagctgggtataaatctaccatcttgctctttgttttctatttatcttactagttcttagctccccccaacaatattctgcgttattttttgttaaactttttaatgatttcattttgtctccttcgttggctaattagctgtaatcttcttgctgattgccttatggtttatattaatagtgtgcagctgtaccttatataaatttaccttcaattaatgttatactactttatgaatggtataatagtaaagtttctatttcccctcctattggcctttgtgttattgttaatatcattttacttctacatacgttataaaccacaaatgtactattattatttttgctttaaacagtaaattattttttaaagataacttgtattttatatttacccatatatttatcattttaaatgttcttttttcctttttgtatatccagatactatttgatatcatttcccttttgcctgaagaccctctttcacattccttttagtgcaggtctgttcatgatgaattatttcagttttatgtgtctgaaaagtgtcttcatttcagtttcatttgtgaagaaaacttaattttggtcattatttaaaaaaaattttatctcttctctccctcctctttctcttttttattactcaaattacaactaattaggccatttgacattgacccacagttcaatggtgtgctgttctttctctacccctcagtgatttttttctctgtgttatattttgggtagtttttattgacatattttcaagttcactaatcctcaatgaatttttttaaaaaaatctctagatattctatttgagatagataggtagatagatggatggatagatagatctatcttctgtatatctacttaacatgctcaatctctctaccttcttcaacatatgcagtgtagtataataaatgttttactatctctgtctattatttctatcctgttttatttctgggtctctttctattgatatttctccttgttacaagttatatttttttacttctctgcagtgaatgccatacctcttgaattttacgtttttgagtgctaaaggttttcgtatttctataattatccttgatctttgtttagtatgcagttaagctatgtggaacagtttgatccttttgtaacctggttttaagtactgctaagcagaaccagagcagtctttatcttagggaggaatttttcctcatactgaggtaatattctctgagtactttgtatgtgaattctgagggtttgcacttttgttggtgggaacatgaaaaattcttgcctcaacataaactttatttttggtttgttttcttgatttattcttcaagaaggatgctttttcttcttggtttgttctttcctcagtctcagatagtttcttcaaacttattccttccttagtacttagctaaagatttgaggaagacccttctgcaaatctctagagctctttttgtgtgtcacattttcttctttgctactcaaccctatgaactctagttgtccctggcctccctagactgttaattctgtctccccattcagtaggcctgctagattttatctgggttccccttccttgtgttggagccttgaaattctctctaggcagtaaactggggctatcataagcctcgccttatatattttctctctttcagggatcattgtcatttcctacctgatatgcagtgtcttaaaatttgttacatacattttgtacagatttttaattgttttatgtggtgaataaatctggcccacattcctcattatgaccgtaagtggagactctcatctaatttgtatctttatgcaagcaaacaaatgataagtaaatatacatatatatcagatcatttggtatagaatatgtaagtaaattttgttatatggtgttttctcattcttttttttttaccttcattcctcctccttccttttttttctctctctcttacttatatgttatgtagcatatgtagatgacttgttaccatttattttccagttttctcgtttttttaccttatcatgtttttctgtgtagatgttttatacttttatttagtcagatatatcagtctatttctttatgatctctgagttttaaattatgcttagaagattttttatatgtcaagattatcaacatatttacctgtgtcttttaagtctcatcttatgatttaattatatgaagttattgactcactttgaatttattgtggtgaaaatagtgtttaatcaattaaaaaatcttaaatgaaatgaggtgtatctagattcccaattcttgtttaacttcatggaaaaagctgccatctttcaaattccttattgtcattctttttttcaaattgttggagtattaaacatctgaggtatacaatttaatttacatctactaagagtaagatttttcaactatttataaaaataagggaaaccaaatagcaaaacatctgttgatcaataagttagtttctttgctcattaatattggtgctaattaaaatgttagaatccttgacttttattatattagactcgggagacctggtgttgattgctattgccaacatgaaagtggtgcagctgtcctacagctccaatttttgatcaatgaggtaaggattattttttgactacttaaatcacacactcccccactacacagtgaatcagttaatgtaatcttttaaatactgtgattctaaatgcttaaatatatatgcatgcaatattacttctgattatatttttcacaaaagactgtactcctgtattggttaatttattaaattttaaagaaaaaagattgtatatgccatattctgttattgttactatatagcataatttagtttaattatttaaattaagaaaaaatcctaatgtcttttgattgcttcactggccattaattttttttctatacactcacttcccaccaacttaaattttgtaattaaggcctaacttcatattttatctttatcttccctgaaatgatccttttgcttatatacgtatgggcccttttatctgcatatatctccaaatacatttgttggaatagatatgcatttgtagttatttttgtgtccgtagttattatggaaattagctttctactgtatctacatttttataaaattatggtgatgaggaactctctaaaaacaaaatatgtatttatgaagctcagagaggttgcagatattccattagtagaaggctactttaggctttcttaaatcagatttttatagtggaaattagagtcttctagagcttcttttatattaagtgagccagtcaatgcaaaaatgctttaaaagtttgtgccatgccaaatgcaggcacttagaagattgaactcagtgtctcggaaaaaaatgtttggttattttctcatggcatgacaatgatctttcattcagtgtctgcatatatttgcatatatctatatctgtttatcttcctaagaacttacaattataagtgtgggtaaaatgtctcatagaacttcatatcagaggtaacccaaggcaagaaagatattggcaaatgttcacttttcacttctcttggctcaaagtctttctcagaggactatgagatcctctttattgacaaacgtagcatatttcaccatgtaggcacacttgctatggggtactgaaatgagaaaggaaggtaaagaaaacatttgaaaaatatttcattgtaataactgctcattattatctagaatgtcaggcttctcgaggtctcagtgatactctgtagttccttgttgagggatctcagctttttgccttctgcatggatgtatacttacaggcataatttgtttccatgtgatttgtactgggtctgatcctttgagacttgtcttccaggtcctaagtttgcccctgtggtacataactaagaataaataaagacaagccttcaacctccttgccttgttcacctcatttatcctgaactactcgccctatgtacctcacacaaagctgctgtatcttttcccaaacttcccagtttctgacctgactggtttttctattcttagttttaagcattttcacagatctttatagtgcttttggtaggttcactttgtttttataaatgaacctagacactgtggtgttctgcttactttcatgtgtctgtctctgttggtgctgttatgcttagtggtaccgttcacttctctccgatgataagtcacatctcagttttatcacagaattaagaatactggccgggcgcggtggctcacgcctgtaatcctagcactttgggaagttaaggtgggtggatcacgaggtcaagagatcaagaccatcctggccaacatggtgaaaccccgtctctactaaaattacaaaaattagttggacgtggttgcacacacctgtagtcccagctactcaggaggctgaggcagaagaattgcttgaacttgggaggcagaggttgcagtgagctaagatcgcaccactgcactccagcctggcaacagagcgagactccatctcaaaaacaaacaaacaaacaaaaaaagaatactgagttcctcactagaattatttaggtattactgtaagatattattgaatatatgctactttaataacattgcctttggcatgttttatcttctgtatagcatgtaactatctcttgtagagaatgttttattgttgttacatatcatgttctatcctcaccccatctcaggtgaacttccacctctctgagaaatgagaccagtatactgtattcaaaaaaatcaagtgtaactcatcaaatgcttccaaggaatcctaataaatttctcgtttgtttataggaagcataagtacagtatacaaataaaacaggcaaacaaacacaaaaattatcaaggcttatatatagaatacctcctatttcattgaaggaaattatctgagttcatgttaagatgtatatatcaatatatacatctttgaacatgtatgtatgtaattagatataaatgtgcaaatcatacaaatttctaaatattttcttggatatgatctttgattatgtttctatttttataaagccattcctctctgagactaaaatcacaggtaccaaatataaagagacctatcataggatacatgagcatttttttggcttagaaattattatagaagggcatttagattcctatcttctctcttctaattcctaaagaagaaataaatgctagcaatttcaatatcgttcttcctagcatctaaatgggatatctgtgattgatactgtaaactatgagagattacttctaacaaagtactttggaaaatataaaaagccttttaggtatctctggacaaccaaggttctgaaagatcactcttagagaacacatttaatgctctggatttaggatctgtgaatgggtaagcatcgacattttcagctggttagctgtcattatggtaaaagttctaacattttaaaatgatctgatttaacccagtcaaataaatagtttaagcatatatacaaagtcatacaaacagttattatctgtccacatgctttctgccacattaagaggtagaaaatatcctattgtatgcgaaataggattcatttgtatttggtggtgctgtataaaaggaatcttagtataattttatagttatactaaattctagttggagaaatgttttcttttattatggatatttcctttataattgatgaagcttcttggactataagaagcaaattaaattataccaaatatactttttaggaagaatatacgctttccaaatatacagaaaattcttgcaaaggagaatttttatatgacctgtattcaattttgtaagactgcattgaatattttcttctctgtaaggctatatagtatatgtgtaaacagtagaaacaaaaaccatccctaaactattttttcccaaagaaaaacctttaatggccataacagtgctataataattaatcctctctattggtaaataaatattccttaagctagtctccctgaccgttgaaatgcagtgggtcagttgcctcttctactttcagcattcttacccttcctgattgaagtttatgcacctatccttccttatatttctgagataacaaaagtaactcttcaggtagtaaacattgagtaaattagcttgtttgtgattaaaaaaaccctaaattaagtaaatcacacacttactttatcttctttttgttctagggtgccttggtcagtgcaagttcagatgatacacttcatttgtggaaccttagacaaaaaaggccagccatactccattctcttaaatttaaccgggaacggtaagaacctatgaattaaacaatttcttaatgtacaacaaaattatttcctgagcaagtttttgttaacttgacaggcttttttcctcataatctcaacagctagaaataatttaatgtttatgcttactttcatagtgttttcttttttgtagaaaatgcgtaattgatatagatccagtcacctactaatgcagtgtttattagcttaaggagcttttgggctgagattatggggttttctatgtgtagactcatattatcttcaaagagagataatttgacttcctttcttcctattaatatttacaggccttttatttctttctcttgcatgattgctctgcctaggacttccagtctatgttgactaggaatggtgagagatggcatccttgtcttgttttggttttcaaggggaatgcttccaggttttgcccattcagtatgatgttggctgtgagtttgtcatagatggctcttcttattttgaaatatgttcctttaatgtctagtttgttgaggggttttaacatgaaggacatcgaattgtaccagaagacttttctgcatctattgagatagtcatgtggtttttgttttcagttctgtttatgtagtagatcgcatttatgtatttgtgattattgaaccaaccttgcatcctgggataaagcctgcttgagtgtggttgattagctttttcacgtgctgcaggattcagtttgctagtattttgttgagaatttttacatctgtgttcatcaaggatattggcctgaagatttttttgttgtatttctgccaggttttggtatcaggatgaagctggcctcatagaatcagttggagaggagttcctcctcctcaattttttggagtagtttcagttagaatggtacaagctattctttatgcatctggtggaatttggctgtgaatcattcttgtcctgggtcctttatggttggtaggctttttattactgatttaattttggaactctttattggtctgtccagggattcaatttctccctggctcaatcttgggagtttgtatgtttccaggaatgtattcatttattttaggttttctagtctatgtgcatagaggtgttcatagcagtctctgagggttttttatatttctgtggggttggtggtaatgtcttttttggcatttatgattgtttatttggatcttctctctttttctctttattagcctagctagtggtctatcatatttcttatgtcaaaaaaccaactcttgtactcattgatcttttgtatggtttttttgcctcttagtttccttcatttcagctctgattttagttatttcttgtcttttgctagctttgggtttgttttgtattgtttctctagttcctctaggtgtaatgttaggttgctaatttgagattttatgaatttttgatgtggacctttagcactataaactttcctcttagcactactttagctgtgtcctagagattctggtatgttttcttggttctcagtagttccagagaatttcttgatgtctgccataatttcattgtttacccaaaagtcattcaggaccaggttgtttaatttccatccaattgtatggttttgagcgattttcttagtattgatttttatttttattgcattatggcctgagagtgtggttggtatggtttcattttttttagattttctgaggattgttttatgtccaattgtgtggttgattttagagtatgtgctatgtacagataagaagatggtatattctgttccttttgggtagggcattttgtagatgtctaatagttccatttggtgaagtgttaagtttagatcctgaaaatctttgttaattttctgactggatggtctatctaaaaactgtcagtagggtgttgaagtctcccactattattgtgtgggaatctaagtctctttgtaggtctctaagaactcgctttatgaatccgggtactcctgtgttgggtgcatatatatttaggatagttaggcattcttgttgaattgaaccctttaccattacgtaatgtccttccttgtcttttttgatctttgttagcttaaagtatgttttgtctgaaataacaacccctgcttttttctgactgccatttgcttggtagattttcctctatccctttactttgagcctatgggtgtcattacatgtgagatgggtctcttgaagacagcataccattcagtcctgcttctttatacagcttgccactctgtgccttttaattggagcatttagccaatttacattcaagtttaatatttatgtgtgtggatttgatcctttcatcatgtttctagctggctattgtgcatacttgtttgtgtggttgctttatagggtcaacagtttgtatacttaagtgtctttttgtagtagcttataacagtctttgctttccatatttagcactcctttcaggacctcttgtaaggcaggtctggtggtcataaattcccttagcatttgcttatcgggaaagaatctaatttctcctaggtttatgaagcttagtttggctggatatgaaattcttgcttggaaattgttttatttagtaaggctgaatatagacccccaatttcttctggcttgtaaggtttctattgaaaggtcctctgttagcctgatggggtttcctttgtaggtgacatgccccttctctccagttgcctttcactttttcccttttctttcagccttggagaatctaattatgtgtcttggccatggtctttttgtgtagtatctcacgctggttctctgcatttcctgaatttgtattttggcctctctagtgaggctggggacgttttcatgggtgatattctgaaatatattttccaagttgcttgctctctccttatctcttgcagggatactaatgaattggagatttggtctctttacataatcctttattttttgagtgttttgttcattttctttctctgactgagttagttcagagaaccagtcattgagctctcagattctttcctgaacttggtctattcttctgttaatacttgcaattacattatgaaattcttgtagtgtgttttccactctatcagatcagttagagtctttttttttttttttaagacagagtcttgctctattgcccaggctggagtgcagtggcacaatcttggctcactgcaacctccgcctccctggtttgagcgattatcctgcctcagcctcctgagtagctgggactacaggtgctgggagcccaggtcaagaggcactgcccagtgaagagtagtggaggcatgtggacaagtctggctgcttttccataaagtggctgtgttgtgctagaggtttgtatcggtccccaaccactatatgtcctctcaatcccaagggcaacaggagcaagggctgcagggcagcaaaaatggtggcctgcttgctccttctgtgagctctgtcccagaaaagcacagagctgctactagcctgagagcctaggtagggggtggctagagaccccggtagggagacactgcccagagaaccatagcagggttggggacccatgtagaaaacagtctgctgcttttctgtaaggtggctgcactgtgctaggggttcatggtagtccctaatcactgtgtaccctcctgatcttgagggcatcagtggggaaggttgtagggcaacaaacatggtggcctgcctttcccactgagagctctgtcccagggaagtggagagctggtagtggcctaagagtccagtgtggggtggttgaggttctaggtcaggaggccttgctcagtgagaagtagcaggggtgggggctcctgtgtaaaacaatctggctacttttccttaaggtggctgccttttactgagtgtctacgattgcccctaatcactgagtacactccccagcctgagggcaaacaggagggagggttgtggatgtggtctgcctctccctctagaagcttgtcccagaaaagcacagagctgctcctgatccgagaattctggtagggctgtggtggtctcactagtgtcccaggcccatgggtcttatcctgcaaggtgctgcagagacgaggcctgtagcaccttgcaggataaggtctactgggcctagttactcttcagccacatggattcagcccctttcctggagacgtgagggagcctggcctcctccattgctagagctgcatctgctggtgttgaggtgcctggggatccagcactcctgggagtctgtgagtacctgagtgatggctctgccaagactccacataactctttgcatgtttgtctggaagccctggttgcagggatcatgagaaatctcctgatcctgagtccaaggatgcaaaggtccatgacagaagtgtgaatccctggggactctcactcactcactgttccctgtgatgtgaggactcctctggctccatgccacttctgggtgggcaattgtcctgtcttgctcttctctgttcactgtgggtgatgctgtttccctgataaatccccatgtttccacctggatgttctggttgaagagctagtgtccattcaccactgtttcttctctccatgagagtggtgcttattacccacttctactcagctatctcacgccaaatctctaaacttagtctttttttttaagaggaaaggaatttatattttagaaatttgttgaaactagataggacttatttctttagtcctaattctggttattttagtttaaaataagtaatgtagcagaaatttcaaggatatcaaaaaactttaagatcagtaaagagttgttcagaagagagtgggggccaatattcaacattcttaaagaaaagaattttcaacccagaatttcatatccagccaaactaagcttcataattgaaggagaaataaaatactttacagacaagcaaatgctgagagattttgtcaccaccaggcctgccctaaaagagctcctgaaggaagcactaaacatggaaaggaacaaccggtaccagccactgcaaaaatatgccaaaatgtaaagaccatcaaggctaggaagaaactgcatcaactaacgagcaaaataaccagctaacatcataatgacaggaccaaatacacacataacaatattaactttcaatataaatggactaaatgctccaattaaaagacacagactggcaaattggataaagagtcaagacctatcagtgtgctgtattcaggaaacccatctcatgtgcagagacacacataggctcaaaataaagggatggaggaagatctaccaagcaaatggaaaacaaaaaaaagcaggggttgcaatcctagtctctgataaaacagactttaaaccaacaaagatcaaaagagaaaaagaaggccattacataatggtaaagggatcaattcaacaagaagagctaactatcctaaatatatatgcacccaatacaggagcacccagattcataaaggaagtcctgagtgacctacaaagagacttagactcccacacaataataatgggagactttaacaccccactgtcaacattagacagatcaacgagacagaaagttaacaaggatacccaggaattgtactcagctctgcaccaagcagacctaatagacatctacagaactctccaccccaaatcaacagaatatacattttttttcagcaccacaccacacctattccaaaattgaccacatagttggaagtaaagctctcctcagcaaatgtaaaagaacagaaattataacaaactgtctctcagacaacagtgcaatcaaactagaagtcaggattaagaaactcactcaaaaccgctcaactacatggaaactgaacaacctgctcctgaatgactactgggtacgtgacgaaaagaagacagaaataaagatgttctttgaaaccaacgaaaacaaagacacaacataccagaatctctgggacacattcaaagcagtgtgtagagggaaatttatagcactaaatgcccacaagagaaagcaggaaagatccaaaattcacaccctaacatcaaaattaatagaactagagaagcaagaggaaacacattcaaaagctagcagaaggcaagaaataactaaaatcagagcagaactgaaggaaatagagacacaaaaaaacccttcaaaaaattaatgaagccaggagctggtttttcaaaaagatcaacaaaattgatagaccgctagcaagactagtaaagaagaaaagagagaagaatcaaatagatgcaataaaaaatgataaaggggatatcaccaccgatcccacagaaataccatcagagaatattacaaacacctctatggaaataaactagaaaatctagaagaaatggataaattcctggacacatacaccctcccaagactaaaccagggagacgttgaatatctgaatagaccaataagaggttctgaaattgtggcaataatcaatagcttaccaaccaaaaacagtccaggaccagatggattcacaaccgaattctacccgaggtacaaggaggagctggtaccattccttctgaaactattccaatcaatagaaaaagagggaatcctccctaactcattttatgaggcccgcatcatcctggcatccaggctttgataccaaagcctggcagagacataaccaaaaaagagaatttaagaccaatatccctgatgaacatcgatgcaaaaatcctcaataaaatactggcaaacagaatccagcagcacatcaaaaagcttatccaccatgatcaagtgggcttcatccctgggatggaaggctggttcaatatacgcaaatcaataaatgtaatccagcatataaacagaaccaaaggcaaaaaccacatgattatctcaatagatgcataaaaggcctttgacaaaattcaacaacccttcatgctaaaaactctcaacaaattaggtattgatgggacatatctcaaaataataagagctatctatgacaaacccacagtcaatatcatattgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagagaaagtcaaattgtccctgtttgcagatgacatgattgtgtatctagaaaaccccattgtctcagcccaaaatctccttaagctgataagcaacttcagcaaagtctcaggatgcaaaatcaatgtacaaaaatcacaagcattcttatacacaaataacagacaaacagagagccaaatcatgagtgaactcccattcacaattgcttcaaagagaataaaataccttggaatccaccttacagggacgtgaaggacctcttcaaggagaactacaaaccactgctcaaggaaatagaggatacaaacaaatggaagaacattccatgctcatgggtaggaagaatcaatatcgtgaaaatggccatattgcccaagataatttatagattcaatgccatccccatcaaactaccaatggctttcttcacagaattggaaaaaactactttaaagttcatatggagccaaaaaaatcccccattgccaagtcaatcctaagccaaaagaacaaagtcggaggcatcacactccctgatttcaaactatactacaaggctacagtaaccaaaacagcatggtactggtaccaaaacagagatatagatcaatggaacagaacagagccctcagaaataattctgcatatctacaaccatctgatctttgccaaacctgacaaaaacaagaaatggggaaaggattccctatttaataaatggtgctgggaaaactggctagacatgtgtagaaagctgaatttggatcccttacaccttatacaaaaattaattcaagatggattaaagacttaaatgttagacctaaaaccataaaaaccctagaagaaaacctaggcaataccattcaggacataggcatgggcaaggacttcatgtctaaagcaccaaaagcaatgacaacaaaagccaaaattgacaaatggcatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacacccgttagaatggcaatcattaaaaagtcaggaaacaacaggtgctggagaggatgtggagaaataggaacacttttacacggttggtgggactgtaatctagttcaaccattgtggaagtcagtgtggcgattcctcagggatctagaactagaaataccatttgacccagccatcccattactgggtatatacccaaaggattataaatcatgctgctataaagacacatgtgcacgaatgtttattgtggcactattcacaatagcaaagacttggaaccaacccaaatgtccaacaacgatagactggatgaagaaaatgtggcacatatacaccatggaatactatgcagccataaaaaggatgagttcatgtcctttgtagggacatggattaaactggaaaccatcatctcagcaaactatcacaaggacaagaaagcaaacaccgcatgttctcattcacaggtgggaattgaacaatgagaacacatggacacaggaaggggaacatcacactccagggcctgttgtggggtggggggaggggggagggatagcattaggagatatacctaatggtaaatgacgagttaatgggtgcagcacaccaacatggcatatgtatacatatgtaacaaacctgcacattgtgcacatgtaccgtaaaacttaaagtataataataataaaattttaaaaagagttgttttactgtttctttttctttaccagtaaaatattaacctatttagatcaccatattgattttatctttctctctgtttgtaagatttttcttctaatactttgaatagatctgactgtatacttttatgtggatggacagagtgtttttatttcccctcacaattggaatgttgaaggcaatgttctggccccttttatggactttttgggaggaagaattgattagtggtgatgatttccaatagtgattttattatctcaactgagttagattaattggtagaaacataaaagagcaagctgacagatttgagataagttttaatcacaggaagtttgaaaatgttttaatgcttacattaaagataaatgtgatatttatctcttaagaaagatacatacatattgtcatgtaacatgagaatattcattatgatcataacttattggaggagataaaattatctatcgaagtatggtgaatgggaggttcaggtcctataggagaatttaaccaagcatcttttgggacattctccaaaacatctgatattagccgtttaattctgtaaattttctaagtactcttatgtttatgctaaatgtgtttcagtttataaatttatactataaattttagcttattttattagggcacctacagtctttagtcttacaatttttgaaggcagaatccagccttagattgttaagtaataggctttcattattattattactattattggagtattattattggagacagggtcctgctctgtctcccaggctggagtgcaatggtgtgatcctagctcactgcagcctcaaactcctgggctcaagcaatcctcccgcctcagcctccttagtgctgggactatgggcatgtgctaccatacccagctattttttttttaaagtagagatggtttcttactatgctttttttgagacagggtctcactctgtcacctaagctggagtacagtagcatcagcttggctcacacaaccttgaattcctgggctacagcagtcctcccaccttagcctcctgaggtgtgcactatgatgcctgactaatgttaattttttttttttttttgtagaaacagattctctccatgttgcccaggctgatttcaaattcctgggctcaagcaatcctcccaccttagcctcccaaagtgctgggattagaggcatgagccactgtgcttggcctggggtctcactgtgttgcctaggctagacttgaactactgggctcaagctatcctcctgccttggccttacaaagtattaggattacaagtatgaacctttgcatctggtaaggcttatatattaaagcctttctggtggatgatccttggacttcttacaaatacgattttaaacctaaatagggaagaaaaaatgtcttgatttttgtaatgcatgatctgagtaatgaataaaataaaacattcatattttaggcatagcagtccttgctatcacaatcataaatttatgtaatactggagaaagcatagagttgttttatatggcttttgagtgaaattcaaatgtaggctacgatatacagacccttaaattatctgtacttattatgtatatttaatttttcttactctagtgttctgctacttactatcagagaatttctgaaaactattaactaaactggaaggaagcaatattttgttgaaaactccataatttatgaaatctctggcaaactggatccatctgaattggcttttgcagacccaatttataacccacatttaaaatattttataaaggcaatttgaactggctttgattcttttcaaagtgttgcataactaatatatttactgggtttgacattcaaaaggtacaacagtgtatgcaataaaggatctttcttctattcctgtcccctggacacttacttacttcccctcagcagagctaaacagtgtaattaatttgttttttctttatagacgttcattacatacatatataagcaaatataatatgtaacataattttctttcttatatgtacataagccaaatagaaaaccatatatttttacatatatcatatatagagagaatatcatatttttttgttaaacaaattagcaagacctttaaacaaattagcaaggtctttataatatattataaagagggaaaaaagcgagacaaaatatacatatatatttatatatattttattacacacaatatattgttaaacaaattagcaagatctttagaatatattataaagaaggaagaaagcaagacagaaaactgcataacatgctacataacaatgaaaataaataaactacagttaaatgcaacatggatgaaactcataaatacagtgctgagcaaaagaagccgaaagaaaacttcatatatattattccatttttgtatgcgtcaaaaaacaggcaaaattaatgctacatgttaatgtagcatgttatacagttttgtgtcttgcttttttccctctatagtatattctaaaggatcactctttatatagactttccctatttctttgtttgtttgtaaattttactgaatcatcaggaaactgtttaaatcttaagtgtacaccttgaaataactttgccgttgtgtaacaaacacctaaatcaagatacagaaaattactagattcatagaaactcccctatgttaccttccagtcacttacccccaggtatcctaatttccaactctatagattaattttgcctgtttttgacacatataaaaatggaataatatatatatagttctttgcttttggattcctttgctcagcactgtatttatgagttccatccatgtggcatttagctgtagtttatttattttcattattatgtactattctatttaatggatattctgcaatttgattaaccattctattttagttctctttcttaaacttaacttttgcatttctattttttataacatttctttagaaaatatatcaataatttggtataataataaaaatttttaaattctttttatatctcttttttctatctctcattctctgtctctcactctatcttccaaatacatactatagcctgactcatcatattgttttctgtctcccaagtagcataacaccttgctcttttatttatgttttttgttgttgttgttttttaaaaattttttattatacttaaagttttgggatacatgtgcagaaagtgcaggtttgttacataggtatacaagtgccatggtggtttgctgcactcatcaatccgtcatctacattaggtatttcttgtaatgctatccctcccctacacccccatcacccaacaggaccagtgtgtgatattcccctccctgtgtccatgtgttctcattgttcgcctcccacttatgagtgagaatatgcggtgtttggttttctgttcttgtgttagtttgctgagaatcgtggtttccagcttcatccatgtccctgcaaaagacatgaactaatccttttctatggctgcataggagtccatggtgtacatgtgccacatttactttatccagtctatcactgatgggcatttgggttggttgcaagtctttgctactgtgaacagtgctgcaaaaagcatgcatgtgcatgtgtctttatagtagaataatttctaatcctttggttatatacccagtaatgggatggctgggtcaaatggtatttctgattctagatccttgaagaatcgccacagtctcttccacaatggctgaactaatttacactcccaccaacagtgtaaaagtgttcctatttctccaaatcctctccagcatctgttgtttcctgactttttaatcatagccattctaactggcgtgagatggtatctcattgtggttttgatttgcatttctctaatgaccagtgatgatgagctgtttttcatatgtttgttggctacataaatgtcttcttttgaggagtgtctgttcatatcctttgcccactttttgatggggttgtttttttcttgtaaatttgtttaagttctttgtagattctggatattagcctttgtcaaatggatagattgcaaaaaatgttctcccattctgtgggttgcctgttcactctgatgatagtttcttttgctgtgcagaatctctttagtttaattagatcccatttgtcaattttgccttttgtttccattgcttttggtgttttagtcatgaagtctttgcccatgcctatgtcctgaacagtattgcctagattttcttctagagtttttatgattttaggtcttacgtttaagtcttcaatccatcttgagttaatctttgtataaggtgtaaggaaggggtccagtttcagttttcaggatgtggctagccagttttcccaacaccatttattaaatagagaatcctttccttattgcttgttttagtcaggtttgtcaaagatcagatggttgtagatgtgtggtgttatttctgaggcctctgttgtgttccataggtctgtatatctgttttgttaccagtaccatggtgttttcattactgtagccttgtagtatagcttgaagtcaggtagcatggtgcctccagctttgttctttttgcttaggattgtcgtggctatgtgggttcttgtttggttctatatgaaatttaaagtagttttttttctaattctgtgaagaatgtcagtggtagcttgatggggatagcattgaatctacaaattactttggtcagtatggccattttcaccatactgattcttcctatccatgagcatggaatgtttttccgtttgtttgtgtcctctcttatttccttgagcagtggtttgtagctctcctcgaagaggtccttcacatcccttgtaagctgtattcctacgtattttattctgttagtagcaatggtgaatgggaattcactcatgatttggctgtttgtctattattggtgtctaggaatgcttgtaatttttgcacattgattttgtattctgagactttgcttaagttgcttatcagcttaaggagatttggggctgagactatggggttttctaaatatataatcatgtcatctgcaaacaaagacaatttgatttcctctcttcctatttgaataccctatatttcttttgcttgcctgattgccctggctagaacttccaatactatgttgaataggagtggtgagagagggcatccttgtcttatgctagttttgaaagggaatgcttccagtttttgcccattcagtatgatattggctgtgggtttgtcataaatagctcttattattttgagatacgttccatcagtacctagtttactgagtgtttttagcatgaaatggtgttgaattttgtcaaaggccttttctgcatctttggaggtaatcatgtggtttctgtcattttttctgtttatgtgatggattatgtttattgatttgcatatgttgaaccggccttgcttcccagggatgaagctgacttgattgtggtggataagctttttgatgtgctgctggacttggtttgtcagtattttattgaagattttcacatcgatattcatcagggatattggcctgaaattttccttgtttgttgtgtctctgccagattttggtgtcaggatgaagctggcctcataaaatgagttagggaggagtccctctttttctattgtttggaatagtttcagaaggaatgataccagctcctctttgtacctctggtagaattcagctgtgaatctgtcttgttctggactgtttttggttgttaggctattaattactgcctcaatttcagaatttgttattggtctattcagggattcgacttcttcctagtttagacttgggaggttatatgtgttcaggaatttatccatttcttccagattttctagtttatttccatagaggtgtttatagtattctctgatggtagtttgtatttctgtgggatcaatggtgatatccactttatcattttttactgcatctatttgattcttttctcttcttctttattagtctggctagcggtctatctattttgttgatcttttcaaaaaaccagctcctggatttattgattttttttgaagggttttcctgtctctatctccttcagttctgctctgatcttagttatttcttgtcttctgctaccttttgaatatgtttgctcttgcttttttagttcttttaattgtgatgttagggtattgattttagatctttcccacattctcctgtgggcatttaatgctataaatttccatctaaacactgctttagctgtgtcccagagattctggtacgttaagtctttgttctcattggtttcaaaaaacatctttatttctgccttaattttgttatttacccagtagtcactcaggagcatgttgttcagtttccatgcagttgtgtggttttgagtgagtttcttaaccccgagttctaatttgattgcactgtggtctgagagactgttcgttatgatttctgttcttttgcatttgctgaggagtgttttacttccagttatgtggccagttttagaataagtatgatgtggtgctgaggtgaaagcatattctcttgatttggggtggagagttctgtagatgtctattaggtccacttggttgagagctgatatcaagtcctgaacatccttgttaattttttgtcttgttgatctaatattgacagtggggtgttaaagtctctcactattattgtgtgggagtctaattctctttgtaggtctctaagaacttgcctagtgaatccgggtgctcctgtatgtggtgcagatatatttaggatagttagctcttcttgttgcattgatccctttactattatgtaatgcccttctttgtctctgttgatctttgttggtttaaagtctgttttatcagagacagggattgcaacccctgctttattttgctttccatttgcttggtaaatgttcctccatccctttattttgagcctatgtgtgtctttgcacatgagatgggtctcctgaatacaacactctgatgtgtcttgactatccagtttgccagtctgtgtcttttaattggggcatttagcctgtttacaattaaggttaatattgttatgtgtgaatttgatcctgtcattatgaagctagctggttatttttcctgttagttgatgtagtttcttcgtagagtcgatggtctttacaatttggtatgtttttgcaggtgctggtaccagttgttcctgttcatgtttagtgcttccttcaggagctcttgaaaggcaaagccgccaggaagcttttgtaaggcaggcctggtggtgacaaaatctctcagcatttgcttgtctgtaaaggattttatttccctttgcttatgaagcttagtttggctggatatgaaattatgggttgaaaattcttctctttaaaaatgttgaatattttccccccactttcttctggctggtagggtttctgcagagagatctgctgttagtctgatgggcttccctttgtggctaacctgacctttctcagtggctgaaggaaaaatgttaaacattttttccttcatttcaaccttggtgaatctgatgattatgtgtcttgggattgcttttctcaaggagtatctttgtggtattctgtgtatttcctgaatttgaatgttggcctgggcctgtcttgctaggttggggaagttctcctggataatatactgaagagtgttttccaactttcttctgttctccccatcactttcaggtacaccagttaaacataggttaggtcttttcacatagtcccatatttcttggaggttttgttcattccttttcattctttttttctaatcttgtcttcgtgctgtatttcattaagttgctcttcattcttgacattctttcttccgcctgattgatttgtctattgatacttgtatatgcttcacaaagttctcattcagtgtttttcagctccatcaggtcatttatgttcttctctaaattagttattctagttagcaatgcatctgaccttttttctaggttcttagcttccttgcattgggttaaaacatgctcctttagcttggaggagtttgttattacccatcttctgaagcctacttctgtcaattcatcaaactcattctccatccagttttgttcccttgctggtgaggagttgtgatcctctggagcagaagagtcattctggttcttggaattttcaacctttttgcgctggcttctccccatctttgtggatttatctacctttggtctttgatgttggtaaccttcggatggggttttggtgtggatatcctttttgttgatgttgatactattcttttctgttggttagttttctttctaacagtcaggccatctgctggagtttgctggaggtctactgcagactgtttgcttgggtatcaccagtggatgctgcagaacagcaaagattgctgcctgtttctttttctgtaagcttcatcccaaaggggcacccgccatatgtcagctggagctctcctgtatgaggtatctgtcaacccctgctgggaggtgtctcccagtcaggagttatgggggttaggtacccacttgaggaggcagtctgtcccttagcagagcttgagcactgtgctgggagatctctattcagaactagcagccaggaatgtttaagtctgctgaagctgcgccaacacccgctccttcctccaggtgctctgtcccagggagatgagagttttatgtataagccccagactggggctgctgcctttctttcagagatgccttgcccagcaaggaggaatttagagaggaggtctggctatagcacctttgtggagctgtggtgggctccatccaggtggaacttcctggcggctttgtttacactgtcagcagaaaaccgcctactcaagctgagtaatggaggacgcccctccccccaccaagatagcatgtttcagatcgacctcagactgctgtgttgacagcaagagtttcaagccagtagatcttagcttgctgtgctcggtggggttggggtccactgagctagaccacttggatccctggcttcagcccactttccaggggagtgaatgcttgtctcactggcattccaagcgccactgaggtatgaaaagtaactcctccagctagctcggtgtctgctcaaatggctgccatattttgcacttgaaacctagggccctggtggtgtaggctccggagggaatctcctggtctgcaggttgtgaagactgtggaaagtgtagtatctgagccggaatgcacagtccctcacagcttcccttggctaaggtagggagttcctcaaccccttgcacttcctgggtgaggcaacgccccaccctgcttctgctcctcctcgatggtctgcaccaactatctaaccagtcccagtgagatgagctgagtacctcagttcaaaatgcagaaatgactcaccttctgtgttgatcttgctaggagctgcagaccggagctgttcctatttggccatcttgccagccgctcttgcatttctgtttaacaaatggcttgaaaaattccacaaacacccttgtgagattttgattagaactaccttgaatctatagatcattttcgggagaactgacatgactgtgggagatggcaatattgactctctgtcattgacagtgacagtggtgattcattcagtctgtggacatatgttatattcctttatttgcttagagtctttgctttctccaggtaacatttatagatttttttgtagagatgttccacatttttttaggttttgtcttaaatatttgattttttaaaaaatgtcaactcttattttagacagagaggatgcatgggcatgtttaatgtttattacatggacatattatgtgatgctgaggtttggggtatggatcctgtcgcccaggtggtgagcatagtaccaaataggtagtttttccgtctagtatgtagtttgccttcctccgtcttctagaagttcatagtgtccattcttcaaatgtttatgtctatgtgtgctcaatgtttagctcccacttttaagtgagaacatatagtattgttttctgttcctacattaattcttttaggattattgcctccagctgcattcttgtggctgcaaaggttgtgattttttttttttatggctgcatagtattctatggtgtatatgtaccacattttctttatctgatccactgttgatgggcacttgggttgattccatgtccttgctattatgaatactgctgtactaaacatatgagggcagatgacattttggtagaatgatttattttcctttgggtatatacccagtaatgggattgctgggtcaaatgtttgctctgctttaagttctttgagaaatatttgatattttttaatgcttttgtaaatggtagttgtatatacatattttataatatatattcatacatatttatacattatataaacacacacacatgtcttttgttgttgttaccatattacactagttaggaccttgtattaactatctattgctatataacaatgttaccataaacttagtgacttaacacacatttattatctcatagttcagtgggttaggagactagtcatagcttagttgagtttacaaaaagttttaaaaatgttttttcagagatagagcctcactatgttattcaggctggcctcaaacccctaggctcaagggatccttctttttcagcctcccaagtatctggaatatctggaactacaggcatgtgccaccatgcctggcttatttgagaattaaaaaatatatattattagctgacttttttgttgcagggtctcacaaattaaaattgtggccagggctgtgcgattttctgaggtttgactgggaaaggatctttattcaagctcattttgttgttggtagcattcatatcccttgcatgttgttggattgagggcctcaactttttgccggctgtttggccagaggtgatcctcagttttttgccatatagccctctcaataagccagctcacaacagagcagcttgctgcttcaaaaccaataagggtgtgagtttccttacaagatggaggtcgtaatcatatgtgaacacagaagtgacagcccatgacctttgtcatattctattagctaaaaggaaatcacaggtcccgtgcacactcaagggcaagaatactatgaggtgggactcatggaaactacctttgagtttgtcctctataggcctccagtacagtactgactaaaatggaaaagaacagtggttttcttgtctcattactgattgtagggggaatgttttcattatttcacctttaagtgtgatatttgctggaagatttttggtagacgttctttgtaagattaagaaagtttattttgctcttattttcctataagcgtatatatatatatatatacgcttataggaaatatatatatattttaaatcatgaatgggtgttgaattttatcatatactttctcatgcacctattgagatgagcatgtaatttttccctttttaaatgtgttaatgtggtaagttacatcagttgatctttaaatgttagatgacccttgcattcccagaatacatacaaattttgcgatgtattagcattattatatgtgctaatatatgctgggtttgctaatattttgctaataagttgagattttaatctctatgttcacaaaagtttagtatgtaagtttccattcttttgattcccctgtcaagttctcacttcatagttatgtcgactttatgaaatgaatgggggatgtttccttttttctatactctataaatatttgtgaaattttggtgttccctcttaaaatttggaaaaattcaccagtaaagcaatgtaggcctgggttttctatgtggggcaattttaaatgacatattatatttccttaataggtgtagaaatgttcagatattctgttttttcttgagtcagttttggtaagttgtgtttttgaagaaatttttcctattcatctaatttttcaaatttattagccttaatggtagggcctgtagtagtttactattttcaattcctaatattggttatttttgagttatcttttttaaaaataagtcttctggagatttatcattttttcagtattttcaaagtactgatagaattcttgatttttttcaaatgtacatgtatttttctagtttactgatttttattcttcattgggtttggtttactgtcttttaactagattaatgagatggaaccttacataactgatttcaatattttttcttctttaatatgtgactttagggccataatttttccctgaaaattgtttgagctccatccaacagattttatgtctaatatttattaatgttgaactaaaacttttataatttttcctatagtttcttatttgaaccttgtgttatttagaagttaattagttttcaagaagttgagagttttctatctcttgttagtaaaaaataaaatgccactgtggaaagatcatagtatatggttttagcttctttgacatttgttgagacttgttttatgattcagcacatggacaattttagtaaatgtgcacaaactaattttactattctgttactaggttcaatgtactatatatgtaaatttgactaagttcattaattgtgttgttagatctgtaaattcttactaatttgtttgtatttgttctatctgatattaagagaggaccgttaaaagctcccactatgattataaattttagaatttctctttttagtagtgatgacttatgttttgaatctaagttgttggatgtatacatttattttctgtatatgtatttattactttatcattataaaatatctctttctctgtagtaatatatcttgtcttgaaatatacattgatatttgcatagctagtccatctttactttgtgtttgcatggcatatatatttccattatattattgtcaatgtcttcatagtcatttttaagcatacaattttaaaaaattagtctgacaatattagtcaatttttcttttttgagacggagtctcactctgtcaccaggctggagtgcagtggcacaatctcagctcactgcaacctccacgccctgggttcaagtgatactcctgcctcggcctcccaagtagctgggcctacaggcacacaccaccatgcccagctaatttttgtcattttagtagaaatgtggtttcaccatgttggccatgatggtctcaatctcttgaccttgagatctgcctgcctcggcctcccagtgctgggattacaggcgtgagccaatgcacctggtgacaatattagtcttatacttggtgtacctaacatttaatataatttattgatatagctaggtttttatctgccatatttttatttcagtctttatgtttcttttttattttactttctttttacttaaactttttattatcctatttttctctatatgacattaatatgtattttttcacgctttttgagggattatctttaataactctttttgaggatttcaacatgaatccttcacttattttgatctaaaatagagcatttcttttaccacttctttaataatgacagcaacttgcactttacctctatttaccatccctgttgctctttggattattttttttgtattttattttcacatccgttttaaaccctataatacattgctaatatagtttagtatgttaatattgtttatattcatatatatttatcagcatatgtatttattctttctttttatcctcattccttactatgtctacttgcattctttttcttttgcctgaaaatttttctttattctttattttactgcagctttgttagaacaaattctctctgcttttattatttcactttttaaaatacttttttatttcataatagttgcagatttgtaggaagttgcaaaactagtacagaggttttatgttcaattcaccccatatgttaatgtcgtacatgcactcgtgtgtgtgtgtgtatacttgaatgtgcatagttatatgtaattttatcatgactacactcatgtaacaaccactataatcaagacacaaaatggttctatcaccacaaagattgttcttgtgctacccatttatagtcacttccattgtcatccctatctctcctatttctaacgcctggaattcactaatctgctctccatatttataattttataactcaagaatgttaaataagtggaatcatacaatgtgtaactttttgggattgtatttttacaaagcataatttcctggagattcattcaagttgtgtacatcaagagcttattttatttcttgagtagtattttacagtattagtgactacagtttatttaactattcacccattgaaggatatctagattgtttccattgtgaacttattacaagtaaagctgctatgatcatttgtgtgcaagtatgtttgtgaacataagttttcgtctctcggtgtaatttccaaaaagcgcaattgccgggttgtatgacatttgtttacatttataagaagatgcaaagctatttcctggagtggctgtgtcactttatatttctaccagaaatatgtaggagatctagtttctccatatactaactagaattttgtgacatctaggtcacgtctcggtgccttaggtctcaaagattttctctgattttttttctaaaagtttttatggttttacatttaaaattataactcattttgagctatttttttgtttaaggtatgagattgaggtcaaggttgttttttcttctactatggatgtccaattgctccagcagtatttgttgaagacgattttttcattaaataattgctcttgcacttttgtcgaaactccgtcggatgctgttttagtctttttgatgtaggcatttaatgctatgtactttcctcttagcagcacttttgctgtgtcccagaggttttgataagttgtgtcatgattattattcatttcaaagaatttttaaatttatttcttgatttcattgttaacctgttgtgggaaaatcaaatattggagagactgaaaaaggttcaggaaagtttattaaggtgatcaccggctcagccggacatatgtccagaattctgagccctgaacaaagggcttttcctacttttaaacttcttaaggtgggaactacgtgaggcgagaagtaagttacagaagcaagaaacaaaggcagcattacgacatttcttacatcttgagagaaacatgtcttgcaacctaaacttattggtattgtgaccctgcagccatgcaggaactcactgggcctctaataaactttgaggaatgtggagttgtggagtatagataaggttcactgtccacagagagaagacaggctgttagtattcctttttaacttgagtgtaaggggggtgtcacactttgcagcaactttaggaagattttaaaatttctattactactactattaggttatagttattttcattatttccttcttcattcctcccttttggtgctcgacacaaatgtagattagtaaagagcaccacagttagctatttcttcttgagtgggtacatacccatcttgtgataccagttggtacttttgcaaagccaccaagaacagacataccccacgacccgaataatggctctgctgctgagtttttcttgtcctagatttttacaggtggttttaatattatttagtttactgagatgtgcagcttggcaggcatcaaaatatatggagacaggccttttatgcgagtacgggaatacttctgttttgtttacaagtttactgaccctggtttctgtggggttggtatataatggcattaggggttcgccaattcggactttaaacccgaagtcatagggcaagaactctgggtcataacatagttggggctgctcatttccaggattgcagaccgagtaactagtctagttatagacacaagttcctgtatgagtccctgtacagttgtagtaggtctggtataacagagttttagtcacaccttttctggaccaggcttctatcatacagtgatgacagacatcctggtccccaattataaccataggtgaaagtgtcggtggctttagtattactaatatgattaagcttatactatgcacaggcacccttctaggcaacaagcttggcagcatttgcaaagataacatgacagcaaaataatcagtacaagtaaacatataactatgtttgtacatttaacccgcatttagttatctatcattgacttccttaggctttggccatgcatagactagtcagattctgtttgtgtgactagagcagggctcagtgtttcctcaagcttcagttgtgcatggaccgaccagcctctggtgcagtcagagcagggaagttgtccgtgtcagcagtgacttggtttcactgcaggatcagccatgttgggtggtcttggttttgttgactggtccactggtcctggatggcagctgctgctggtttcagccagctatgatgaacccaaggtatgatacctgcaactttaacagctgtgcggatagacaagatcacaatatggggaccatcccataaaggccctaaagtggttgggttctattgtttgacccagagtctccaggttggaagggatgtactgcatctgtgaggctaacaggtattctttctcttactcacccttatatttcctgtatggcctcacctaaggcttgcatttgccttcttaaggttaattccccagattctcttaaatcaccttttatctgagttatcatcaggggtgcttggccaaacactatctcatagggtgaatacccagttactttagtaggggtttacctggctcagagaaggaccatgggcagcacctgatcccaccttagatgagtttcttggcaaaactttaacagctgtttgagtgtctggttcattcttttaacttttccagaactttgtgggcgataagctgtatgcagtttccatttgatttttaacatctgcattagctgttgtactatttctgtcacaaatgctgggccattgtctgttcctaaagttaaaggcagttcaaatttaggaataatgtcctttagtaagattctggttacttcctgagctttctctttcctggtaggaaatgccttcacccaccctgagaaagtgcagacaaacactagcatgtaccagtagcctctggcttgaggcagctccataaagtccacaagcaggttttcacagggtataactccagtttcttgaatccctgggggccgtgttggccgctgccatggattgttttgggcacaagccaagcattgctcacaaacggcttgagtgatggcagttgggagcagcacatagaaatgtcgtcctataagagtttctaatgcagtttttcccatatgctttccttgatgaaactgctttatgaaccggggggctattgcttctgcgatggcaagcctcccatctgagaacttccactaacatcctttctggtaacttccactctcctgctcaaacgaagccttttcattagaagagtagttagggagttctgttaggggaagctccagtaagggcatggtaagggtttccttttccttcttagttacctctgtcattacagctcttttggcttctctgtctgcctttctgtttcctctagccttgtcacctcctcctgtttgttgttctttgcaatggatgactgctacttcttttggagcccatacggcttctaagagcttctctatttcctttttatttttgatttcctttccttcagtagttaataatcctctttccttatatttggctctgtgggcatgcaaagtggcaaaagcatgccttgagtcagtatagatgtttactgactttcctttggctaagagcaatgctctagtgagagctattagctcagctctttgggccaaagttccgactggcagagggcgggcttcggctactgaattcagtgttaccactgcacatccagcccgtctgacaccttcagatatgaagctgcttccatcagtaaagtatttaacatctgggtctcttaagggctagtccgttaagtttttttggcttgataaaacctcatccactgtttccacacaacagtgataccctgggccacacaatggggctttccgtgctccacccattctgttggcagcagtgtggctggatttagagtgttcacagtctccagggttatgtaggggttttcacacaaaagcccttgatatcttaacatcttagggttagatagccagtgatgccccctctgctccatcagggtgacacgaccatgtggggcacccgaattattaacctttgtccaaatgtgagcttgttagcatcttccactaacagggcagtggctgccaatgccttgaaacagggtggccatcccatagccaccaggtctagacacttggagaaatatgccgtgggccagtaccatgaccctagtgtttgtaccaagattcctgtagctattccttttctttcatggacatacaggtaaaaaggctttgtcatgtctggcagtcctaatgctggggcctggatcaaagccttcttgatgtctttgaaggccatgtcctgctctttttcccacaggagggattcttcccccctgcccccgccccagctttggtagccttatacaatggttttgccaaaagcgagtaatttggaatccaaatgtgacagaaaccatctgcccctaaaagctcctgcacttgtcgcctagtgtcaggtagaggaatgccacacatgttctcttttcactcatgtccaagctcatgctgcccctgagagatgttaaagccaagatatcttgccctttggccacagatttgtgcctttttccttagacaccttatagccagcctcccacagaacacgaaggaggctttctgtgccttgaaagcactcttcttttgtgggtgcagccaacaatacatcatccatgtactgcaacaggacacaggggtcacttggtggcacaaaagccttcaggtctgtctagtgcttcctcaaaaatgattggggggtttttgaatccttgggggagcctggtccaagtatactgtgatgagccccactcaaagacaaagatgccctggctttcaggagctcgttggatgcagaagaatgcatcctttatgtctaagcatgtaaaccaagcagcatccacaggaattcacccaagcattgtatatgggttgggcacaatggcatataatgtagctgcaactttatttatggcccgcaaatcctttactggctggtaatctctggagggctttaacaccggtaccaatggagtgttccaagacaaggcacatctttgcattatcccaaatttaaggagccagtctatatgctttgtaatcccatgggtggcttctgctgggatgggatactgacggattcacactgggtaagtgccccgcagcagttccaccactacatgtgcctgatttatggctagcctgggggactgtcttccacccagacccctggcagcttgagaaataatttcttatacattgcctcattttcccgctggcaaaatgcatctttataaattttgcatctctcatagagtctccattcctttgttgttgggacagtaggggtcattatcatgccttttctttgacctaggtttagagtcgtgcccccttacggtgtaaaggagatttgtgcttgcaatttctggagcaaggcttttcctaacaagggcaccagacaatttggcaaatataaaaattcatgttgaacctgctgtcctccaatcacacatcttgtagatttgaagtaaggcctctgttactcctgtagctccaattatattgacataatttttagacaatggcccaatcgcttgagttactcctgagtgctctgcaccagtattgaccataaagtccactttttggccctctacctccattgagaccataggctccttggggcctaatgaagtggaacccagtctgtctcagtcctcataataatcattgattcctgccactctgattaaatccatatctgacttctgaaccccttgactggtggcagggggttctggccagccgttttgtccttgattgttgcctctatccttttctctctctggacattcattcctccagtgtcccatctgcttgcatttcacacattgatctttctcaatcctaggtcagcccccttgttctggcttagcttactggttttgcctagctagtcctctaccatgactgtgaccatgaccacgtcctctcacaaaaccggtttctcttccaactaaggctgctgccagcaagtctgccttttccttggctctgcatctagcttctctcttggcctcctcatcttgatttacaaacatcttagtagccacctgtataagcttggtaatatgccttcaaaaccttctaacttctgaagctttagctttatgtcttcttgcacctggcttacaaatgccgcattaaccatacactgattacctgcagcctctgtgtcaaatggcgtgtaaagccagtaagacttgcagagtctctcataaaattcactgggactttcatttggctctggtggacctctgagacctttctgatattggcctttttccctgcaggctttattccatttaggagtgcctcttgatactgctccaaactttgtagcccttgagcctggttagggtcccagtttgggtcagcgtctattgggagtgcttattgtgcatactgcctgatatctcctgtgcctgcaggtgcattgttctccagcctctagagagcagcttgtataactctacagtgctcttctgtattaaataatgacagaagaagttgtttgcaatcagcccaggtaggattgtgagttaggaaaatggactgcattagatctataagagcctgaggcttctctgtataggagggagtatgttgtctccaatttaagagatcagtagtagagaagggctgataaacgaagagctgttctgccccttggacttcattctgtgcattcaaataaatttgtttctgtgtttctcggaggggcacctgcattgcttgggcatggcccgacctaaggcagccgacctcatccccttggagttcctcccttggcttttcaggcaagggctctggctcctctctgcatggtgttgctttcttctgagtctgagcctctgtaggcagctggggcagcctcctgtctaagccttgtcagggatggataaattggtgcataggggggtggactttctaactcttcaggtggggcctgtaagatggtttttttctgctttttctatgactccttttctttttctgatgccttgcagtctctttctgtggttcctggttttgtccaggccattagagtcttacagtaggtcttaaagtaggctgcagtgccctgcagccactcagggcaggtctgaattacacttagccaggagtcgatatgtggaaactgatccaggtgcccaggctgttctccaagcctggtgaccacccaaaacactcggccaattatctccctgtctattttccccttggctggccaccctaccttaagagatggccagtctatctcacaaagggttctcagtttctgtggagttaggttaacatcataatcaccattaaaaccttttttaaagtttttcagcatgcactccagtggagtaggctttgatgcttttcctcccatttcctccctcatggcatgctttcactctcagtttcacttttggatccaccagactgggtcctattacaggaggttttgatactacttagcccggagagtgccttaattcctgtcacagctagctgcagctgtggaactggttctatggactgtatgcagtgtcctaggtctggtttttcccatactctccttggagcacacagtccatgataagaggtctgtgcctcccagcgtcacgctctatgttggtctctcctgagaccatctctttcacacactttcacacacttcctctgtccctgaaacagttttcctttctgaccaattcacgagccccacctgcatctggtgtcagttagggtgtgagtttcatccgaatcagcaccctgtcaaaacagaaaatcttctgtctccactcccggatgggtccccagaaatgttacggggcaatcaaagactggagatgtgtccagaattggtgggttcttggtctcactgacttcaagaatgaagccgcggaccttcatggtgagtgttaacagttcttaaaggcggagtgttcggagtttgttccttctgatgtttggatgtgttcggagtttcttccttctggtggattcgtggtctcgctggctaggagtgaagctgcagaccttcacggtgagtgttacagctcataaaggcagtgtggacccaaagagtgagcagcagcaagattattgcaaagagccaaagaacaaagcttccacagtgtggaaggggacctgagcgggttgccactgctggcttgggcagcctgcttttattctcttaactggccccacccacatcctgctgattggtccattttacagagagccgagtggtctgttttgaccgggtgctgattggtgcgtttacaatccctgagctagacacaaaggttctccacgtccccactagattagctagatacagagtgtcaacacaaaggttctccaagtccccatcagagtagctagatagagtgtcgattggtgcattcacaaaccctgagctagacacagggtgctgattggtgtgtttacaaaccttgagctagatacagagtgctgatttgtgtatgtacaatcccttagctagacataaagattctccaagtccccaccagaatagctagatacagagtgtcgattggtacattcacaaaccctgagctagacacagggtgctgattggtgtgttcacaaaccttgagctagatacagagtgccaattggtgtatttacaatcccttagctagacacaaaggttctccaagtccccaccagaggagctagatacagagcatcaattggtgcattcacaaaccctgaactagacacagggtgcagattggtgtgtttacaaaccttgagctagatacagagtgctgattggtgtatttacaatcccctagccagacataaaggttctccaagtccacaccagagtagctagatacagagtgtcgattgatgcattcacaaaccctgagctagacacagggtgctgattggtgtgtttacaaaccttgagctagatacagagtgccaattggtgtgtttacaatcccttagctagacataaaggttctccaagttcccaccaggctgaggagccccgctgtcgtcacccagtggatcctgcaccagggccgcaggtggagctgcctgccagtcccgtgccatgcgcccgcactcctcagcccttgggtggtcgatgggactgggcaccatggagcagggggtggtgctctttggggaggcttgggccacacaggagcccacggagtgggggaggctcaggcatggccagctgcaggttctgagccctgccccgctgcaggttctgagccctgccccacagggaggcagctaaggcctggggagaaatcaagtgcaatgccagtgggccagcactgctgggggacccagtacaccctccgcagccgctggcccaggtgctaagcccttcattgcctgggtccggcagggctggccggctgctctgagtgcggggcccgccaagcccatgcccacccagaactccagctggcccgcaattgccacgcgcagccccagttcccacttatgcctctccctccacacctacctgcaagctgagggagacagctccggccttgaccagcccagaaaggggctcccacagtgcagcggtgggctgaagtgctcctcaagtgccaccaaagtgggagcccaggcagaggaggcgcccagagcgagtgagggctgcaagggctgccagcacgctgtcaccactcagagagaccaaaaaaggtggaggaaagtttattaaggtgctcaccggctcagccggacatatgtccagaaagtctgagccctgaagaaagggcttttcctacttttaaacatcttaaggtgggaactatgtgaggcaggaagtgagttacagatgcaagaaacaaaggcagcattacaacatttcttacatcttgagagaaacatgtcttgcaacctaaacttattggtcttgtgacactgcagccatgcaggaactcactgggcctgtaataaactttcaggaatgtggagttgtggagtatagataaggttcactgtccacagcgagaagacaggctgttaatattcctttttaacttgagtttaagggagggtcacaatttgcagcaactttaagaggattttaaaatttctattactgctactattaagttatagttgattttattaattccttcttcaaacccaaaaataattcaagagcgtattatttaatttccatgatttgtatagttttgaaggttccttttggagttgatttccagttttattgcattgtggtctgagaagatacttgatatgattttgattttcttagattaattgaggcttattttgtggcctgtcatggtctatcttggagaatgttccccacgctgatgagaagaatgtattatgcagttgttgggaagaatgttctgttaatatctgttaagcccatttgttctagggtatagtttaagtctattgtttctttgttgactctctgtcttgatgatctgtctagtgctgtcagtggagtattgaagtgccccactattattgtgttgctgtctattttatttcttaggtctagtactaattgtttaatatatttgggagctccagtgttaggtggatataaatttagaattgtaatatcttccttttagactaatccttttatcattatataatgtccttctttgtcttttttttaactgttattgttttaaagtctgttttgtctgatataagaatagctagttctgctcatttttggtttccattggcatggaacatgtttccagctctttaccttaagtttatgtgagtccttatctgttagatgagtctcttgaagacaacagatattgggttggtggtgttttattcattctgccattctgtatcttttaagtggagtttttaggccatttacattcaatattagtattgagatgtgaggtattgttctattcatcatgttagttgcctaaatactttgtttttttttaaattgtgttattgttttataggccctgtgagatttatgctttaaggggtttctattttggtgaatattgaggttttgtttcaagatttagaactttagaatttcttgtagtgctggtgtggtagtggcaaattctctcagcatttgtatgtctgaaaaagactttatctctccttcattcatgaagcttaattttgctggataccaaattcctggctgacaattattttgtttaaggaggtggaagatgggaccacaatcccttctggcttgaatcccttctggcttgtaaggtttctgctgacaaatctgctgttaaccttataggtttttctttataggttatctgatgcttttgtctcacagctcttaagattcttttctccatcttgacttcagtagtaattgttgtagtcacattgtttagcctgatgattgtgtgccttgctgataatttttttgtgatgaatttcccataagttatttgagcttcttgtatttggatgtctagatccctatcaaggccagcaaagttttcctcaataattccttcagatatgtttcccaaaatttagatttttcttcttcctcaggacaccagttaattttaggtttggctgtttaacataatctcatatttcttggagactttatttttttaattctttttttttcattttctgattgggttaatttgaatgccttgtctctgacctctgaaattctttcttctacttgttctagtctattgttgaaactctccagtgcattttatatttccctaagtgtgtattttatttccagaagttgtagttctttttctttatgctatctctctggaaaattttttatccatatcctgtatttttaaaaaatttctttgtgttgttttttaccttcctctggtatttccttgggtaaactatttcttcaaattgttcttgaatttagttttgattggattgtggtgttttttaaatttctttctgctcttaaggatcaaactttaatgtttgtagtttattttagctgaatttggttcttggtgcttttacgggtgaagactctgtatgagttacttagttatagtctttgtctgctggttttcccagatgctggttgtagtagttatatacttggtatatgggcaagtttactgtctcctagggggttagaatggcagggatctcttgaagcttatcttgttctctcatagtgtatactttttttacttatttaatttttccctagtattttatttactgaattggtgattcaaccttcaggccaataggggtggtattcctggctaggcactggttgtagctaaggcaggttgaggagacatactaccaatggtgggcagaggcccagtatttattaagttggctgggggagctctcaattaggtgtggagaggctttatcagggcaaagagtgggagctacctcagctcccctgccagactagcaggaaagctatcagcctcacagccttactcttgtccaagtgttctggctgttcaaatcagacaggctgtatgggtctatttcaagattctttatttttttctatttttatgtgtctgtccctctgccaataccacacttttaaaattattgtaaccatacagtaagctttaaaattggatatactgattcttccaactttattctttttcaaaattgtcttagttactctagttcctatggctttctacctaaattttagaataagtttttttacttttcaaaaaaaaatcttgcgataatttgataggaattacattaaatctgtatattactttggggagaatttatatcattgcttatgttgagtcttccaattcatgaacatagtatgtctctacatttacttagatcttctttgatttctttcatcatttttttttggcatacaaatcatgtacatgtcatgttagatctatacctatgtatttttttgattgtgagtggtatttttaaattttgtttggcacatgttcattgctgatatatagaaatacaattaatttttgttgactttgtgtcctgcaactttgctgaactcactagtaagtttcaggcagaggcagctttatctgcttgggacccattccattggaccaaggtctgtactaataagggccaatgcttggttaaatactctgctctgaccatcttgaaattcttggtaattttatctctgaatccatgttttttaaatgaagtttcataggagaatggagtacatgtgtaagcaggagggacatgacagtgtgtgtgtatatatacatttgtaatcctgtttttgaggtttattgtaattgggttttgaattttgtcaaatactatttctgcatcaactgatgatttttctgtttcagcttgttatttagtgaacaacattgattgatttttgaatattgagctagccataaatttctggaataagcctctcttgtttttaaatgtatggctgaattctatttagtaatcttttgttaagaacttttacatttgggctgggcgtggtggctcatgcctgtaatcccagcactttgggaggctgaggcaggcagattacgaggtcaagagatcaagacatcctggccaacatggtgaaaccccgtgtctactaaaaagaaatacaaaaattagctgggtgtggtggcgtgctctgtagtcccagctactcaggaggccgaggcaggagaattgcttgaacctgggaggtggaggttgcagtgagccaagatttcgccactgcactccagcctggcaacagagcaagactctgtctcaaaaaaacaaccaaaaaaacaaaaaaaatcacttttacatttctattcatcagggatattagtctgtagttttctttattttactgaatttatctggtttgttctcaggtagtctttatttataaatttgaacgttttccctcttgtattttctggaagagattgttaaaattggtatcaattgttgggtgcagtggctcacgcctgtaattccaatactttgggaggctgaggtgggcagatcacttgaggtcacaagttcaagaccagcctggccaacatggtgaaaccccatctctactaaaaatacaaaaaattagccagacgtgatggcaggcgtctgttatcccagttactcgggaggctgaggcaggagaattgcttgaacctgggaggcagatgttgcagtgagccaagattgcaccactgcattctagcctgggcaacagagtgacactctgtctcaagaaaaaaaaaaaatggtgtcaattattctttaagtgtttggtaaaattctctagccaaatcatgagtgtgtggaaatttcttttttggaaatttggaaattataaattcaattttcttagtagctacagggatattcagcctatttcagttggggttattgtgctagtttacagtttctgaggaattttttcatttcatctaagttgttaaatgtatttgtgtggagttgttatcattttcaaagctgcatggtctgtagcaatactcattgtttcattcctgatgtttgcactgttttttctttttttctcctaaaaaaatctcctactagagatttttctattttatgtaacttttcaaggaaactgctttgtcattcattgattatctctattctttttgttttcaattttgttgatttttgctctttactatttttttttactctgctcagtttgtgtttattttggttttctttttctaggttgttgagacaggaggtaagttactggtttgagacttttcttattattattgtaattttattttattttaagttctgtgatacatgtgtaagacatggaagtttgttacataggtaaacttgtgccatgttggcttgctgcacctatcaacctatcacctaggtattgagccctgcatgcattagctatttatcctgatgctctccctccccgcctaccctcaacaggccccagtgtgtgttgttcccctccttcttccacgtgttttcattgttcagctcccacttataagtgagaacatgtggtgtttggttttctgttcctgtgatacatggctgatgataatggcttcgagctccatccatgtccctgcaaaggacgtgatctcattcctttttatggttgcatagtattccatggtgtatatgtaacatattttctttattcagtctatcattgatgggcatttgggttgattccatgtctttactcttatgaatagtgctgcaataaacatattcatacatgtatctttataataaaatgatttacattcctttggatatatacccagtaatgagattgctgggtcaaatggtatttctggtcctagatctttgaggaatcaccatactgtcttccactctttaaaatggttgaactaatttacattcccaccagcagagtaaaagcattcctatttctccacagtctcgccagcatctgttgtttcttgactttttaatggtcatcattctgactggcatgagatagtatctcattctaattttaatttgcatttctctaatgatcaatgatgttgactttttttttcatgtgtttgtcaaccgcatgtatgtctttttttgagaagtgtctattcatgttctttgcccactgtttgatggggttgatggtttttttcttggaaatttgtttacattccttatagattctggatattagacctttgtcagatggataaattgcaaaaattttctcccattctgtaggttttctgttcatgctgatgatagtttcttttgctgtgcagaagctctttagtttaattacatcccgtttgccaatttttgtttttgttgcagttgcagttgacgtttttgtcatgaaatctttgcctgggcctatgtcctgagtggtattgcctggattttctctaggattttaatagtttttggttttacaaatagaaagagaggaagtcaacctgtctctgtttgaagataacatgatcctatatctagaaaaccctatagcctcagcctaaagcttcttaaactgataagcaacttcagcaaagtctcaggagaaggttacaaaataaatgtgcaaaaatcacagggattcatatacaccaacaatagacaaacagagagccaaatcatgaatgaactcccattcacaattgctacaaagagaataaaatatctaggaatatagctaacaagggaagtcaaggagcacttcaagaactacaaaccactgctcaaggaaatcagagaggacacaaacaaatgtaaaaacattccatgcttgtggataggaaggatcaatattatgaaaatggccatattgcctaaagcaatttatagattcaatgctattcccattaaactattattgacattcttcacataattagaaacaaattctttaaaaatcatatagaaccaaaaaagggcccacatagccaagacaatcctaagcaaaaagaacaaagctggaggcaccacactgacttcaaactataccacaaggctacagtaaccaaaacaacatggtactggtaccaaaacagacacatagaccaatagaacagaataaagatctcagaaataagaccacacatctacatctgatcttagacaaacctaacaaaagcaatggggaaataattccctatttaataaatgttgctgggaaaactggctagacacatacagaaaattaaaactggaccccttccttataccttatagaaaaattaacccaagatggattaaagacttttttctttttaaatgtatttagcactacacatttccctcttggcagtcttttagctatatctgacaaatgtttatatttccaattttattcagttcattatatttttaaaaattttattgtgacttcttagacacaaagattacaataaggcatgatattatcatgttttggtcaatgatggactacatataaaagaggataatgaagctgaaaaatttctattgcctcatgcgttcatagccattgtaacattatagcacaatgcattgcccttttctatatttaaatatttagatacacaaatgtttaccattatgtaacaattgcctacagtattcactacagtaacatacggtacaggtttgtagcctaggagcaataggctatacaagttgtgcattccttatccaaaatgtttgagaccagaagtgttttggattttagatttttctgaatattggaatgttgagattattcctaccaggtgagcatcccaaacctgaaaattcaaaatcctaaatgttccaatgagcatttcctttgagtgtcatgttaatgcttaaaaagttttggatttttaagcactctggattttgggttttgggatactcaacctgtaccatgtaatctatctgtataaaaaggtgtactatctaggttagtgtaagtacttacactctatataagagcgatgtttgcactatgataaaatcacctaatgatgcatttctcagaacttatgcccattgttaagtgatgcatgactgtgtttggaagtgtttttcttatttccaagtacttggagattttattgtatctttcttttactgatttctagtttgattccattgtactcagagaaaatattttatataacttgagttattttaaaattgttgaggtttgtttttcaaccccaggatgtagctcatctttgtgtatgttctgtgtatgctagaaaaataatgtctattttgctgttgttgacagattattctgtaaaagttgattagattctatagggttatgattttcttgcattctatatccttactgattttctctttagttgttctaataattgctgagagagaggtattgaagtctcctacaagaatcatggatttctttttcctcctttcagttctgtcatgttttatttaatgtattttgcagcctgtttggtgcattcacatttagggttgctatatcttcttggtagagtgaccattttattattatttggtgtccctctctatctcataatttcctttactgtgaaattttcattatctaacataatatagtgtcttctttctagtgattcatgtttgcacgatatatctttgtctattcttatactttaaagttagctatgttaatatattcaaagtgtatttcttatagacaagcgtatagttgggtcatggtttttaattcattctgtcagtctatatattttaattaatgtttacattagatataattattgatatattagggcttaggttctccattttattttttgttttttggttgttctatttgttattgctctgcttttttccccttgcctttctgtggtttaattgaacactttttagaattccattttgacttattattagttaattttagtgtatttctttgtatcactttttaaagaggttgctataggtattttattatatacaaacaacttactggaatctactgctgctacaaattaccagtttgaatgaaatgcagagacttttcctttctttacttccctttacttctctcatttataataaattttattgtttttccctatatatattatgaaccacatcagactatgttatttcagctttaaccatcaaatataatttagaagctccggcaacaaaagccaaaattgacaaatgggatctaattaaactaaagagcttctgcacagcaaaagaaactaccatcagagtgaacaggcaaactacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaaatcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggatgaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcacaccagcatggcacatgtatacctatgtaactaacctgcacaatgtgcacatgtaccctaaaacttagagtataataaaaaaaaaaaaaaaaaaaaaaaaaagaagctccaagaggagaaggaaaaaaatatataaatacacttagtatatacatagtacatttattatatttttactgtctcttttttcccatacttgatttttaaaagtttcttctattagatatttttctgtttagaaaactccataaagcaattttttattggtcttttaaagaaaaaatttttagttttcctttacctgataatgtcataatttcttcatacctgagggataattttgcttaatatagaattctaggttggtagtttttctttgtttttcattttatacacctgaatagcattctacttcctcctggtctctgtggtttctgatgagaaatctactgtcattggaaattttctcccatagttaaggtgttgttttttctcttgctgctttaaagattttttttttcttttcttccttgtttttatctcagataattggctgtgatttgtctgactgtttatttctctgggtttattccgtttagttttgctcagcttcttgcattttttagccattgtttattcaactgctttttcagtctcatcctcttttcctttcattccgttatcctgataatatgattgatagatctattggttttgtcccataggtttctgaagctctggtatttttttacttatattatttgttttttcagattggtgaataaatattattacatcctctaggccactggctcttatgtctgtccttgttattctggtgtttagcttatccacagaattttaaattttcttcattatattttaagtagtaaaatttgtaattggttctttttacttactttttctttgcttatactttatatttttatttgtttcatatgtgtctgtacttgttgaaaccttttcatgattacttcttttaaatatttgttagcaaattctaatatctatgtcatcttgctgctagtaactattgccttttttcattcaaattgaggtttttctatttcctattataataagtgatttttaaattaaaacctggacattccaggcattgttatgaggtttcagtttttatttaaaccccttttttaggtggttgtatttgacattggtctggcaggggaaggtcagatgttgtgttattaatgataggtgggaattgaagttcaggtgctccatttaaactcactgacatcttagatagggagagacaccttgtagctgctgggtggggtgggatttttggctctccactatgcctcctcttttacccctcttacaaggaagaataagagtacctccttactgctcctcaaatggattctactaacccaattctcattcagaaattgaaatattttatccatatagatgtagaaaatattatttctgttgttcaggagcatgaaaatagacttccatacctctgccagaaatcatggcttttgctcctgtggaacagaaagggaatgagtttagttaattatgattaaaatattttaaagtctctaaaggaggtatatacagatctgaattgtctaaaaatttttgtacctaagagtaatcatttttggtcatttatttgtactaataacattgttgatcatgtacagtttagctttacttcatggggacacaattagtgcctcagatggtatgaattttttttattttttatttttttattattatactttaagttttagggtacatgtgcacaacgtgcaggttagttacatatgtatacatgtgacatgctggtgtgctgcacccactaacgtgtcatctagcattaggtatatctcccagtgctatccctcccccctccccccaccccacaacagtccccagaatgtgatgttccccttcctgtgtccatgtgttctcattgttcaattcccacctatgagtgagaatatgcggtgtgtggttttttgttcttgtgatagtttactgagaatgatgctttccaatttcatccatgtccctacaaaggacatgaactcatcattttttatggctgcatagtattccatggtgtatatgtgccacattttcttaatccagtctatcattgatggacatttggattggttccaagtccttgctattgtgaatagtgccacaataagcatacatgtgcatgtgtctttatagcagcatgatttatagtcctttgggtatatacccagtaatgggatggctgggtcaaatggtatttctagttttagaaccctgaggaatcgccacactgacttccacaatggttgaactagtttacagtcccaccaacagtgtaaaagtgttcctatttctccacatcctctccagcacctgttgttccctgactttttaatgattgccattctaactggtgtgagatgatatctcattgcagttttgatttgcatttctctgatggccagtgatggtgagcattttttcatgtgttttttggctgcataaatgtcttcttttgagaagtgtatgttcatgtccttcgcccactttttgatggggttgtttttttcttgtaaatttgtttgagttcatcatagattctggatattagccctttgtcagatgagtaggttgcgaaaattttctcccatgttgtaggttgcctgttcactctgatggtagtttcctttgctgtgcagaagctctttagtttaattagatcccatttgtcaattttgtcttttattgccattgcttttggtgttttagacatgaagtccttgcccatgcctatgtcctgaatggtaatgcctaggttttcttctaggatctttatggttttaggtctaacatttaagtctttaattcatcttgaattaatttttgtataaggtgtaaggaagggatccagtttcagctttctacatatggctagcctgttttcccagcaccgtttattaaatagggaatactttccccattgcttgtttttctcgggtttgtcaaagatcagatagttgtagatatgcagcgttatttctgagggctctgttctattggtctatatctctgttttggtaccagtaccatgctgttttggttactgtagccttgtagtatagtttgaagtcaggtagcatgatgcctccagctttgttcttttggcttaggactgacttggcaatgcgggctctttcttggttccatatgaactttaaagtagtgttttccaattctgtgatgaaagtcattggtagcttgatggggatggcattgaatctataaattaccttgggcagtatggccattttcacgatattgattcttcctacccatgagcatggaatgttcttccatttgtttgtatcctctttaagttcattgagcagtggtttgtagttctccttgaagaggtccttcacgtcccttgtaagttggattcctaggtattttattctctttgaagcaattgggaatgggagttcattcatgatttggctctctgtttgtctgttattggtgtataagaatgcttgtgatttttgtacattgattttgcatcctgagactttgctgaagttgcttatcagcttaaggagattttgggctgagacagtggggttttctagatacacaatcatgtcatctgcaaacagggacaatttgactttctcttttcctaattgaataccctttatttccttctcctgtctaattgccctggccagaacttccaacaccatgttgaataggagtggtgagagagggcatccctgtcttgtgccagttttcaaagggaatgcttccagtatttgcccattcagtatgatattggctgtgggtttgtcatagatagctgttattgttttgagatatgtcccatcaatacctaatttattgagagtttttagcatgaagagttgttgaattttgtcaaaggccttttctgcagctattgagataatcatgtggtttttgcctttggttctgtttatatgctggattacatttattgatttgcatatatcgaaccagccttgcatcccagggatgaagcccatttgatcatggtggagaagctttttaatgtgctgctggattcggtttgccagtattttattgaggatttttgcatcaatgttcatcaaggacattggtctaaaattctcttttttggttttgtctctgcccggctttggtatcaggatgatgctggcctcataaaatgagttagggaggattccctctttttctattgattggaatagtttcagaaggaatggtaccagttcctccttgtacctctgatagaattcggctgtgaatccatctggtcctggactctttttggttggtaagctattgattattgccacaatttcagctcctgttattggtctattcagagattcaacttcttcctggtttagtcttgggagggtatatgtgtcgaggaatttatccatttcttctagattttctagtttatttgcgtagagctgtttgtagtattcgctgatggtagtttatatttctgtgggatcagtggtgatatcccctttatcattttttcttgcttctatttgattcttctctctttttttctttattagtcttgctagccgtctatcaattttgttgatcctttcaaaaaaccagctcctggattcattaatttttgaagggttttttgtgtctctatttccttaagttctgttctgattttagttatttcttgccttctgctagcttttgaatgtgtttgctctttcttttctagttcttttaattgtgatgttagggtgtcaattttggatctttcctgctttctcttgtgggcatttagtgctatacatttccctctacacactgctttaaatgtgtcccggagattctggtacgttgtgtctttgttctcgttggtttcaaagaacatctttatttctgccttcattttgttatgtgcccagtagtcattcaggagcaggttgttcaattttcatgtagttgagcggttttgagtgagtgtcttaatcctgagttctagtttgattgcactgtggtctgagagacagtttgttataatttctgttcttttacatttgctgaggagagctttacttccaactatgtggtcaattttggaataggtgtgatgtggtgctgaaaaaaatgtatattctgttgatttggggtggagagttctgtagatgtctattaggtccgcttggtgcagagctgagtccaattcctgggtatccttgtcgactttctgtctcgttgatctgtctaatgttgacagtggggtgttaaagtctcccattattattgtgtgggagtctaagtctctttataggtcactcaggacttgctttatgagtctgggtgctcctgtattgggtgcatatatatttaggatagttagctcttcttgttgaattagtccctttaccattatgtaatggccttctttgtcccttttgatctttgttggtttaaagtctgttttatcagagactaggattgcaacccctgcctttttttgttttccatttgcttggtagatcttcctccatccttttattttgagcctatgtgtgtctctgcacgtgagatggttttcctgaatacaacacactgatgggtcttgactccttatccaatttgccagtctgtgtcttttaattggagcatgtagtccatttacattgaaagttaatattgttatgtgtgaatttgaacctttcattatgatgttaggtggttattttgctcgttagttgatgcagtttcttcctagtctcgatggtctttacattttggcatgattttgcagcggctggtactggttgttcctctccatgtttagtgcttccttcaggagctcttttagggcaggcctggtggtgacaaaatctctcagcatttgcttgtctgtaaagcatatctgtaaagcattgtctgtaaagcctcacttatgaagcttagtttggctggatatgaaattctgggttgaaaattcttttctttaagaatgttgaatattggcccccagtgtcttctggcttgtagagtttctgccgagagatccgctgttagtctgacgagcttccctttgtgggtaacccgacctctctctctggctgccttaacattttttccttcatttcaactttggtgaatctgacacttatgtgtcttggagttgctcttctcgaggagtatctttgtggcattctctgtatttcctgaatttgaatgttggcctgtccttctaggttggggaagttctcttggataataacctgcagagtgttttccaacgtggttccatgctccccgtcactttcagttacaccaatcagatgtggatttgatctttaaacatagtcccatatttcttggaggctttgttcatttctttttactcttttttctctaaccttctcttctcgcttcatttcattcatttggtcttcaatcactgataacctttcttccagctgatcgaatcggctactgaagcttgtgcattcatcatatagttctcatgccatggtttttagctccatcaggtcatttaaggacttctgtacattggttattctagttagccattcgtctattcttttttcaaggtttttaacttctttgcgatgggttcgaacttcctcctttagctcggagaagtttgatcgtctgaagccttcttctctcaactcgtcaaagtcattctccatccagctttgttctgttgctggtgaggaactgtgttcctttggagggggagaggcactgtgatttttagaatatttagcttttcccctctgttttttccccatctttgtgattttatctacctttggtcttcaatgatggtgacgtacagatggggttttggtgtggttgtcctttctttttgttagtgtctgtcaccgcttctctgggctaggaagtgcaattccctgaccccttgtgcttcctgggtgaggcgatgcctcaccttgcttcggctcttgcttggtgggctgtacccactatcctgccccccactgtctgacaatccccagtgagatgaacccggtacctcagttggaagtgcagaaatcacccatcttctgcatcactcatgctgggagttgtggactggagctgttcatatttggctatcttggaaccacctcctcctctaacctttcttcacgcttcttagcttgcttgcattgggttagaatatgctcctttagcctggaggagtttgttgttacccactttctgaagcctacttttgtcagttaatcaaactcattctccatctagttttattctgttgctggcgagacactgtgattctttcgtggagaagaggtgttctggtttttggaattttcagccactttgcactggtttctccccatcttcatggatttatctacttttggtccttgattttggttaccttctgatggggtctttgagtggatgtgctattcgtttctgtttgttagtttttcttccaacagtcaggcccctctgctgcaggttggctggagtttgctggaggtccactacagacgctatttgcctgggtataaccaggggcggctgcataacagcgaaagaaaaaaaaaagcctgttttttcctctggaatctttgtcccagaggggaacctaccagttgccagccagagctctcctgtatgaggtttctgtcagcccctactgggaggtgtctcccattcaggaggtatggaggtcagggatccacttgagcaggcagtctgatggttagtatagctcaaacactctgctgggagtccactgctctcttcagagctgtcaggcagggatgtttaagtctgctgaagttgtgcccacagcagccccttccccgaggtgctctgtcccagggacatgggggttttgtctatatgtcccttatgggggctgctgcctttttttcagagatgccctgcccggagaggagaaatgtggcagtctggccacagcagccttgctcagctctgcccagttcaaacttcctggctgctttgtttactctgtgagcttaaaactggctactcaagctgcaccagtggtggatgcccctccccacaccaagctcaattgtcccaggttgatctctgactgctgttgtgttggcagtgagaatttcaagccagtgggggtgggacccaccgagccagaccacttggctccctgacttcagcacccctttccaggggagtgaacggttctgtcttgctggcattccaggagccactggggtatggaaagaaaaacacctgcagctagttcagtgttttccctaatggccacccagttttgtgctcgaaacccagggccctggtggggtaggcaccatagggaacctcctggtctgcggggttgcaaagaccatgggacaaatgcagtatctgggctggagtgtgcacccttcctcaggctcagtccctcatggcttcccttggttaggggagaaaatttcccgacttcttgcacttcctgggtgaggcgatgccccaccctgcttcagatcaccctccgtgagctgcacccaccatccaaccattcccagtgagatgaaccgggtacctcagttggaaatgcagaaatcacccaccttctgtgtcgatctcgctgggaactgcagaccagagctgttcctattcggccattttgccagctatccccttgtttgccagtattttttaagcttgttgcatatcaaatggaactaattgaaatgtgatctaatacaatggatgccattactgaatatattatacttaagattacatttaattttgtaatcttggttatagaggggttatactgttggtttacgttgaacgtaaagccaagcaatactcccatttttttttctattttaaccattgttaaacagtttttcaatcatatactttagcagttgatgttttttaaatgaaaatgcagaattttctatgtatccctattagtataattttctgttcaacctacggtactgatatcaagaaatgtggaaagcacattatattatctaatatcttgatatgttttttagagttggtttgaaaattggtggagattgtttgatgactgccctttttcagtagaaggggatatgtattttggctcacagtactgcaggctgtacaggaagtgggatgtcagcatctgcttctggtgagcacctctgaaagcttacaatcatggtggaaggagaaggaggagcagagtatcatgtggttagacagggagcaagagagagaggcaggaggtgccaggttcttttaaacaactaggtctcatatgaacttacagggtaagaactccctcattatcgtgaagacagtaccatgccatggtggtgctgtcctcatgataatgagtgagttctgactctataagattagtcatcaaggcagagagatctgcctccatgacccaaacactatacccatttccaacatcagacatcacatttcaacatgagatttggaggggacacacactcaaaccgtattatgaggccagagaaatgaagtggctcagctgtggaatggaatgctaaagttcaagttttgtcgggaatacctttgtagggttggcctggcctgctccacttgcatctgcaaggatgatgggtcctcctgatgtggccaggttcaaaagaccactctggccattgttccctacaaggaatccagtttataattggcatgtctgtagggagcatccactttactcccttcaaaagcctccaaggaagttattgtgaatttttttttccagaaagaaaataattttctccatttcaggcacattatcatggtccccagcatcctcccacctcacagatcctgcaattctggtgcattctggactccaaataaccctgtatatatagagagagatagagattgcctctatctatatacattcgtaagcttccccaaaatgatcttggtatcaataaagggagaattcaggtacatttcaccatcagcctcacagcatggcagccattgatttgtcctgtggcttccttaccagggaaccaatctgcctttatgagaaaaagacaaagatataatagaaaggttggtgggtgactgtctgccaaattggtatcagggttcagtgaacttttatgatatgactatggagttcacccagaggagtgaactttactggacatgattcagagatacctctgcagatacatgatactggagaactgcaagcacctgggctcagtaagatttcagctctttatacacagcctgatctcttggttacaataaaaagagttgaagacagttcagagtggagttcttcaagaagctacaatagaggggaactctgtgattgtaagaattgtagagaaaacttcagtgaacacttatgcccaagaatgaatcaggaagaaattgaaaccctgaacagaccaatatcaatcaatatgacacacatgagagctcagaatagagggaacacttctgagtgtaactggtgtagaaaagacatccatactctgcagaagaaaacctctattggacaggagcttccttagtttaattagtttgcaaaagtcttcaccctgactccaagccttgctgtgcatctgcaagaaaaccctgcaaatttaaggaatgtggaaaagctttcaagtatttgcagtccttaaaaatgccccacttaaaaggcatagagtggcaaggtagatgaaaaaagcaagactcatctctctgctgtcttcaagagacccattgcacacctaacaggacccacaggctcaaaggaaagggttggagaaatatctgtcacacaaatcgaaaacaaaaaagtagttcctattctcatatcagataaaacagactttaaaccaacaaccgtataaaaggataaagaaggacattacataatgataaaggggttaatttgacatgaaaatttaactatcccaaatatatatgcacccaaattggagcacccagatttataaaacaagtacccctagacctataaaaagacttagacagctacacaataagagtgaggtctttaaaaccccattggcagcgttagacagatgcttgaggcagaaaacttaacaatgaaattctggattaaatttaacacttgacctaattgaaactaatatatgtctacataatactccacccatcaactataggatactcactcttgtcttctgcacacagaacatactccaaacttgaccacatcctggtccataaaacaagtctcaataaactcaaacaaactgaaatcatatcaaacatactctcagaaaacagtggaataaaaataatcaataccaagatcttttattaccacacaattacatgaaaatcttaaaaacttgctcccgattgacttttggtaaacaatgaaattaaggcagaaataaaagaaattatttgacataaatgaaaacagagacatgacttactaaaatctctgggatgcaacaaaagcaatgttaagaggaaagtttatagtactaaatgcctgtctcaaaaagtcataaagatctcaaattaatgatctaacatcaaatctagaggaagtggaaaaacgagaacaaactaatcctaaagctagcatcggaaaagaaagaactaaaatcagtgcagaactaaatgaaattaagaccccaaaatccacacaatatatcgacaaaaaaaaaaagttggttctttgaaagaataaatattggtagaacactagctagattaacaaagaaaaaaaagaggaaagatccaaataagcaatcagaagcaacaaaggtgacattataactgatcccacaaaaacataaaatatcctccaagactgctatgaacacctctatgcacacaaactacgttatctagaggaaacggataaatccctggaagcacagcctcccaagaatgaatcaggaagaaattgaaaccctgaacagaccaatatcaagttccaaaattaaatcagtagtgaaaaatctgccaaacaaaaaaaaagctccagacaagatggagtcacagtcaaattccaccagacatacaaagaaagctggttccagttcttctgatattattccaaaattcagggaagagggacctcctttattactcattttatgaagccagtatcacactgataccaaaacctggcaaagacacaatgaaaaaaggacaatacaggccaatatccccaatgaacgtagatgcaaaaatcctcagcagaatactaagaaaaagaatccaacaacacaacaaaaagttaattcaccatgatcaattaggcttcattcctgggatgcaaagttgattcaacatatgcaaatcaataaatcacaacataaaaagatttaaaaaccatatgatcatctcaatttacacagaaaatgctgttgataaaatctaacatctcttcataataagaaacatcaacaaactaggcaacgaaggaatatataccatagaatggtaagagctatttatgataaacacatagccaatatcatactgaacaggcaaaagctgaaagcattccccttgagaactggaacgagacaaggatgctcactctcaacattcttattcaacatagtactggaagtcctacccagagcaatcaggcaaaagaaagaaataaaaggcatccaactaggaaaagaagaagaaaaactatgtctttttgctgatgatataattctatacctagaaaaccctaaagactccactgaaaagctcgtggaactgatgagttcagtaaagtttccggatacaaagtcagtagcatttctatctaccaataatgttcaagctgcaaaccaaacaaagaaaacaatcccatatacaatagtcacaagcaaaaaatacctaggaatacatctaacccaagatatgaaatatctctttaaggagaagcacaaaacacagctgaaagaaatcataggtgacacaaaaaaatggaaaaatatttcatgcttatggattggaagaacaatattgttaaaatggccatacttcccaaagcaatgtaaagattcaatgctatacttatcaaactaccagagtcattctttacagaattagaaaaaaactattataaattcatgtggaaccaaaatagagcccaaatagccaaatcagtcctaagcaaaaagaacaaagccagacacattacattacctgattcaaactatactactgtaagtgtacagtaaccaaaagagcatcatacaggtatacaaagagagatagaccaatggaacagaatagagaacccagaaataaagccacacacctacagccatctgatctttgacaaagtcaacaaaaataaccaatgggaaaagtactccctattcaataaatggtgctgtgatacttggctacccatatgcagaaaaatgaactagacctctaccatacacaaaaattaactcaagagggtttaaagctctaaatatcagacctcaaactataagaatcctagaaatcttgtgaaatatcattctggacattggccttgggaaagaatttatgactaggtcttcaaaagcaattacagcaaaatcaaaaattgacaagtgggacctaattaaactaaggaacttctgcacagcaagataaactgtcaccagaagaaacagatatactacagaatggtagaacatgtttacaaactatgcatcaaacaaaggtcaaatatccaggatctataaggtacttagataattcaacaagcaagaaacacataaccccattaaaaattgggcaaaagaccttaacagacacttctcaaaagaagacatacaagtgttcaacaaaaatgaaaaaataccccacataactaatcatcagagaaatgcaaatcaaaaaccacaatgagatattatctcctacccatcagaatggctattattaaaaagtctaaaaaccacaaatgctggcaaagctgtggagaaaaaggaatgtttgtacacctttggtgggaatgttactagttcacctactgtggaaagcagtttggagatttcacaaacaaaactgagctaccatttgacccagaaatcccattactgggtatatatccatagaaaaataaattgttctaccaaaatgtcacatgtatgttcattgcagcactattcacaatatcaaagacatggaatcaacccaggtgccccttgacagtggattggaggaagaaaattggtgcatatacactacagagtattatgcagccataaagaaaatgaagtcatgttctttgcagctatttggatgcagctggaggccattatcttaagaaaatttacacaggaacagaaaaccaaacaacacatgttctcaagtatacatcggagctaaacattggatgtacttggataaaagatggcaaaaatagacactagagactactagggggcaagagttaatgaattgactgttgggtactgtgcttacctcagcatcactcaatatacccatgcagcacacctatacatgtacctcctgaatctataataaaagttgaaattatttttaaaaaccacaaaataaacatatatgaatatataaaaagataagacagtatagagaatataaagcttagtacatatgacataaaatgcttgcattacaaatgacttctgttggttaagagaaaagttagagaaaattagatgattaggtgattattttaagaacagataaagaaaattaagtaacagtcttcaaaacaaagttcttagtgttttgccacttaagttttagtgaagaaatatgtttgggtatttactgcagacagggtattacgtaagtgaacgaaaataataaatatttatcattcagttctgtcaaattatttttaattatgaatttctgaaggactatgagtgtgtcagatgatatgtgtctgtagcatctacatgctggtacatagtatctgtgaagtgtttattacaatagtaaatcttctatatgtcaatcatcatatgaatttatgactgctcatgaaatcttttgaccatatatttttcttgcctgatccaggcaagataataaaaatgttataattttaacttatatggtaggtaacaaataatatcctgacaaaagaatcaagaaataatagaatacaaacaagtagaaacacatctcatgctcatggatgggtagaatcaatattgtgaaaatgaccacactgccaaaaataatctacagattcaatgcaattcccattaaaataccatcatcattcttcacagaactagaaaaaacaatcctaaaattaatgtgaaaccaaaaaagagcctgcataaccaaagcaagactaagcaaaaagaacaaatctggaggcatcacatgacccgacttcaaactatactacaaaactatagttaacaaaacagcattgtactgatataaaaataggcatgtagggaaatggaactaaatagggaacccaaaaataaagccaaacacttacagccaactgatctttgacaaaccaaacaaaaacataaagtgggaaagaacacccaattcaacaagtggtgctggtataattgacaagtcacatatagagaatgaaagtggatcctcatctctcaccttatacaaaaatcaactcaagatggatcaaagacttaaatctaacacctgaaaccacaaaaatcctagaagatatcattggaaaaactcttctagacattggtgtaggcaaagagctcatgaccaagatgcgacaaaaagaaagataaatagatgggacttagttaaactaaaaagcttctgcacagcaaaagaaaaaatcagcagagtaaacaggcaacccacagagtgggagaaaatcttggcaacctatgcatctgacaacggactatatccagaatttacaataaactcaaacaaatcagcaagaaaaaaaataaaaacaaataatcccatcaaaaagtgggctaaggacatgaatagacagttctcaaaagatgtacaagtggactgggcacagtggctcatgcctataatcacagcactttaggaagccgaggtgggtgtatcacgaggtcaagagatggagaccatcctggccaacatggtgaaagcccatctctactaaaaatacaaaaattagctgggtgtggtggcgtgctcctgtagttccagctacttgggaggctgaggcaggagaatcgcttgaacctgggaggcagaggttgcagtgagccgagatcacgccgctgcactccagcctggcaacagagtgagactctgtctcaaaataaataaataaataaataaataaaaagatgtacaagtggccaagaaacatgaaaaaatgatcaacatcactaattatcagggaaatgcaaatcaaaaccacaatgtgatgccaccttactcctgcaataatggccacaattaaaaaataaaaagaataggcgttggcgtggatgtggtgaaaaggaaacacttctacactgttggtgggaatgtaaactactacaaccactctggtaaacagtatggagattccttaaataacttttgatttaaaaaaaagctgttagaatagataaatatagtgaaaaggtacaaactaagtatggacacatgaaactcaatagaacctgtgcagttagaaccatattcatattttgaggttattttatttctgtaaaaaaaattcaacgtcacattaattaatattgatttaaattctggttgtagttttttgtaattaatttggaatttttgttttatgtgtgtaaagagccataagtgtgaaaaatttatattttattttgtttttatacctaagtaaaatttctaagagtaagtcaaaagtaaagaatataaacaaattcaaaggtctgcccatttttcaaagtgagaaaaatttatttattttgtgttttgatcattaatggcccaattgaaacacaactctctacattagcttttcttgatttttcttactgtaattaatctcttccttctttggagtctatagaaattattacattttagttttatttttcttacttgtctgcttgttttgtctctcctgttagatagtatgatttgaagaaaaacggatgtgtgtgtataatctgggacaatacatttttaaaaatttaatttaaagttctgggatacatgtgaaggacatccaggtttgttaacatatgtaaacatgtgtcatggtggtttgctgcacctaacaaacccatcacatcggtattgagccctacatgcattagctatttattatgacactttccctccctcccaacctccgccaacaggccccagtgtgtgttgttccccatgtattctcattgttcagctcctacttaataagtgagaacatgcggtgtttggttttctgttcctgtgttagtttgctgaggataatggctttgagctccatccttgtccctgcaaagatcatgatctcattcttttttggctgcatagtattccatggtgtatatgtatcatattttctttatccagactatcattgatgggcatttgggttgattccatgtctttggtataatgaatagtgctgtaatgaacatatgcatgtatatatcttcatgatagaatgatttatattcctctgggtatatacccagtaatgggattgctgggtcaaatagtatttctggttgtaggtctttgaggaattgtcacactgtcttccacaatggttgaactaatttacattcccaccaacagtataaaagcattcttatttctccacagcctcgccagcatctgttgtttcttgactttttaatgatcaccattctgactgaagtgagatggtattacattgtggttttgatttgcatttctgtaatgatcagtgatattgaactttttttcatgttttttggacgcatggatgttatctttggagaagtttctgttcatgtctttgcccactttttaatggattctttgttttttttttcttgtaaatttgtttaaattccttgtagattctggatgttagacctttgtcagatggatagattgcaaaaattttctcccattagtttcttttgctgggcagaagctctttagcttaattagatcccgtttgttaatttttgcttttgttgcaattgcttttgatgttttcatcatgaaatctttgcccgtgcctatgtcctgaatggtattgcctagattttcttccagagtttttatagtttggggttttacatttaagtctttaatccatcttgagttaatttttttataagttttaaggaagggatccagtttcaattttctgaatgtggcttgccagttctcccagtgccatatattaaatagggaatcctttccccattgcttctttttgtcaggtttgtcaaagttcagatggttgtagatgtgtggtcttatttctgagatctatattctgttccattggtgtgtctgttttggtaccagtaccgtgctgttttggttactatagccttgtggtatagcttgaagttgggtatcatggtgcctgcagctttcttctttttgcttagaattttcttggttatatgggctcttttttggctccatatgaattttaaagtagttttttctaattctgtgaagaatgttagtggtattttaatggaaatagcattgaatctttaaattactttaggcagtatggccattttcacaatattgatgcttcctgcccatgggcatggaatgttttttccatttgcttatgtcctctctgatttccttgagcagtggtttgtagttctccttgaagagctccttgacatccattgttagctgtattcctagttattttattctctttgtagcaattgtgaatgggagttcattcatgatttggctctctgcttgtctgttgttggtatataggaatggttgtgattttgcacattgattttgtatgctgagactttgctgaagttgcttatcagcttaagaagcttttaggctgaagcgataggattttctatatgtacgattatgttatctacaaacagagacagtttgacttcctctcttcctatttcaatacgctttatttctttctcttgcctgacttccctggccagaactcccaatactatgttgaataggagtggtgagagagggcatccttgtcttgtgctggttttcaagggaaatgcttccagcttttgctcattcagtatgatattggctgtgggtttgttctaaatggctcttattattttgagttatgttccatcaatacccagtttattgagagtttttaacatgaagagatgttgaattttataaaaggccttttctacatctattaagataatcctgtggttttttgtctttagttttgtttacatgatgaattacatttattgatttgaatatgttgttaccagccttgcatcccggggatgaagccagcttgatcgtggtagataaactttttgatgtgctgttggacttggtttgccagtattttattgagggtttttgcattgatgttcatcaggatattggcctgaagtttcttttttagttgtatctctgccaggttttggtatcaggatgatgctggcctcataaaatgattgatgcactagtccttccttttaatttgtttgaagtagtttcagaataaatggtaccagctccgctttgtacctctggtagaattcagctataaatcagtctggtcctgggctttttttggttggtaggctatttactactgcctcagtttcagaactcattatttgtctattcaggggtttaacttcttcctggttcagtcttgggaggctgtatgtgttcaggaatttatccatttcctctggattttctaatttatttgcatagtatgcaaataaattagtgcaaataaactaatttatttgtttatagtattctctgatagttgtttgcatttctgtggggtcagtggtgatatcccctttatcattttttattgtatcaatttgattcttccgtctttattagtctaggtagcggtctatttcattattctttcaaaaaaccagctcctggatttgttgacttttttgaagggtttttcatgtctctatcgccttcagttctgctctgatcttggttatttcttgttttctgctatctttggggtttgtttgctcttggttctctagtcgtgatattatggtgccgatttgagatctttctagcttttcgatgtgggcatttagttctataaatttccctcttaacactgctttttctgtgtcccagagattctagtgtattgtttatttgttctcattggtttcacagaacttcttgatttctgccttaatttcattacccaggagtcattcaggagcatgtcgttgcatttccagttagttgtatgggtttgactgtgtttcttaatcttgagttctaatttgattgctctatggtctgagagactgttatgattttagttcttttgtatttgctgaggaacgttttacttccaattaaatgattgattttagagtaagtcccatgtggtgctgaaaataatgtatattctgctgtttttggatagagagttctgtagatacccagaccaacttaagccagagctgagtttgagtcctgaagattcttatcaactttctgtgtcaatgatctaatattgacagtgaaatattaaagtttcctattattattgtgggagtctaaatctttttgtaggtttctaagaacttgttttataaatttcgttgctcttgaagtgaggcatagaaatttaggatagttagctcttcttgttgaattgaactttttaccattatgtaatgcccttctttgtcttttttgatctttgttggtttaaagtctgtcttgtcagaaactaggattgcaacccctgcttttttctgctttttatttgctggtagattttccctcatccttttattttgagcctatgtgtgtccctgcatgtgagaagggtcgcttgaatatagcacaccaatgggtcttgactctttaccagcttgccattctgtgtcttttaattggggcatttagctcatttacatttaaggttaatattgttatgtgtgaatttgatccagtcatcatgatgccaactggttattttgcagacttgttgatgtagttgccttatagagtcattggtctttgtacttcagtgtggttttgtagtagctggtaacagttttttgtttgtttgtttgcttgtttgttttcatatttagtgcttcctttgggagctcttgcaagatgggcctggtggtgacaaattctctcagcatttgcttgtctgaaaaggattttatttctccttcacttatgaagcttcatttggccatatatgaaattctgggttgagtattctttgctttaaaattgttaaatattggcccctgatcttttttggcttgtagggtttctgctgagaggtctgctgttagtctgatggacttgcctttgtaggttacctggcctttctctctggctgcccttaatattttgtctttcatttcgaccttacagaatctgatattatgtgccttgggggttgatcttcttatggaatatcttactggggttctctggatttcctgaatttgaatgtgggcctctcttgctaggttagggaagttcttgtggatgatatcttgaagtacgttttccaacttggccctgttctccctgtctctttcaggtacttcaaccagtcagaagtttggtctttttacataaccccataggtcctggaggttttattcattccttttcattcctttttcttttttttcctaatcttatctgcctgtcttgtttcatcaagatagtcttcaagctctgaaattctttcctccgcttggtctattcggctatcaataattgtgggtgcattgtgaagttctcatgttgtgtttttcagctccatcaggtcatttatgttcctctctaaactggttattctggttaacagctcctgtaatgttttatcatggttattagcttctttgcattgggttagaacatgctcctttagctcagtgaagttcattattacccaccttctgaagcctacttctgtcaattcattcatttcagccctgcccagttctgtgcccttgccagagaggtgttgcaataatttggaggaggagaagcactctgctttttgagtgttcagtgttttttcattgattctttctcatctttatgagtttatctagctttggtcttcgaggctgctgacctttggatggggtttttgaggggacttttttgttaatgttgttgctgctttctatttgttattcttttaacggtcaggcccctcttctggtttgttgggggtccactccagaccctatttgcctgggtccctcccacacctgaaggtgtcaccagtggaggctgcagaacagcaaggatgactgcctgctactttctctgggagctccatcccagaggggcaccaaccttattccagcaggaatggtcctaaataaggtgtctggtgacccttgttggggggtttcacccagtcaagaggcatgggatcaggaatccacttaacgaagcactctggctgggctttggcagagggggtgcactgtggtgggaggaatcccactcatctgcacttcccaggttctgcagagccatcgggggaaagactaagtccactgatccatggagagagaccatggctgcccctcctgcaaggggctctatcccagggagatcagagttctgtctgtaaatccctagctggagtttctgaaattcctgcagagaggcccccatccagtgaggaggaatgggtcagggtccagcttaaagaggcagtatggccatgatccaccacagccgctgtgctacactgtggagaattcctcctgagtccaaaccgctcagtctccctcgcaccagcagggaaaaagtggcagaatggagctgcatttatggctgccacccctccccccaggactcagtcatcttaggcaacaggcagctgcaatgatggcagctgcccctcccctcaggaacttggtaatcttagtctctagctgagcgaccgccaagaatctgcacagctctgttcttgggacccaaggccctggtcacataggctcacaaaggggatcttctgatttgcaggttgcacagattcgtggaaaaagcatggttttcctggtggtaggtagcacactcaccaccttgcttggctgggagtgggagttccccttgttacttgcagctcccaggtgggccgttgctccactctgcttttgctggctctctgtgggttgtgccaactgcctattcagtcccaatgagagaatttggatacctcagttgccggtgcgggattcacttgcagttttcgttcttctctcgccgttttcattcttctcggtgggagccttcgaccgcagctatttccagtcaatcatcttggtccctcccggcaacaatactttttttataaagagttattcggtgaagattgaataaatggatgaatggatggaaagctaaggatatcttcgattatttaatgatagttaatattgatataggaataagattatttttccaaggcttacatgcagtagaaaaaatccttcatctatcaggtagtggtggtagaaataagttacaaatgaaagtgtaattataaaatacaataaattaagttgtataaaggtattgactaatcatatattagagctagcaaatatacagcagaagtgttagtatatcttttcctttatctatggcaatcattctaagtaatcctgttactctttttgggggggttcagttaaaacctgaaaatctttatctagttgttgtaaccactactcatcagttggacattgaatataaggtgaaacctgtctgatataaaggctctagtttctatttaataaggatgaggaaaaaagtagttactagttcaaggaatagttctagttctgtctcattactgaaacctggtagttcttacacttttcttcttaaccctggaagtgactatgtaatattgaggtttgctttttttctacttgaacccctatatttatgtcttctttaatgggattagtgttttttccactgtccctgtaattcagaaaggatgatcttagtcctctttaaagtaagtttcctctttctacctaagattgaattgaaaattgattcttcattgccttgaaacatgaccatcaagttatttcctgtgcaacattattaaatatctcttggcaacagcaattctagattttaggttttaatcaaaattttccaacatcatataggctacacaattactattgtcaatagtaattgcttatgtaatagcagagcttttaattttttgaatgtagtgtgcagggtactttgaataatatatgaagtttggttcaaagaaacagactgttgaaaacttcagtgaaccagactgagaatataaattggacacactggatgttcacttttattcttttttctttttcttttttttttttttttttgtgacacagagtcttgctctgtcaccaggctggagtgcagtggcacagtctcggctcatggtaaccctatctcctgggttcaagtgattctcctgcctcagcctcccaagtaggtgggactatgggcacccaccaccacgcccggctaattttttgtatttttagtagagtcggggtttcaccatgttggccaggatggtcttgatctcttgacctcatgatccacctgcctcggcctctcaaagtgcttggattacaggcatgagccaccgcgcctggcctttttattcttatataaagaagtacaagacaatatcatattggaaatatgtcattcacattttttttgaaaaatttattggtctgtctgacaagagataactatgaacttatcctccttctcttttgtggagtaactaaaaagcatgattaggccaaactagaaggagtgataatgttgtgaatagaggactctggtaaattcccatatttaatatgtaggagtcatgattgctctggctatggaacaggtcctagagctagtcagagagcccattgtgaagatgaaaacagaacaataaaatgaagggaaaaatacagtgaagctctgactttataagttttctttttactgcttatatgtcaaacatctgaataaaaactaaataatttatcatctcatgtagacatagctaccacttctctgtgaactctgaaatttatgttttgaagcaaatatgacctttatgtatttgaagtaaatattaagtttacgaaatataatatgaaattcatgtatttgaagcaaatatgatcttaaaaatagaaaaaaatgtagcttagtgaaagatgttaattttgtaaccaaacaggaaaggattagaatcccggttttgctgcttattagcggtcttaggcaagtaaacaaaaaaattcagccacagtttcatttttgtaaaacagaaatacatatctgtcttgctgttttcagaattagaaataatgtaaattaatgcccatataggcacttattaatagtgcttattaacattattgtttttaacgctataatattatttatcctatactctcaatgaataactacatgctatacttgagtatatagtacattttattatttatatagctatcactacataatacatgtaaggaaaatataatgctgaccaaatgtaaaatttagatattttaattataattttctttctttcagaattacttactgtcatctacctttccagagtaaatggctttatgttggaacagaaagaggaaatacacatattgtaaatattgaatctttcattctttctggatatgttatcatgtggaacaaggcaattgaactgtaagtttgaacttggatatcactttattggcttaaatacttcatacagttatgtaacatgtaggtcaaattacagttatttgatacgtctattactaatttataatgaatttgagtgaaaagttcagtaaaataacttaaagccataaaagcttttaaaaatagatattacaatattttaggctttccaaataccataaataattaagctttatatctaaaaatgtgatgacaaaatagtaaggcttattctaaaagttatacatggaaatctcacttcattataatcaagcttagtatagcaactttcagtgagaatgaattgtgttatgtaaaaataatcatgatcactgcatatgattttaatgcttgtagcttgttcttttcttgcctcattaaaatattgttcagggctcaaatatcttttaggttacgttatacataggttttttgggtgtatgattgatggcaattaccactttggctttggcactgatatttaagtttctgtacatgtgaaatgtgaaattctccaaatatcaaactctgtggaatttcaagccatctgtattcagccattttgcattgctataaaggaatccctgagacaaggtaatttatatagaaaagaggtttaattggcttatggttctacaggctttacaggaagcatggtgctggcatctgcttagcttccagggaggcctcaggaagcttacaatcatggtagaagttaggagcaggcatgtcatataatgaaagcaggagcaagaggaggagttagggggaggtgccacacactttcaaacaacaagatctcacgagaattcattcactactgcaagaactcacttactatggcaagaactcactattacaagaagagccctaaggggatggtgctaaaccattcaagagaaatccacttcccatgatccaaatacctcccactaggccccaccttgaacatttagggattacaattcaacatgagctttgggcagggacaaatatccaaactatatcaccatctatttgtagtacatacgtaagcaattcttctagtaaaattattaatcagaaaaacaacttttatttaacacgtttatgctctctacatattaggtccttgataagatgtttgacttgaagttgactcattttctgcctcatatatagtctaagttacaaaattattctgcaaaattctgattaaaacaccctatttttgtgaagcttgacgctggaaataaatattttacctaatcttaatgtttcaatatgcatgtatattgcttcataaggaaggttgttactagttatactcttgtcatgatactccttttgtattatgtctgaatgggtcttttattaatgataattctttctccctcattagattaggaactgctccagagcaggatttttgtttattgttcttttcttgttcttcatacttggcttatttctgtgctttccaaagtaaatactaaatgattgatgacattattgaagcattagtatgataaattgttacatatacactgctattgacttacaactttcatttatgttttcaagataattggtgtgagctattttgctcattttgttgttctgtgtgaatatttctaaaaacattaatcctataaataattatgtttccccccaaagttactttattaggtatttgggagggtccttttcccctgtaatcctagtcctataaaagcaataaaagggctgaattttaatagttttacataatattgtttcaggatattgataaaaacatacaggcttagatgaacaagagaagattcagttataaaacttttaaataaattcaatattagtgaaaatatatagatgcatcacttgtgttcaggttgaatgctgctaaagtaattgagaagaatttgttatcttaagcaaattaaacatttcaccactcttgcaatgctgttcttatattcatttatgtaacaaatccttttcatggttcagattactacgtgaactagtgacttatactttattttaatgtgtttatatagtctatacaatttcaagactaatgaagagtttttaaaatgtatattataagggaggctaaaatcaggagaaattaaagagctaaaataaggcatttttatttttcataatatacacatgattcagcattagaatagcatctactattttatatataaacctgtgttttatcgagttgtacatgcctctgaaaatgttcttgaaatatctctgagaaattattagtaaaccacataccatcacttcctgaatgtctcttgattcatttagaccggatttccaaaaatatgttccatagaattctaattccactgtgacagataacattttaaatgccaatttccaatctcctggaactgtcttttcattgctctctacctcttgagatacattagaaaatgtatgtaacttcctgttaatatgtgtcaagtgtatgggacagtaataaaatatgcatttaattaagaagactcatttaataaatataattttagtccatgaattttaataatatattttctaagtaggacaaatgcaagaattatctaaaaaaatatgagattgtttctattttaagtccttattgaaatacttttcatttaatgtttatttttcagcttgtttctatttttagtgaattattctaattgcaattagaggcaattcccaagagtatgaatagttgggtttccaaaatgtatatattggttatttggaacctgggacaaatttttcatttaaacagtgatatttgaagaataccttataaaataacagcatagaactaaactatcattaaaaaatatttatatgggaaaatatataccaggtgatagcatagaaacagctatttctgtagggcagccctaacattttaaaaaaatgtaagctttttttccacatatgattaaaatttgagcatgaaatttataatcaaatcataaaagtgtaagactcatgtttaacatcattcaagcatgtttactgagctctattatatgatagatactagaaacaactatgaacagagaagacataatctctgtcctcctgggacttccagtttaatggaggcaaagttaaataaaaaggcaattacaatatactggtaatataatatggcaattccataagaaggacatctattataatatagacatgggatctcaaagtggtatctgtgaagattgttacatctatgctgagatccaaggggtgagtttcagttagatgagtaaaataccagggacaagaacattccgggcagagggaacagaatatttaaaggatggaatataagataattttctgctctgtgcccagaaattttaagtactgcagtttatagtttgttggaatggctggtggataggatagcaagggataaagctggaaggtaatcaggttttataacatgaaaggtcttgtaagccaatttgataagttcagactttaaagactaatagggagctagattttgacggttgcaagcagatctcaatcaaatctatattttaggagtactaccctgaatgcaggtatggagaaataattggagagaaagaaagactgtgttcttggtaaaaattatgttggtgttgtaggagtggagataaaccaacatattaaagaaatatttaaaagaaggaataataatagggaaaaattaaagatgacttcccagtgtttgccttgagcaatggtgtacaatggtgccatttagtgaaagtgcaagaggttgagtaggttgagagtaaaataataagttcaattttagctccattgaattgtatgtgtttataagactttcaagtggagttggtatagaagaatagcaagaggtgggatatatatggatctgaaggtaatgagagagatcagaatttactgggttgttaaaaccagatgaacagatgaaattgtgcataaagagtatgtagagaaaagttagcaaactaatagccattgaactaattatgactcatagatatattttgtttggccatcagagcatttaaatatgctctgaattatgactttctattatttaaaaattggtagaatgaagataaaaatttggactttttggtgaaacagtcctagtctaacattcctgtatggcaataatcaactgcaaatgagtagtaactttccttatgtaggtgggtaatgtgctatccaggttggtacagttcttattcagcctatttaactcatttgcaatacctgcctgattcctgtagggttttgaatttgtggtcatatattatatgggaatacatggcagtctaggacaggataccatagaatatcaatatttaagatatgggaagataatgaaaagcccataatggaaactaatattaagaaggctactttagtgaatgggagaaagagaactaaatagggataccgagaagaattactgcacatttttttaggtggctagtacatgaaaataattcattgataattctatctaaagaattttttttgtaattttcagaatccaaagtccacagatgcttttttatttttaggtcaatttctcatgaccataagtttttccaggagtgctttgtggttttggaagtttaatgttagggaacaagccagaagaaataccccaaaatgttaataggcattatctctatgcagtgaaataatgtgaaccctttttcctcttcacttttgatgtgttctatgtttgtttaagatagtaaataatgtttcttctagagtctgaaaaagcaactacaaataacggaagtttaatgttagattattttcagaagtagaatattctatagtttaaggatctaaacacaagagtcttgcatgtgatccgagtagtgtttcccaaaacaaatttctgtgatttcattaatatgatcaatgaaaaaggattcaatggactaataattttgtaaagtactgaagatttacaatgcttatttgcatagtacaggctctaagaaattctgtaggggaaataatatttaactttaattcagggtttcccaaagttttaaaatatagaacaactaacttatcgtaaagtacactttggtaagtgttagtgcaatcaaaccaagagacggagaggctatggtttgttggcaattatgaattcctggaggataatttaaagacattaaaccttatcagaggcatttatacctttatagaacactgaatttatgtataaatgatatgttacatataaatgtggaaaaaattaaagaaatatctgtaaactttttatgaagccctgtttaatttcttttcttcctgcatatattctagaatgcaaatagtaactctaatttccaattatcacatcaatcataatacatactatttattgaatgcacactatgttttgccatagtattagatgctgtatgtatcttctaatctgcacaattattcagtaaggtcagtcctaatatttccatttttagatgaaaatatttaagatgaatccactaacaaaattcatcaatatccaatgaatctgtgtttattccccttggtaactctgaggagtcagcaccaggagatcctagaattaatttgtcacttttctctgattccaaatagtttctaagatttaaatcttcttcattgttttgtatagaatctttgatagttttcatgtgtgcttaagaaagaaactgaaactgtgttaatataatcataagaataatttgacactgttaggtcgtggagaaaggctgtggaaagtggagcaataataaaacccttgttatatcagatcagatcatatttaatcatgacataatcattttcaaagtgatgtaagttaaactaggaattataatagaaacatgccagatatgagagtagaataaatttaaagtcagattgatagagagagcccaggtcttttaacaatattctgttagactcataattatctgttatttattatactaaataacctgataagtgtggtataaccaatgaactaggtttcactccaatttgttgtttttctgtaaaagcgttatcactagagtagatttatttttaaatcaaaagtgccactgtacttttctttaggggaaaataatcagaggagatttcgtgtaaaaggaaatcttaaatcaggtatgtactttgcaatttaactgagacagttttacaccattacctttgtagctgtagtgttcttttatctatgtaaataaaaattcaattaaaaaaattcagaggcgcttatctgacaacaaacgtttcaaataataaagaaccccattgttattaggatctttgtgttttaacccgatttttaaagaaaaacataaataagtagtttgcaattagtaaacagaaatgcagttaggactggtaaagtaaataaaaaacttaagtgaatctgagcttaaccctagaatggtgggattttattccagtgtaatcttaatttctttgtttcagtctctagtggtaaggtattttaatgtttggtttttaattactgttttgaattgatttaacagatccactaagactcatccaggtccagttgtacatttaagcgatagcccaagagatgaaggcaaagtgagtattatgatatctttattattagttttattttcctcattcttgaaaaaaggtgtttcttactattattttatatctagtatctagcccagttgatagcattttatattatgtaaaatgaaaatgtgttgaatcaacgaatgagtaaatgaatgaatgaatgaatcatgctactgatggtcccaaattaagtctttagctttactgagagataaaatcggtatttaattctggcattttgagaacgataacatgtagaacaactttaattttcaaatactctatgcttgaatttaataatatgattataatttgcctttgttactcagtttggtaatgaaaaatgaccaatattaaataacataaattagccaatcttgatttcattaacatgtactaatatataaaatgttatcagactacagaaataattcttattcactttgattatttcataatttgcctttgatggtgaggaaacagttgaaaacatgaaaattagatatttttaatattaattaattaatattaataaattatttagtatataggtttggttctttatttttaaaggatagaaactgaattagcctatcaaaaatcaaacctgaaaggcaagtccacccacccaaggaataaaattggatcccttcaaattgatccacaagtacaatgtaattccaatcaggtgccgtcagagtttattttttaagaattcaaaaggtgattttaaaatttattaagaaaagaaaatgtatacgaatagccatgacatttttgaaaaagaaatacagtgttatattggtacaggggtacacaagaggaccaatgtatctaaatagataaatccccaaatagttcaggtatttgggaaaatgttatatattttaaagaagatgtctgaggacataattagctattgaataaatggtactggataattggttcttcactttgaaaagaatagtaagacctctgcctcatagatacataaagaaccaatgtttaataaacattaaaattacaactcagaaagtattcaaagatgcttgtaggatagggttgttagttactgtggagtagggacactcttgggcaaaatctaaaaactttagggcatatgctataacaagaatctcataataagagataggcaacaaagtgggaggtaatatttcctacatgtcaaaaataatgaacatgtaaaatatataaagaacttgtactaaatcctcatcttgtagtaagaaatcaatatataatatctaatgactaaatcagaaaatagcaatataaacatatttagacatatgaaaataagcctaccaaaaaagatgattttaagagttgatgttgttgcctcttacttctagagagaaggatttggcagtgaggaggaaacagtctcactagtaattagggaaatacaatatacaatttgtcaacatcataccgacaaaatgttaaacactaaaaatattaattttaaaatatcagagaatggaaaaagcactgggaaatagccatctaaatatatgtatatataccaggatgagcaattaagcattatcaacatttaaaacatatattcgtttttggaatttgttatgacctagaaaattcatttccgatatctatactgtttatgtgactaatggtgcaaactattaaaatagtctaaatgtctcttaatagaatattgaataaatgaatgctgatgtattcatactgtggaatgctgtgttgatatggaaagttctttaagacgcattttttaaaagaaaagttgcagaacagtaaggtataaaaccacttgaacattgcctttatatttgtacttatatattcaaatgcctaagaaaaaaaaaagcctgaaagaatatagacaaatctgggagaacactaaagattggaattggggaaaatggtcaaagttattcttattttatttgtgttgttcaaatttttatgaaagaatataatgtggcaattgtttaattacaaattaaaaggactgcaaaataaatgaatattggcatcagaaaactataggtttgagttgtggctctagcatttattagcatataatcttgaataaatcactttacttcttgtatatcagtttttccatcaatagtcttttgtcacagaagtttttttattttaatatatgcagttttatcagtcttttcatgtgattcttgctttttgtttcttattcagtaaatatttccctaccagagagaaaatacaattctatttttttctattggttttaagaccttgcatttcacaattagattttaatcttcatgtaatttatgatggtttgatatagtagacttttatttgcacatgtaaataattcatttattgtatagtgaatctatttttcactgatttatacacctcactcatatatcaagttccaatatttggattggtctcctaggcttaaccttttgctgaattatttatctactattgtactaatgacatactttattaattataataacttacaaaatgtcttgatatctggtaagctggtcccttttctttttctgaattatcttggctatttctgactcattattctagtatatgaattttggaatcagcttatcaagctcaatgtgattctcaattgggattttgtttgaaattcgagtgtataacttatagaaaatttacatgttaagatatgggtgttccatctataaatatgtttactttggctttcatttgttttgctatataactataaatttttttataaaagtcttttatatcttgtgctagctcaattcgataagtaccttatagaatttattgctcttgtgacttgtgacttaatcttcttaaagaagtttcataactgattatctttagattatcaaatattattgattttttaatattttgtattcagttgcatcattgaatgttttgtttttaatagctgtccttagattctctggaatattctatttataaaaactgaaaatatagacaaattttcttcctttccaatatttatggttatatatatcttttttgttttattgactaggaccccagtgcagtgttgagtaaaaatggttttagtgggaacttttttttgtttccaacttcaaaggaaatgcctccacgatttcagcattaagtaaaatggttgttgcaggtccttgattgcttttatgaagttaaaaacattccacctatttccaatattctaagagtttaaaattatgaatagtgtcaaattttattgaatgctttctacatgtatcaagattattatttcttaatttgttaatttgttgaattatgttaatagattttctaactttaaacatatttgtatttctgggataaattcaacttggaaggggaaagcttcccttggaagctaattggtgaagtgcaagaaggaacaaactgctaaagttaaggttcctacaaaatcaagataatatggttgggcgcagtggctcacacctgtaattccagcactttgggaggacgaggtgggtggatcacctgaggtcaggagttcaagaccagcctggccaacatggtggaaccctgtctctaccaaaaacacacaaaaaattagccttgtgtggtggcatgcgcctgtagtcccagctacttggaagctgaagcaagagaattgcttgaacccaggaggtggaggttgcagtgagctgacattatgccactgcattccagcctgggcaacagagcaagactccatctcaaaaaaaaaatcaagataatgtcatagaatcagaaaataggccatctttcccccaatatatcatttataaagaaactgtgcattggtctatcgaatacaaaagggtactcttgagctgagagatgcctgtattgatttgatacagcattgagtgaatctgcttgaattctcttagcttctcttgtctcccaaacaaatgctctcccaaacaacggctgtttgcttcacttcatgtttggcaaaattaattgagctattcccaggtctctggctcctttcattaattctggattcagaagatgtgctacaacataaggcattcaatctggcttccataacacacaccaaaggggtcaaatgacacaattctgaagagagggggtgttaacctcccatggagaaaaccttgaccaatgttaggcaagagacaagtaataaattcttcctctcttcctccttattatttggctaatttgagtcatagttttctcacataaacttttggagatttcttgcaagaccatgctacacctgaccagtgatgtctcttctgcttctccccatgaaatagtagagtgataatgaatcatctttcttttattattacaaccctgagattgcactcctcccttaaacactaggactaaaccctgcctcaagctttttttgtacacacttctggttaagataacagttactacaattattctcgataagggactgaaaaatacagccacaaaccaaatctggcatgctgcctgttttctcaaaatgttttattgaacacagccatgctcattcattaacatatgtctgtggctgctttcttgctgtaagagtaaagctgagcagttgggatgcaaagcctaaaatgttcactatctggcctttacataaaaagtttgccaactcctgtcctagtctgtaaaccctcagtattggatttttgaagttaggttgtctcctgtctaaaataagcaaacctgttgaaggtaccaggtgaaatgaattaaactcttccatgcagtgacatcacagttactttaaaaatgttcttctgtgattagggactaatctttctctgctagaaagataagataaagggagataaagtagtcatggtgtttaattgatatggggtaatgataattacataatgatgatgaaataaaataacttcctttgagggcacttgtgttagtttcccattgtcaaaataaattatcataaattcaatagcttaaaacaaaacaatttattatctttcagttctgtaggccagaagttcaacacaggtctcactgggcaaaaatcaaggtatctgcagggttgcattcctttttagtaattctagaagataatctgatttcttggctttttcagaggctgcaaaattccttggcttgcagcccctttgtctatcttcaaatccaacagcatagtatctctctgactcttcttccgcaattgtgcctctttctcaccacaactgggaaacgttcttcacttttataaaatattttatgttgttgttgttgttatgtaaagaacatattgacagattccaaagattagagtgtgggtgtctttgggagtcctttattcttcctacatcatctcagaacaattaattactgatttaccaaatcccagaagtcctctaaagtagatttaaaggaactcctacctcatgtagctctagggaagactgtgctaaaaataggcccaggagctgcttataaggagaccaaatacataactttgataggtctcatttgttaaagtcagagccctgataaggaaagagtatgacctttgtatattagtttcctatggctgccataacatatgaccacaaagtggatgacttaaaacaaagaagtttattttttcctagttctaacaaccagaagtctaaaactaaggtgtcagttaggccgtgctccctctgaagactctaggggagacttcttccttgccttttccagcttaggtggctcctgatgttccttgacttgtggcagtataacaccaatctctgccttcattttccattttcacatgatcttctctatgtcttctcctctttttataacaacaggagtcattggatttagggtgggcctaggatgggatttagggcccaccctaaatccagaatgatttcttcttgaaatccttaactaattacatctgcaaagattctatttctgaataaagtcacattctgaggttctgggtgcacatgaatttttgagagcactattcaaccattaacctgggatggaaaaatttatatagataagcctgagaatattgtaaaccccagcaacccccaatttcctcaaacacttctggtcagcagaagtacctctttcaccatttctggaggagaacagtttcccttttctgggtgaccgtgtaatgacttcacctaaaataatttcctcgtatgatgatgtttttccccacaagaccacctccagtatcattacatccaggcaaagaaccagaatcagatctcagatctcagcacagcctaacacagaagcataaatcttcctcaaggaataaataaactatatttgaaagaaatagaatacctaccaaaggaattgaggatatgactaatactgccattcaccaatgaaatgtgtttagagtggtttttaaggacttgaacttgggggctgcctagaggagggtttatttttatgggggcagttacttatgattttggattcggtgctttggcagggacacttggatatggtcctagtagtaatttgctggcatggctccttgaagcctagactaaaaaaaagccatatagtaaataaagtagagatgtcagagtctttgggtatggtattaaagaagggatcaggggatgataatgttaaaatgaatgtattatgtttgttctggcaactcaccttttgactgtgttccctaggaggcttctgaggagactgtcttcacttaacctaataagaaatgccctagaaaggaaaatattagcatatttgagaagcttggtagtggttgtcccttttaaggcccttgttgacagtaggagttgatgcaagagagccaggttccataatattcatggattgtagaggccaggtcacaaaatttaaccatctggcaatatgggcttaattaccataataagcagcaaggctggagtggcaatgcaggaatctatggtaatggctaatataccatgatgtttataggagcaaaataaggtgggaagctgactgggatgttgtttgccttgtatgatcagaaaaaaattaagagtagtttaatttttgacagtcaccatcaaaatggaaaatcacaatatctcatcaggttttcaaatataagttagtttgcagattcagaatctattgattaaaaaaggagctagttgtcactgaaaaagaatcctgaaatgctctaataagtacatatagtaattatagaaacatctgtgattgtttgcaggagtaactgtttagttttcaggactgttagatatagggtcagagcagacattaatactgggaaatttttaaaaaagcaattatggtcctccagttagaggcgagacatatggaataaatacccagttgatagacggagttttggcccaagtctaatctcacagtagatctagtgggtatgcagacatacccagttattttctccaaatgtataatttgacagatatgcttagtagctggaataatactcatattggtttgcttaccctgtaattagaggcacatagtgggaaaggaaaatggaatctcctgaaactgtcttcctctgccaatattgtaatcagaagcaatacagcatctctgaaggaactgcagagattattagcacaattagacttgaatgacataatggtagtggtcaccaatacatattgttgagttccattgtgtaggttttgcaaaaaaaaaaaaaatagattgaggttggtaatagtacatcgctataaaaataaccaggtgacagtcccaatcacagctgcctagcttttatgtgtatagatcaacacaacctatggtacctaagatacagttacatatttagtgaaatctttttttcacatggatgtgggatggaccccatattcatcaacagaggggaatgaaagaaaggactgcagtgtaaattcaaaatctttctccaggactatgttatttttcatgctctcagtcataatataattctcagtaatcttgattgtctggacattctttggaaagtataccaattcacttttttgcctatgtaatgctaactggatctagtgagcagacctggcgagtacctttataactcataagattcatgtttcagaggatgggaagaaaataccacaaagatccaggggcctgtaccagatatgaagattttgagggtcttagggtctggggcatacagagcatctcctctaaattaaagcataagcaattttacttcccctaagaaagtgtcacatcacttgatggggcttttggatttgaatcatagtttataatgtccttgaaattactgaaccaactaatttttatatcacccaaaagtctgccagttttgagtgaaagcctagagaaaaagctggtagtgtttgtctcctaagtcaaagatgctttgcaagctactgtactacttgggatgtatgattttatagatctgataaaacttaatgcacctggtagataaaatgttctattggaaagccctctagaggagtcatagcagttactatccattttcaaagcaactcctgacatgctcctgggcccttgtagagactgaaccatggaatgccaaatgactatgttacctgtgctgtccatcatgagttacatattatattcactgagtcataaaattgggtgggagacatggtatatttaggatgttagccttgacttttcaaaagctattagtgaattagatgtacaccgagcccagaattccatctgttgcaaaaatgcctccctcttgacctacatatataatcttatgggattggaaggaaatacctaaaaccaattgacagaggaggaaagaagttatgcctgcttcatagacaagtcagaggattggttgccattagctggttacagactgttgctcaattacatctctactaagggctaaccctgaatgaccctggtaaagaaaatcatcacaattggtagagccaatagcagtatactgtattatgcatttcatatgaataatgacacgataatttaaaattcagaaaaattttcttccacttgaaaatgttaaaactcttcattaaacaactattagatcaagtagaaaatacaaatcaaaataggtgaacatataaacatcaaaatagtgatatatatatcagaatttatggaatataatgaaaataattatcaaaaacaatttgtagtctttaaatcatatatcaatagaattataaattaaaatacataaatctaatatgaaacacagaaagctagaaaaacgattaagaaaataaagcaaaaggaaacagacataaagagataagagcagaacttcagttagttctgattgtaagctatgttataaattaatcaacatgctagttctttgaatagaacataaacaaaatatgcaaaccaacatccaacctaatcaagaaaaacagggagaaaacaaacttacacagaataatacacgaaacaagaggaaatcatactaaaactaaggacatttttaaacttttgagttaaatcattttacacagctctaagcaggtagatataaaagcctacataaaatgggtaatcccatagggaaattattaacagtgataccaatggagacagaaagtttaagaaaatgagaaagttattaaattactactcccacccaaaagtacaagtcacagatgactttataatggaattttatgaatttttcaaatattagataataccaatgctacatagactgttcttaaaaaaagattgccaagctatggccagtgggacaaatatggcctgcctgttattattttaaataaagttttattggagattgtgtagtctggaaagcctaaaatatttactgtttggcctattacagaaaaactttaccaacccctgttctgagtatagtttcaaaaaagaaaaaaattcaaattgtttttatgaagcaattataagagtgataactaaacctaataaaagttgcataaaaagaaaactggttttattggatgtattaataccaatggaaaaggagtgatatcagcaaagtggcagaataggaagcctgggctttcattcttacaaacacacagattcagctacaattcacatataaattccctttgtgagaaatgacaatgtaattgaaaagtttctgaaccccaggagaacatgaaaccagattcattaacaccagtaaggaaattcaggatgccctcttaccagaaaccttgctcctggtgcagtgccatatggtcaaggagagatttcctaggttgcagcttcacctaagggaggtaagaactttgttcatgtgtttagcacctcaatttttccaaaggggctccccagagaattggcttctgtcttgccagtcttggagcactgacagctctgaaacagcctagctgcctagacaagaatggaggcagcaaattgcgctgataaacacttctgaccctccctgccctgctgcttagcacagaggacagatgaaaaatcccagctctcagcttaccccttaggttgaaaagagtggatctgtgcatccagtgccccagcttctttgggggtgccaaaagaactagcacacatctcaccagtcctgaagctctgatgggtctggaacatctagctacctggggagaaccaaggtggtggcttgagctggtagatgccatagctaccccactggggtcagcacagagtgagaagataaagaccacagatgcctgtatctccatgggaaaggaaagagtagatagaagtcctcagaatctctgtctaggccaattggtggggtacttctctatgagaacatttcaggaagactgagagagatgcctgctttgcctaaagtgcagaaagcaacatagagagtcaaggaaaatgaagaatcagacaaaaatatttaaacaaagaataagataatggaaaccaaccctaatgaaatagatttatatgacttacttgatagagaattaaaataactcttaaaaagagactcactgaggtcaataatgcaattcatgaacaaaactagaattttcaggaaagagaaaatatttaaaagtactaaacagaaggcatggagctgaagaacacaataatagaactgaaaaaaaaatcactagaggggtcaatagcaggctacataaagtagaagaaaggatcagtgaacccaaagacaggtaactagaaataattcagacagaaaagcaaaaggaaaacagaatgaagaacagggaagaaggcttacgggacttatggggtacaattaaagtgggccactgtgtattatagaagatccataatgagaagaagcatatcaaggaccagaaggcttatttaaacaaatgatgagagctaggtatggtggcttatgcctgtattccctgcagtttgagaggctgatgtcagaggattgcttgagcccaagagtttgagaccagcctggacaacatgacaagaccctgattttatgaaaaagaaaaaagatgtaatgattgaaagcctctcaaatctggggaatgtagatatccaaacccaggaagcccaaagaacaccaaataaaatgaacccaaagaaatctatgttcagatatgttattatcagactgtcagaagtcaaggacaaagaaaggatttttaaagcagcaagaaaaagtggattgtcacatacaagggaatctttataagataatccacagtttttagcagaaaaattgcaggacagaaaggagtggtgcaatatattcacatcctaaaagaaaaaaaatactgtccatcaagaatagtatattcaacgaaactgtccttcaaaaatgtaagagagataaaacctttcccagacaaacaaaagctcaggaagtttaccaccactagatttgactcgcaagaaatgctaaagagttctttaagttgaagcaaaagggaagcaagatagctgttgtattagtccattctcacacttctagaaagatactatctgagactgggtaatttataagcaaaagagatttaattgactcacagttctgcatggctggggaggccttaagaaacttacaatcatggcgcaaggcaaagaggaagcaaggcatgtcttacatggtgacaggtgagagagcaagcaaaggggaaatgccccactttaaaaccatcagatctcatgagaactccctcattatcaagagaacagcaagggattacatgatccagtcacctgccaccagttcccaaccttgacacatggtgattacaatttgagatgagatttgggtggggacacagagccaaaccatatcagctctcttagtccatttttctgttgattgtaatagaatacttaaaactgagaaattcataaagaaaaggaatttatttattacatttatgaaggctggggagtctgaggtctagggaaggcatttggtgagaaccttcttgctggtagggactctgtggtgtcccgaggtggtgcagggcatcacatggtgagggagcagagtgtgctaatattctagctcaggtctttcttctcttatacagccactagttctcctcctatgatgcttcattaattcattaacccattaattcattcattaggacagagctttcatgattgagttacctcttaaaggctccacttgtcaatactgctacattggagattaaatttctttttttttaattatactttaagttctagggtacatgtgcgcaatgtgtaagtttgttacatatgtatacatgtgccatgttggtgtgctgcacccattaactcgtcatttaacattaggtatatctcctaatgctttccctccccccttcccccaccccataacaggccctggtgtgtgatgttccccttcctgtgtccaagtgttctcattgttcaattcccgcctatgagtgagaacatgtggtgtttggttttttgttcttgtgatagtttgctgagaatgatggtttccagcttcatccatgtccctgcaaaggacatgaactcatccttttttatgactgcatagtattccatagtgtatatgtgccatattttcttaatccagtctatcattgatgggcatttgggttggttccaagtctttgctattgtgaatagtaccacaataaacatacatgtgcatgtgcctttatagcagcatgatttataatcctttgggtatatacccagtaatgggatggctgggtcaaatggtatttctagttctagatccttgaggaatcgccacactgtcttccacaatggttgaactagttaacagtcccaccaacagtgtaaaagtgttcctatttctccacatcttctccagcacctgttgtttcctgactttttaatgatcgccattctaactggtatgagatggtatctcattgtggttttgatttgcatttctctgatggccagtgatgatgagcattttttcatgagtctgttggcttcataaatgtcttcttttgagaagtgtctgttcatatcctttgcccactttttgacggtgttgtttgttttcttttcttgtaaatttgtttgagttctttgtagattctggatattagccctttgtcagatgagtagattgcaaaaattttctcccattctgtaggttgcctgtgaggagacattcaaaccatagcaatggtgaagtaagactcttcagtgatagtcaccctatacaagtcaccataatgtagaatcagtgggagtgctaagcttgttttgctgcaactatatggtcccatctgggggtgatggatcatcaggaattagattagtgacagatcatcaggaattagatactcacaaggagcatgcaacctagatcccttgcatgtgtactttacagtagggttcacaatccaatgagaatctaatgctgcagctgatctgacaggaggcggagctctggtggtaatgcgagtgacggggatcagctgtaaatacagatgactcttcacttgcttacctgccattcacctcctgctgtgtggtctggttcctaacaggccacagactggtactgtggccagggtttggggaactcctgctctagaccaccttggtgtcatgaaaatccacaacaccatccaatgggctgaagttccagtctgcattaccactggttaactacagtggcctcaagcccccactaatcctcagtggcaggcgggctgtagctactgaaggccttagcatgtccaggtgccagacaggaacccatggccatggtggaatgaacttgagttctggcctgcatgaccgctgaccgactacagtgcccttaggccctgaagaaacctcagtggcaggcagattatagctgctgcgggccttaggcatgccctggtgccattctcatcttagtagcagtggactttgggtataagttcagcaaccagaagataactcatgtctccctttttccaacaccaggcagcacagcacagagagaaaaatcattcacttggcgaaggaaaggaaagtataagcatagaggtttgctgtagaacccagtatagtgcccaccacagtaaaactcaatatctggcagatccctccccaccacagctcctgactctagactgatatgcacaggcagagcctctagacctgccctggtgtcagttaggaacccatgggccccagcaaagcagactcagaactcaaccaacatcacttcttgcctacttcagcagccttgagaccagaataaaccttagttgcagtgcttaatatcactaatcattagggagatccaaatcaaaactacaataagctaccatctcacaccagtgagaatggctattactacaattttttaaaaataacagatgccagcaaggttggagagaataggtaacacttgtacactgctggtgggaatgtaaattagttaagccattgtggaaagcaatctagaggttttccaaagaactgaaagcagagctaccatttgatccaagagtgtcattgctggatatatagccaaagaaattataaattgttctaccataaagacacatgcgtgtgtatgttcattgcggtactattcacaatagcagagacatggaatcaacctaagtgcccatcaatggtggactggatgaagaaaatgtgctacatatacaccatggaatactacatagctatttttaaaaatgaggtcatggccttttcagcacatagagggagctggaggccattatcctaaccaaattaacacaggaacagaaaaccaaatactccatgtgctccttataaatgggagctaaacgttgtgtacacacagacacaaagaagggaacagtagacactggtgcctattttagggtggagggtgggaggagggtgaggattgaaaaactacctatcaagtattatgctaattacctgggtgacaaaactatttgtacaccaaaccctgataacatgcaatttccccatgtaccaaacctgcacacgtaccccttaaacctaaaataaaagttgaaaagaataaaaaaaatgttggttttttaaaaatataaacaaaattggtaaacttttagctacactaagaaaaaagaatgaagaccaaataaataaaatcagagatgaaaaaaagttacatctgataccacagaaattcaaaggattggcagactcttatgaacaattttatgccaacagattggaaagcctagaagaaatagataaatacctggataccaaaaccaggtaaggacataataaaaaagaaaactacaggcaaatattcctgatgaacatagatgcaaaacgtttaacaaaatactcaaccaaattcaacagcacattaaaaagatcattcattatgaccaagtgagatttattgcaggaatacaaagatggttcaacatattcaaatcaacaaacataatacatcatattaacagaatgaaggacaaaaaccatatggtcattttaatacacggagaaaaggcatatgacaaaagtcaacattcctttatgatataaattttcagtaaattagatagaaggattgtacctcaacccaataagggccacaattgacaagacccacagctaacctcatactgaatgggaaaaagttaaaaactttttttctgacatccggaacaaggtaaggatgtccactcttagcagtcctatacaacataatactggaagtcctgaccagagcaactaggcaagtgaaagaaatataaggcatccaaatttgataggaggaagttaaattgtccctttttgctgatgacatgattttatacatagaaatccctaaatactccactaaaaggcttttagaatttataagtgagttaagttgcaggttataaaatcaacatgcaaaagtcagtagtatatgtatatgctaatagtaaattatttgtgaaagaaataaacaattctatttaccatatccattaaaaaaactgggaataaatttaaggaggtgaaaggaggtctctacattggaaattataagacattgataagagaattgaagaagacacataaatggaaagctatcccatattcaaggattaggagaattaatatagttaaaatatttttaccactcagtgtgatctatagattcaatacagtttctatcaaaataccaataccattcttcacagaaatagaaaaaacaccacaaagtttgtatggaaccataagagactctaaataaccaaagcagtcttgaccaaaaagaacaaagccgaaggcatcacattacctgacttcaaagtataccacaatgctatagtaaccaaaacagcatggtgctggcataaaaacagatacataggctgatggaacatattagagagcccaacataaaaatccacacatttacagccaattgatttttgacaaatgtgccaaaagcttgcaataaagaaaggaaagtctccttaataaataatattgggaaaactgtatatgcatatgtggaagaatgacatgagacactcttttctcactatattaaaaaattaaaatagattaaataattaagtgtaaatccttaaactattaacctactggaagaaaacaggggaaatgcttcatgacatgggtatgggcaaggagttttttgaataagaactcaagagcacaggcaacaaaagttaaaatagacaaatgagattatatcacacacaaaaatgttcgcatagcaaaggaaacaacagagtgaaaagacaatctacaagtgaaatgttagttatagaaaaataaatatgttcttactcatattggagggttaaacagaaattctgctcacagaattaaagtagcattgtcgttattagaaactaggaagagtagaagtcaaggagaagaaagggagaagttggttaatggacacaaaattacatctatatggaaagaatgagttttagcattctgtagcactataggttgaatatgattaacaattatttagtgtatatttataaaagctgaaggagaagattttgaatgttcataacacaaataaatgatgaatatttaaggtgatggatatgctaattatcatgatttggtcattacacattgttcaaatgtaaaaaagcactctctcttataaacatgtacaattactatatgtcaactaaaaagaaaaagaatgacacatgtcaaatttttaaaaaccctatgagaggagtaccattacacatgaaacaattaaggcggaatatgaattaacttacccaagatcgtgttgcttgtaagtatcagaattagtgttcaaacctaggcaatgtggctcagagtcaatgctcttaacaatcacactataagaacagatataataaatatctacttacctggaggatataaattctatttttattccgagttctgaatcaaaatggtaattcaaaggcaatgagaacattaacctcatcaccatcatttaggctcaaaagaaaatggtacatattctattgcaaccagtcaggattaattctcaaatgtatgaaacttgaagagggaggacaatgcaaaggaaaccgtacttagtagcagaatagttattactataagcagacttcaaagtatgttggacaaaccatcacttatgctgaaagtgacaataaaagacttgggaaaaaaagaccacctacagaatgagagaaaatatttgtcaactatacattcaagagtataagggactcagacaactcaccataaaaaaccaaacaacccagttgaaaaatggacaaaatagacatgtatatgcacatgtggaagaatgacatgaaacactcatttctcactatattaaaaaattaaaatagattaaataattaagtgtaattcctcaaactatgaatgacaagagacatttttcaaaagaagacatattataaatggccaacaagtatatagtgaaatgctcaacatcgctcatcatcagggaaatgcaaatcaaaaccacagtgagctatcacctcacctcatttagaattgccattatcaaaaagacaaaagataataagtactggtgaacatatggagagaaggtaatgtaaattggtataaccattgtagaaaatagtatggagattcctcaaattaaaaatagaaataccatatgtgatccagcaataccactacttggtatataactaaatgaattgcagtcaatatatccaagagatatctgcattcccatgttcgtcacaacattattcacaatggccaagatatggaatcaatgtaattatccatcattggataaatagataaagaaaatatggtatatattcacaatggaatactattcagccatataaaatgatgaaatcttctcattcgcgacaacatggatgaacctggaggacctacgttaagggaaataagccagaaacagaaagacaaattccatatcatctcactcatatgtggaattttaaaaaattgattacattgaagtagagagaggaaagttacttaccggcagctgaggtggttaatgaggaggaatggatgaggacatgttggtcaaagaataacataattacagttatgtagcaggaataaattgtaagatatctaatgtattacaaggtgattataggtaatgatatattgcactgttgaaaaatatagagtgtagatgttatgtgatcttatcacaaaatgataactatgtgagggaatgcttttaactataataagtttaaccattccacaatgtatatatatttcaaaatactgtgttatatgtgataaaaacatacaatgttatctgtcaatataaaagaaataaactttttaaagactgaaaaaataccgaaattgaaagaaaagtatgttaaacagcaatgcaatagcagaaggaagtgtgaaacttaggccagacatggtggcttacacctgtaatcccagcacttgtgaggccaagccaggcagatcacctgagattgggagtttgagactagcctgaccaacacggagaaaccctgtgtctactaaaaatacaaaattagctgggggtggttgcacatgcctgtaatcccagcgattcgggaggctgaggcaggagaatcacttgaactcgggaggcagaagttgcggtgagctgagattgtgccattgcactccagcttggtcaacaagagtgaaactctgtctcaaaaaaaaaaatgtgtaaaacttattgctaagggtaaatatacaaacaaattcagaatactgtagtgtgagatgatgatgggtacatcacttaattctattaggacagtgcaaaagtaattgcagtaaagtaattcaaaggatacaattagtaaaaataactctaactgaaaattatgttagaagatacaccatataagtagatgaaaattgtgacaacaatactataaagtatgtgttaggggaagagaagtttaagtgtagagttttggtatactattgaacttaaggtgttattgcttaaaatagagcattagattttatgtaagtcctaaggtaaccacacacacaaagaatgcctaagaagttacacaaaataaaaagaaatcaaagcatatcaataaaaaacataaaggaagacagcaagagaggaaaggacagacaaaagggttataagacaaacagaaaacaactaacaaaatggcaaatcattccctgtcaataattattttaaatgttaataaattgatctccccaatcgaaagatacaaagtatctgaattgatttagaaaaataaaaaataaaaaacaagacccaaccatatgctgtctacagtaaactccctttccatttaaggatatataaagactgaaaaacatgtttcatgcaaatgataatttatgcaaatagtaaacaaaagtgaggagggatggctattattattgcagacaccatagactttaagtcaaaaattatcatgagacaaagaaggacaataaaaaggtctatccaccaagaagaaaataatgattataaatatatacacatctgatatcagagcacctaaatatataaggcaaatattgtcagaactgaagggagaaatagatagcaatgcaatcatagtaagagacttcagtactctactttcaataatagacagattatccagatatattaaaaggaatcagcgggcttcaataacactatagaccaaatggacttaacatatatacagaactttccacccaacagcagcaagatatacatttttctcaagcacacatggaatattctccaaaatagataacacgttaggccatgaaacaaaccttaatacatttaagaagattgaaatgataccaagtatcctttctgaccacaatgtaataaaactagaaatcaatagtggaagaaaactccaaaatgtataaatatatagaaattaaacaatacatccctaaacaaccattgcctcaataagaaatcaaaaaagaaattagaaaatatcttgagacaaaaatgaaaacacactctaccaaaaattatgggatgcagcaaaagcaatactaagagggaagttctagcaataaatgcttacattaaaaaataagaaagacctgcaaacttacaactttacctcaaggaactagagaagagcaaactaagcacaaatgtagtggaaggaaggaaataaacattagaggagaaataaatgaaatggataaaaaaatcaacaaaactgagagttattatttgaaaagatcaacaaaattgacaaactcagctacactaagtaaaaaagatttaaaattcaaataaataaaatcagaaatgaaaggagtgatttacaactgatgccacagaaataaggatcataagagactaataagaacagttatataccaacaaactgtataatctagaaggattgagtaaattcttagaaacataaaacctgccaagacaaaccatgaagaaacagaacgtctaagaactagtatagagattgaattagtaatgaaaaaccttttaacgaggaaaagctcaggatggcttcactagtgaattctaccaaaaatttgaagaaataacatcagtccttaaattaaaaaaaaaaaaacaacttgaaaaggggaaaacattgtcatcagcattaccctgacaccaaaactagacaaatatatcacaagaaaataaaactgtaggtgaaaattcatgatgaaatagatgcaaaaatcctcaacaaaatactggcaaactgaatccaagagcacgttaaaataatcatgcatcatgatcaagtgggatctatctctgaagtgcaaggatgattcaacacataataataacactttctgattttaagctaaattacaaggctacaataattaatgtagtatgacaattgcataaaaacagacatatagaccaatggaacagaatagagagcccagaaataatccatacatatgtggtcaactgatctttgacaagggtgccaagaatacacagtgtagaaaggataatattttaaacaagtggtattgagaaaactggatatccacatgtataagaatgtaattagacctttttcatacatcttactaaaaacatcaattcaaaatggattaaagacttaaacataagaccttaaactctgaaataaacataggaccttaaactctgaaatatgtagaaaaaacgtagaagaaaagcttcatgacgctggttttgacaatgtcatggctctataaacttaacactgaaagtaactacaatgaaaacaaaaataaacatgtaggacaaggtcaaactaaaaagcttctgcatagcaaaagaaacaatcagcagcgtgaaaacacaatgtagagaataggagaaaatttttgcaagccatgtatctgtaaagcgttaatctgcaaaatacataagaaactcatacaactcaatagtaaaaaaaaaaaaaaaaaaatctagtaacccgattttaaaatgggcttaagtcttaaatagacatttctccaatgtctatactataaagcatgtgtcaggggaagagaagttttaagtgtagagttttggtatactattgaacttaaggtgttatcagcttaaaacagagcattagattttatataagtcctaaggtaaccacacacacaaagaatgcctaagatcaggtatatggaaaagtgcttaatgttactaatcattagagaaacgcaaatcaaaaccaagaatagatactaggatcattattatgtgtatgtattttaaaccgaaagacaccttttgacaaggatgtgaagatattggaacacttgtatggtgggactgcaaaatggttcaaccactatggaaagcagtgtggaggttcctcaaaaaattaaaaatagaactacctatataatacagcagtcccatttctggatatttatacaagagaattgaaatcaagatctcaaagagaaataaatcataatatttttggcaatagccaatatgtggaaatggcctaaatggccattggcagatgaataaacaacatgtggttacccagcccttattagggtggaagagtatcccttcgtgtacctataatacacgtggtatttctacaatggaatacttttcagccttaataaataaggaaattttacagtatgtgacaacatggataaacctggaggatattatgtgaagtgaaatgaccagtcatagaaagacagattcttcactattcaacttatatcaggtatctaaaatagtcatatatatagaatcaaagagtgtaatggtggctgatgggctgggggaggttgaaatgcagagatactaatcaatgaacttaaagtttcagtcaagcaagcttgattgatgtataaactttagaaatctgctgtgcaacattgtatctagagtcaccagtaatgtactatatatttataaatttgttaatagggtagatctcatgttcagtgttcttactacaataaaataaaatattaatggaaaaatcttaaataaaatattaggagacagaatcccaccagcacattaaaaaataattaattatgactagtggtgttttactccagggatgcaaggatagatactattacaaaatccatcaatataatttatatcgctaataggtctaagaacaaatgattatctttatgatgctgaaaaagtctttgaataaaatttagcacccattgtatttccagttttgataatcagatcagtccttccactgggagaattctatactctacaaaaatataatttaaaacatgtcatcaaattattttcagcaaacaaaatttgcaacaattcatcaacatcaaatcttactaaggaaaaacctaaaagacttgtttaagcaaatgaaaatgatctattatataagaacagagatgaagaaaagaataaagaaccacaaacgtgttaaactaaggaaatattttataaaaataataatgacttcttgcagtgtaatatattgagaattatgatacaagttgggatgacgttcactaaatttaattgccaatgtctttatgatggttaattttacacaccaaactgactggattaaggaatactcagagagttggtaaaacattatttttagtatgtctgtgaaagtgtttccagaataaatgaccatttgaattagtaggctgagtgaagaatatctgccctcaccaatgtgagtagacattatccagtttattgagcttaggatagaacaaaaaagacgaaaggtgaatttgctctctctactggaactgggacatctatcctttcctgcttttgaatatcagctcaaggttctcaggacttcagacttttctttcccaggcctctcccacttctctggttctcaggccttcaaacacagactaaattacaatcccagttttcctacttagtcagcttatagagagcatattgtggaacttctaatcctgcataattacatgaaccaatttgcataataaattccttcttatatagctatacagatatatatcctattgattctgtttctctggagaaccctgactaatacagtccttataatttccagaaagtagcacaagtactaatttacattataatttgataagtcatgaaaaatttttattctggtgggtaaaatataataaatgtatgtataatggataagttaatagagtggaaaattaggataagaaaaaactactaaccaactcccttcccaaaaagagggaggacacattaacaaatgggacaaatacaagataagtaggtagctttgttctaaaatatgtcagcaattatattaaatgtaaactgactaaataggctaattaccagacaataatttgcaaactgctaaaacaacaatatgctgttacaagagatacattttaaacttacagatgtagaaaagtttaacgcaaaactgcaaaaggatatagtatgtaaaccataaccaaagaaaacttgtgtaactatactaatatcagaggatacagactttaaggcaaaaacttttttaaggataatattttataatagaaattggttaattcagcagaagatgtaataatcctaaatttgtatatgcctaatgatgacatagatttatagtatacaggtagtgcttactttgcatggtaccacgttaactaaaacatgtgcttatctgaattgtgttttcattttgcatggaatcatgatgtgtgtgtatgtataatttgatagaactaaaaatatttttaaaattggacagaactaaaatgaaaaatactcaaatctacaattgtagttggagattttaacaaacctcttccagtcactgagaaaacaaacaaacaaagaaataattagtgtggataaagaaaattaaaaccacatgattaacaacttaaccaagttgacacatataatacattatgtatatagtactagcagaccacacattattttcaagtgcttatagagtatttgccaaagttgtatatttgctgaaccaaaaaacatgccaataaatttcagaggattaaaataatacacaatatgttctctaaccacaagagaatttagcaagattatcaataagaaaaagataaatgaaaaatcccctaattgtttagtcattaagtactacacttctgaatagcttctatgtcatagaagaaatcagtataaaaattagaatatattttaaacaaaattgcaataacaatgtgacatatcaaaaacttgtgcaatgtagctaaagctgtgcctccaggaaaatttatagtttatattacatttcttaaaaagtgaagaaaagctgaaaatcagtgatcttagtatccaacccagtaagctagataaacagtgaattaaacccaaagaaagtagtagaaagataacaataaagatataatggttaattttatgtgtcaacttgactgggccttgaggtaaccaaatattggtcaaacatcattctaaaggtttaggtgaggatgttttggttgagatgaatatttaaatctgtagactgagtgaagcaggttgccattcctaatgcgagtgggtctcatcaatcagctgaaggcctgaatagaacaaaaaggctaaccctttttcaagtaagagagaattcttcctgcctgactgcttttgaactgagacatcagctttttcctgcctttggactctaactgaaacatcggctcttcctggttcttgagcctgctgaccttcagactggaactataccattggttctcctggttctcaggtcttcagactcagactggcacaccatcagctctcctggatctcctgcttgccagctcaccctgcagatcttgggacttgtcagccttcataatcacgtgagccaattcctcataataaatatctttttctatacatagaaaaacatctcttggttctaatttttcggagaaccttaattcaaaagatgagagcggaaattaaaagaatagaaaacaaaaatttagtacattaacaaaacagttatttgaaaatactaacaaaattgatgcatctctggcaagtctgatcaagaatgaaagagaaggcacaaaaaatcacaaccaatttatgctccccctagtagtacagttggtttaacttttcagaatcagtcaatgcaattcacagaaataaggagaaaaatatatggcaataaaaatagctaataagcagcatttaataaaatttaccttctcttcattataaaaatctcttggtacactagggaaagaaaggaatttcattaatatgaactttgttaattttcccaaagctatgaaaacatcctccttaatgatgaattaatatttttcctcctgaaatgataaatgagacaaagatggctatgatttattcctttaatttaacattgtacagctattcacaatattggtcattagatgagaaggaaatggaactcatatacattttgtgaaaatgaaaacatgaagtggttggtataaccactttggaaaactgcttggcagtatctattaaagttaaacatactaatatcctatggatcaatatacatttaacagaaatgcatatatgtatttaccaaaagatatgtacaaggttgttcatggcagtattattacatcaactgtaaaatgaataaattaatttgtggtagtgccatagccaaacaatgaaatgctattttaataatgaaattaaattaactaatgctacaaatataatagaaatagaagcaagaaagagagcaatatgtattgtataattctacctgtctaattcgaaacaggtaacagtagcctatggtgttagaagtcaggatagtggttatttttagagaggagagtgggaatattaactaggtaagagtacgaaataggcttctgtgaatggcttgtattgtttttcttgtattacttgtcttctattgtgttttttaacgtggattgtagtttcatgggtatgtttacttcatcataattcattaaatatacatctataatctgtgtacattatatatatttcaacaaaaatatttattttaaaattaaacacctattcctaataaaagaaatgtataacatataaatcaatttatacttctttaaatctctctctctctctttctatgccctctccctccctccccagaattcaggatcttatttaatggggaaacactagaggcatagccaccaaagtcaggaagaaggcaaggatgcttagcctctctactatttttaatactctaggatgatttttagcaaagcagttagataaatacaaacaattagagacataaaaattagaaaaaaataaagtagtctctattttagattatatgataatatatctggaatggcaaagagaatcaaccttaaaatgaatacaaacaaaataatttagaaaggtgtatactaaaatctaactatagaattaataccctattagaaaaggtaatgaagagaagaacccatataaaatagcaataagaaagttaaaataactaggtataaaattaacaagaaaatcaatatgtggaaaactttcaaacttcctaaaagatataaacatatactcgaataaataaaaggtggtatcctttgctcttgaataaggtggctcattatttttaattctgctttctgagatttacttttttctttacttttcaaagtcaaatgcttatatcattaaaacattttcagtttttcttctctacgtacatatttacaaaaccataaaatttcctcttaagattcatctgtgtcttgtgaggcatttttgttcagttctgttttatatatttcattatgatttcttctttgcttattaattacctacagatatattttttagttttcaaaatatttttgtcatgacttctaattttattttactgtggttagaatataatatctacaattttgattttttggtatttaacaattaatttgttattcaccaaatacctatttttttcagacactagtgtaggttctaatgatatcatggtgaagaagtaaccctacttctttgcctttatggtacttgcttctattgtgagagacattttctgtttaaaaaatatgtatatataatttgtggtttgggcattgttcctgttttggtgtggtcaaatattgcagagtgctcttatttttgtcttggttcctcatggtcacagagtggccttgtctaatgtctcctggatgtcagggggattcttttctcttttctaattctctaactgattctaatatcatgttttctaaatcataatcttgtatacttatctcaacagtttatggtgtttttgaggttcagtatgttatattttgtgatttactggggctattgctagcaatgttttataagcaaatcaacttttatctttcagatatttactttaataaaatataatagtgttttaggatattattttattaaatcttggggctcaaatttagaaagattatattattcattttattgcttaagttatattttctaaactttttaggctaatgaatctccttgccaatatctccttgccaagagtctcatacactcaataaagttggttttattggctgggcatggtgactcatgcctgtaatcctagcactttgggaggccaagaggggcagatcacttgaggtcaggagttcgaaaccagcctggccaacgtggtgaaaccccatctctactaaaaatacaaaaattagccaggtgtggtggcagatgcctgtaatcccagctattcaggaggctgaggcacagaatctcttgaacccaggaggcggaggttgcagtgagcagagattgtgccactgcactccaccctgggtggcagagtaagactctgtcctctgtctcaaaaaaaaaaagaaagaaaagaaattggtttcatcgttcatcattttctcttgtatgtaaaaaaaatcaatttgaagttaaaacatatcttagtacacttagtacagtcatatcaattttattttaagaaatattactcaaatatgtatttagttttgacattttcacttagcaagtcatatatgccatttacttcaagttaacatgtaaaaagctcaattttttgtcatttttaacatttattgtgtgtggtttaataaccaagcatttttgttatagcttcaaaaataaatgtatattgctttaatgaactgatatttgaaaccttttgtgtttttactgcgaaaactactagctggtttacttttgttattttttgtgtctcattgtaagatgtcgagataagtgataaggtctcaggatgctctgcaggcttaggttatcaccaccactatattttctgttcttaccaatggttttttgaagttattgatacatctttatccagtgtataagaattttcatcagaggaatactactaatgtatttgaagaaaatcatcttaaggcaaatctgtcagaaatatatcattattttaacattggctatttttatccttcctcttattttttttccctaaccaatgataggttaaattttctgtcattggtaacaaaaaaataggaaggatacaaataataattgtgaatcatttaacagcaaaagttatcagtatggctagcattgtttagcttaatgactgagtcttaaagatgatcatattataatcatgatatgttctaaaattcttctattttaaagaaatattttattaatcatcttatttattgatttaaaaataaatattaatctttttaatgacgtgaatctctagaataactttataatcttcagagggttcataaaacatcagtttaaaatattgaattcggtcaaagagaaaataggatttggtagaagaaatttgaagccaaatttgaagccacatttctcaagtgcataggactgaatggcatatacatagttcattaatcttatcccatttcatgttttatttcatcttcgttttctatcccatttttcttttcttccaattttcatacttattttatatcatgtcatatatatttatattcttccttatttcctctttgaaattaggtgatttattggtaagtgttcatattgaagcagagtttgccattttttaaatgtagaaaacctatattcaagttctagaaaaatttattctaaataaggatgttatgtggtatgattttactttattaacattaaactttatttgaagcaagttaaaattaatgttagaattaagaaaatgattgttctaatgttttccagctgctaataggttatgaaaatggtactgtagtattctgggacttgaaatctaaaagagcagaactgagagtttattatgatgaggtaagtgatttctaccgacatgtttgaaagagtattgtgacgttatgcctgtttactacttttaagctttgcactttaccagtatgtttagccttggaaagttgcctgattctgacccagtgcttcacactgtcttttagtatttgtgtaagttccatctctagatttttcttttaagaggaaattctgccttgactgcctatttcggggccctcttgtggcatcttatatactttgcatttgttaatagatcctgccttgtcaatcttatatacttgggtgcctgtcacctgtactatatccccaactttgtctcaactgcttttcctttctgtaggctccatgctacgttgtgcctcattgtccttaaggtctctaaagacactattcacaccttccttagaaaattccttttcagtggcaagaagttcaagtcagtttgaaaggtcttgtcttctaatacttgccttcttagaataaagaaaaattttgtaaatagtaatacttattaagtgaccagatattaataagtgacacttattaaatgaccagatcttgaagtaagttttattgtatgtaattgagacttgattaagtttgtatttaggggaagcaacaaactcctattcatcaaggaataatctcccagttgacacttcagttgttcaaatattaattccgggccattaattatttttccattcagaagaggctaataagaagaccgtaaaactgggggcaacagattaaaagggaaattaccttttgtacctgtggaaacaaaggtgatcatctgtgctattaattcaatttgaaaatggtgggagtaggaagagataggaggaaaatatatgtcaaaaatttatgtccagtaaaacctaatcttatataggaaaagtgccaaataatttaaagcagcactgaaataattagaaaatgaaacacacacacatttattttagaacacttccttattttatcattggagggataaaaaaagtctccagatgaacctgtagtcaccctagaatactttacatgttctctcccatccccctcataacagttaattttttaagtttcggtgcttaaagatataagccttcacctatttcataagctgcacaattcgttatcagtcattctcatagtggtaaaaaaatgtttagaaataaaataaaatggcagctgggtaattttttcacaattggtgaaaaataatctgataagtaatatcatgcagttatgttctttataatcaaattcttcagcatcttgaatcataagaaaagaaggtcttagggagctaagctaggagtttccttttgttatacaaatcataaagatggggatggatagtgctccttctcttccctctctcaacactagcagctaaataagaatacaaacaccatgggaatatttagccagttggaattagaataaccagctcaaaagaaaacccagaggaaaatgctgaatcatctagctttcctatggccttaaaaagtatggaagaaacgttttgagccttaaaaagagagtaaaatttcagtgaaattttaaaataaggatttgcagctgccttagtacaaatatatgtaatttatacctagaagttattgacatctgatatatgtatgtaaatatatcatctttatctactttaatgtgtcattatatgctctattgttttaacagagatagttaaatacttcatttcactaccaaacttttcagcctctcctcagcactttacctctcatatctagaaagcatgcttaatacttacctgaaatgttttttcttaagtcaccaataagctcttcattactacacacagtgacctcttccaagcctttaaattcctcactaaacctgtggctttacctcagtttctcctccttaaaataatttattcacttgtctgtgtctttccacctcatttatcatgcacctttttccataactgatttttcccttagctctcctttacgttattgatattcttcaggatattatgtctttaccctcatttcttctctctctaatttatactttctagtgtttatattatctcttatttcaaatattacctttatgctaaaaaaagaacatccatatatctgtagcctttacctccctcttgaactctagatctaaatatctaacaatatattagataaatccagcaaaatatcccattggcactgaatttgtatttaaatatctaaacctccttctatgttttcttctggtttttaagtcttgtttagttaattcagtttagacccctcaaagtaatatttgtctcttccatcatcgtgttgtatatgcaatcaatttctgcaggctttctgattctgattttatattgtctcatttatttcctcttttctaattcccacttccaatgtcctagtttaagttgttatcttttgcctggatgactataagagcattttaactaatcacaaccacttttcctttgatgtcttacctcttcaatatatccttcattaacaagattatcattttaaaacagattatggaattctctacaacagaacctttgaatagctctcaattgtcgacaatacacagtccatattgcttgacttgagatttaaggtcctagtgctatcattcctctttagttaaatttacaacatccttctacacattccccacatttcagacatattactcactatcttccatatataacacttattgcttatctctgagcctttgctccttctaacttctcatcatgaactgccttctttcctcttctgtatatcaaaattctgttaggtctttagcccctgtaaaactatttagacaatttaactagcctcttcataaatagccattgatgaatggatattgttatccagttttttggatttccttcttctttcatgtgttcaagaaactcagtctcagccactgagttgataaaactagctagtattttatgtttaaaattctgttttctatctcttaaaattctttttggattagttgtattatatttgtttttttcagtaagccctctgagcccccctccctttttttgagaaaagagaggggtagaatctaataaatagaaattgaatatttatccatcaagttagatcaaatgctagctactcagtaatgcactatatgagaccctgatctctaataacaagttggttttacatgcttgcttttctaaacaataaatatacttctttaatagtactgacttactttggctttatttagctattgtttttatatctgtcctctccagtagatagaaattcagtgaaataagaaagtttagggttgagagtgccttttctgcctccatctttgatggcaaaacagtttgagacaactttaagttaaatgaggctcatcaaagttaacatgtaggggaggcaagaagatgtgactttcccttgaaccacctacagaagggagaagaaataagcagaggagaagagaaaaaaagtattttatctctaacttcctctgctggaccctagcaaaaaagaaatctctgcttagtaatgaaggccacagagtgagagaaaacacaagtccaggatttcatgttgctttttccacttaatcaaatcttattttcttgattatatgtgtaataattactttagccatcagttatctgcaactctaataatactgattgtttagaacttttatcagttatgtatgtgtaacttagtttggaaattttagttgtatgtgtctgtgtgtgaagtttcaaaaaataaatatgattagtattcacttatattaatcttctctctcttgctgttttataagtgtctttaaggaaaagatgttgtatgcttcttttctgcctttatgtctactagaatttttcttatagtacttagtactttacccaagttctgtatgtactttattaatttagaaagaataccaagggtgtggaaatgcatatgacattaattactaattcagtcaacagatatttattgagtacttactttatgctggtcactatgctagcattgggaatacaatagcttgggaaaatgaaatacagtcagccctccgtatccataaattccatatccttggattcaactaactataataggaaatattttaaaaacaaaaaataattttaaaacaatataataatttataataatacaaataaaaagacagtatagtataactacttacatatcatttacattctattagtaatctagggatgattttaagtatatgggaggatattcataggttgtatgcaaatagtatgctgttttatataagggacttgagcatctgtggattttagaatctgagggagtgtgggagttctctaactaatccccagtggataccgagggatggctgtaattacttttgaatcttatctgactcaaaactacagagttaacctgaaaatataaaagaaaatttaaacctttcttgctttaaattgatttaaatagtatatgcaagagggcaatacagtgcaatgattgagaacgtttttcgtagttagaccttggttttgagttctgtgacttgagcaagtatctcaatctctcaaggcctgtttcaccatgtgtaaattgaaaaatcaatacactttttataggattaaatgaaataatgtgtataaaatgcttgccttggggtttggcacatagaaagccttcagatggtagctcttacttaaattattcttttaattggctatgtgaggaggaaataggacttcatcttaccagaaattatagtctgatatgggtcagaaaaattatgttttttaagtgttgttagtataataattttatatcagaatagtttttctttggaatatagaatgatataacctatctacttttttccccctctacttgttttaattgttattttattaggctattcattcaattgattggcatcatgagggcaaacagttcatgtgcagccattcagatggtagtttgactttatggaacctgaaaagcccaagtcgccctttccagaccacaattccacatggtaagatgtatgctttcaaaaggaataaacactggcaattcagtgccttgacttgaagtaagagagatggtattaatgcgtttggtagaaaaaagtaataggacatagcttctggttctaaacatcccttttataccacctacagatcccaacattgtaccccaaactttccatacttcccttcttcctaccaacccacatccctgttttgtaagctgtagttatgtactgtcccaaccaaaaattggataatggatggttgatatatctggggcagaggagataatataggaaattttgtcacttttaagggctgaggagccagtgagagaatggcactatttagatgtgactttcagagttaattcctatactactttatagtctgttgttttctagattctcccacttgtttccatttctgccatttgattccagtaagttatgaagactgtggttttaattttaggttttacttttcttattgccttccacattgagaagagcattttaatcctaaatgaggattttaatcttaattgaggatttatattggatctgtatacctaatggggaagaataagcaattcaaatgtataaatatatataattcagatgactaaattatttgataatattggtgatgatctgagttctatgtttacctcatatcattgattatttgtaataatagatatgtcagaaactaacagttgatcaaacatattctatgttacagtttctgagcgttcgttatcatgtcacatttggaaagtagtggtatgttttctgtaatgggtgacccatagatcacaagcattcttagaattatttcatgctgtttgtctgccatttttttgtaccatagttacatgctccatcagtaaatgatcaaattattgcaacattcttccaggatgtaaatgttttagtctttagctggtttacttagagattactttacatttagatgcttacttagagatgctttatttagagattgccattacagaaaccttgggtagatattagctatacataccactcaggattaactatttatttctacgataggggataagttctgtccacacacccccagctaacccccaatactcatgccttttatatgtaaaagtataatatgagctagtcataaattttctacttacttccttatgttcttctcaaatatcagtttctattagttcttttggctagactggacatttgatacttttattttttttaccatatccatatttatttcatcagtttggattgttttctattattctgcttttctgttgaaataaagttctgtttacaggttgttcaacacatcagccttgatgtcttttataacatataaaacaggaatagattatattcctgttgcctcacaataacataagcaccagtgattttgataatagaggcatttattgtcatctattgacattctttgggtttatttttttcccttttgttttagccatttttattttctaaaataaaacttttctctaagtaccactttagatatatcctataagtctttaaatgtaatattattaatcatatataattttcattaatatttagtttgagatattttctataattcctattataattctcctttgacccattagttatttagacatgtgctttctaatttctaaacattttcatttttattatttgtgttattattattaataaaagatgggtcttactatgttgcccaggctggtcctaagcttctggaggcctcaagtgatcctccctctttggcctcacaaagtgctaaaattataggtgtgagcaaccacacccaacctcaatttctaagcatgttttttatgatggattttaaaattgtagccagagaatatgacataactagttctacaaaatctactgagatttgctttataatcagtgcagagccaattaccatagcattctaagtgtgcttgggaagaatgtacattttcttttttttttttttttttttgagacggagtctcgctctttcgcccaggctggactgcagtggcgctgtcttggctcactgcaagctccgcctcccgggttcacgccattctcctgcctcagcctcccgagtagctgggactacaggcgcccgctaccatgcccggctaatttttttttgtatttttagtagagacggggtttcaccgtgttagccaggatggtctcgatctcctgacctcgtgatccgcccgcctcagcctcccaaagtgctgggattacaggcgtgagccaccgcgcccggccgacattttctaattgttacataaaggtcaaacttgaaattgtgtttttcattttgtatggtttaaattgttgctaattttttgttctgatatttcaattcttagagaagcgagttaacatttctcttataatggattttcctttgtaattctgttcatttttgttttatgtattttaaaaaacaaataggtcagggtagttgatggtgttttccagattccctgtaattgaactgatacttgtctagtgctatcaattgctgagagagtgctattaaatttcctaatatgattatagaagtgcacgcttctcagtttaattctgcccatttttgctttatttattttggggatctattattaggcatccattacatatcctataaagagcatagtccaccttttgtatacacagattcttcacccaaagattcaacaaaaccaaagatcaaaagtgttctgagaaaaaaaattaaaaatacaaaaatttaaaataatacaaataaaaagaaacaatacagtatcacaactatttgcatagtgtcacactgtattgcatataagtaatctagagatgatttaaagtatacaggaggatgtatgtagattatatgcaaatattatgccattttatataacagacttaagcatttgtggatttgggtataggagggggagtcctggaatcaacggatactgggaataaccatagttgagtcttgtgcttttatctagtcagagttcaatctattaatattaaatgtaagtactgatgagattgaattttggcctaccactttattatttgttttgtgggtcccgtcatatttttccctctttcctctttttgccttcttggaggttatttcaatattttctagtagaattccattttaatttaaatattaatctaagcattttattttcacatattttttattggttgctccagggattacaatatacttccttaactattcaaagcctattagagctaacattgtaacacttcacataaaatttgcaaatcttgtaaccatgtagatctatttctcttcccctactgtcctttacgctatggttatcatatagtacatccaaatatattgttataatttttgctttaaatcatcatgtctttttttaattaagaggaaaaacagtcttttgaattttctttgctatttatcattttcatttgttcctgaagatacaagaacattatttaatttttcttgtaggcctagtggaaatgaattcacatagcttactttatctggaagttcagttttgttttgttttgcttttgcttttttttttttgctttccttttttggaggccatttttcctggatttagattcctgaagtgacactttgtgtgggcatgtgtgttttggttttaaggtgatgaacactttacatgatcttctgccttccataatttctgaatgaggaatctgtagtagcttgaattttgcttcctctttatataatgtgtcacttttctccaattgctttcaaaattttgcggggtatcttttattttcagcaatttgactactttatgtctaggcttggtttcttcaagttcattctgttaagggttctaccaagattctcatatatatatatatgatatataatttgctggatcatcagctgttttactcaagattagcactgttgatggcattgttcttatagctggttgctgctgttgctgcaaacatcgatttttcctattcaatgatttcaaatatgtatttatggtttcaaatgtgtatttttcaattgcagtgctaccagttacatatgcaatcatacacacatacatatacaacacatatctatatatatgacattaaaccaaatcctatcaaatacttaatagtgaaaattttgctcagaagcaggacaggggtgtccacaattaccgcttttatttaatattttcctggaaatactagccaatattattagacttgaaaatgaaatatgatatttaaaaatttagaaagagtattcaaaattttagtttcttatgatgcaattagacaacacaaaacaaaaatgaattaggaaaactattacatgtaacagtagaattctgtacacaaaacaaacaaaatataatggatgaatagaaccattttagatcacagcacccacaagaatacatgggaataagccttaatgtacatgtgaagtattatttctaatacagaacatacaagagaaaacttgaataaattaaaaacatatcatatgtatgcatactaaattcaatggtatgaagacgttgatttcccacatattactttgtaaattcagtttgttcccaagaaaaataattacagggttttccctgacaaaaatgtgcaatggggaaagggttccctatttaataaatggtgctgggaaaactggctagtgatatgcagaaaactgaactggactccttccttataccttatataaaaatcaactcaaggtggattaaagacttaaacgtaagacctaaaaccataaaaaccctagaagaaaacctaggcaataccattcaggacataggcatgggcaaagacttcatgactaaaacaacaaaagcaatggcaacaaaaggcaaaattgacaaatgggatctaattaaactaaagagcttctgcaaagcaaaagaaactgccatcagagtgaataggcaacccacagaatgggagaaaatttttgcaatctatccatctgacaaagggctaatatctagaatctacaaggaatttaaacacatttacaagaaaaaaatcaaacaaccccatcaaaaagtaggcaaagaatatgaacagacacttctcaaaagaagacattcatgcaaccaacaaatatatgaaaaaaggctcatcatcactggtcattagagaaatgcaaatcaaaaccacaatgagataccatctcacaccaattagaatggcgatgattaaaagtcaggaaacaacagatgctggagaggatgtggagaaataggaatgcttttacactgttggtgggagtgtaaattagttcaaccattgtggaagacagtctggcgattcctcaagaatctagaaccagaaatagcatttgacccagcaatcccattactggatatatatccaaaggattataaatcattctactataaagacacatgcacatgtatgtttattgtagcactattcacaatagcaaagacttggaaccaacccaaatgtccatcagtgatagactggataaagaaaatgtggcacatatacaccgtggaatactatgcagccataaaaaagaatgagttcatgtcctttgtagggacatggatgaagctggaaaccatcattctcagcaaactaacacaggaacggaaaaccaaacactgcatgttctcactcataagtggggaattgagcagtgagaacacatggacacagggaagggaacatcacatagtagggtctctcggtggatggggggcaaggagagggaaagcattaggacaaatacctaatgcatgccgggcttaaaacctagatgatgggttgatgggtgcagcaaaccaccatggcacatgattacctatgtaacaaacctgcactttctgcacatacatcccagagcttaaaatttaataaacaataaaacagaaaaataattacagggtttttaaaattagatgagcaaatatgtagcaaagataaacacagtatgaaaattatttaaacaagaagtactggttaattacaggcagtttggaaggtttgatgccctgaatgattcttactgaaataaataaaacgttgaatatatcatgtttttttttttaattttaaatgtcactgagatggtaagcatgagaataaggaatctaaagactccaaaagagaatgttaaactagaaactctgagagataagtgacgatagattttgttctaaattttctgctatactttggagagcttaaactttgttctttaaaaaacaggtttattggggtatagttcacaacagcaatttaaagtataagcttcaatgattttttaatatattcatagttgtgcagtcatcaacacaattcttttaatcgtttaataaatttagaacattttcatcactccccccaaaaaccccatacccactagcagttcatttccatccccactccttcatccctaggaaatcactaatctttttctatctctttataactccattaaaaaatgagtgaaggatctgaatacacatttctccaaagaacacataaaaatggccaacacgtatgtaaaaaggtgctcaacatcatttatcatcaaggaaatgccaatcaaaaccactatgagaaatcatcttacacctattaggatggctgttatcaaaaagaaatcatctcacacctattaggatggctgttatcaaaaagagataacaaatgttggcaggtatatagagaaaatggaatctttgtaaactattggtgagaatgtagattggtacagtcattatggaaaactaatagggtatggaggttcctaaataaattaaaaatagaactaagatagaaacccagcagtttctcttataggtatatacccaaaggaaatgaaatcaccaccctataaagttatctgcactcccatgttcatgacaatattcacaatagccaagatatggaaacagcctaagtgtctgttgactgatgcatgggtaaagaaaccaaggtatttaaatacaatgtaattttatgcagccttaaaaaggaaagatatcctgtcatttgccacaacatagctgaacctggaggacattatgctaagtgaaataagctagacacagaaggaaaagtattgcattgtctcacatgtgaaattttttttaaaaagtcaaatatactgagagaataaaacagtggttaccaggggcaggagagcctgggggagaaaacagggagatgtaggtcagaggatacaaagtagcagatatatagaagaaaaagttgaaatctaatccacagcataaggactaaagttaataaaattgtatttgagatttctgctaagaattttagctgtttttgccaccaaaaaaatggttaaatatgggagatgatggatatgttaacttgcctcactatagtaacatgtttaccatctatgtacattccataacgtcatgttgtataccttaaatatatacgataaaatttacttttaaaaatgaagtgtttcggctgtaggtaaggttaaaaaaagtgtatgctttaaaagtttggaagttcctttagtttatatatgaatgttttttcatcttttgctaatctctgaatgcctccattacacccacattattgaaagatgttttatctgcatatatataattccgcattgggaactattttcccccagcactatgatgatattatacaatgtttgccaggctaccattttattgttggaagtgttcagtcacacaattttcattcttttgtggtgattcatcctttctgtgacttctattacaattttatccgtacctttgatgttttatgatttcattgaagtggtttaggttggacatctctttccttatcctgcttttgttgtaggaaaaactggttcttataacacgaccatgaaatgttaggctcgcagacactttgaagggtgagaagagcagggtttattgggtgaaaaggaaaaaaagggaaacaaggactctcagcaaagcgagagtcctgctaacaggcttcctgtctcacagattggaccccaggttaccactcccaaacagaagaggtcaggctcctccccactgcaaatggtgcgaacttcccgaggctccaccccagtgtgcattcctcccagtgggcaggccggttggagattctccgggcacccctttatacttggcttgtctcattttggaatacattgggtttttttgatttatagatttatattttttatttgttatgaaaagttaccgctattttctctttaaatatcgcccctgttccattctattctcaaatgtattttagacatattaagattttcacttttttttttctttttttgagacagggtctggctctgtcacccaggctggagtgcagtggtgtgatcccaccacagaggtgtaacctctgcctcttggactcaagtgatactccctcctgagtagctgggactacaggtgtgtgccaccacacccagctaatttttatactttttgtagacacaggttttcgaatgttgcctgggctggtctcaaattcttgggctcaaatgatccttcaacctcagcctcccaaagtgctgggattacaggcatgaccaccgttcctggctttcatatatttcaatataatgtttgtttctgtctccttgcttttctgtactgcattctgggtaatttttttcagatataacttctttcactaattttctcttcagctatgtatattctgctttttgtgaaattaattttcttaatttctataattagtttttgtttctaaagttaattttgcagattataattttacatattcataatttgcaaatctaataatcttttggtctttgggataatatcctttatttctttaatcattacatacacatgtcttctatattctgggtcctactattctaatgtctgcatttattggaagtataaagctgtttactgtttctgctgatttttatcatagtgtctaacttccttttagtgtaatgatattgggttgaaaggtcattgctcaatattaatacatagagtaggattagattgaggattttgaaagtttttcagagagagtcttctcttgcttctctgacttacttagagatgaaacgacaaaatatctgcaacttattctcaaatagctcagaagtgaaataatagcatataaagagaaagaatatgataaggcaattgtggaaataaagaactagagaacttgggtaaatgatatagaagagattttttaagtaaattttccttaattctatatcaaaataaaactgttcagaaaaaaaacgaaggagcctaaaaatatgccagactagaattagcagtcttttgaggataccatttctgaaataaaggaggatatgactcttggagtccaagtggtaaagagaaacaaggaagcaagcattgaaaatagagggtcctccagaaacaaaagaaaattacaaaatcagaacacatatcaacacctccacacacacataaatgaagtacaattaataaaactgtactttgccaaaatgagaagttgctctaaacctaagaaatatagtaagctaacctaactgcttatgtgttaattctgttccataaagaatacacatttcaaattaacaaccattggaatccatcctcatataaagatggtataaaagaaaaaagtaaatagaaaataaagatattttagctgctaaaaattctcatcaaaaacaacaacaggtagtttagatttcaccttctagatgtagacctggaaagagtatagatcccactttagggaagtggcgtctgcaatttttctgaggcttgagtaggctgttttcccctcagagtgtaaacaaagccaccaagaagttcaaactgggtggagccctccttaactcagcaaaacatctgtagccagactgcctctccagattgcttctctctgggcagggcatctctgaaaaaaataagacagcagccccagtcaggggcttacagataaaaccctcatctccctgggagagagcacctgggggaaggggtggctgtgggtgcagcttcagcagacataaacatccctgcctgctgactctgaagaaagcagtggatctcccagcacagcgttcgagctctgctaagggtcagattgcctcctcaagtgggtccctgacccccatgcctcctgacttggagacacctcccagcaggggccaacagacacctcatacaggagagctctggcaggcatctggtgggtgcccctctgggacaagcttccagaggaaggaccaggcagcaatcttcgctgttctgcagccaccactggtgatacccaggcaaacagggtctggagtggacctccagcaaactccagcagacctggagaaaaaggccctgactcttagaaggaaaactgacaaacagaaaggaagagcatcaacatcaacaaaaaagacacccactgagaaaccccatctgaatgtcaccaacatcaaagaccaaaggtagataaatccatgaagatggggagaaaccaggacaaaaagactgaaaattccaaaaaccaggatggctcttcttctccttctccacatgatcacaacacctcgctagcaagggaacaaaacttgatggagaatgagtttgacaaattgacagaagtaggcttcaggaggtgagtaataacaagctcctctgagctaaaggaggatgttccaacccaatgcaaggaagataagaaccttgagaaaaggttagaagaattgcttactagaataaccagtttagagaagaatataaatgacctgatggagctgaaaaacacgacacgagaacttcgtgaagcatacacaagtatcaatagctgaactgatcaagtgtaagacaggataacagagattgaagatcagcttaatgaaataaagcgtgaagacaagattagagaaaaaagaatgaaaaggaatgaacaaagcctccaagaaatatgggactatgtgaaaggaccaaacctatgtttgattggtgtacctaaaagtgaaggagagtatggaaccaagctggaaaacactcttcaggatattatccaggagaacttccccaatctagcaaggaaggccaacattcaaattcaggaaatacagcgaacaccacaaagatactcctcgagaagagcatccccacgacacaattgtcagatttaccaaggttaaaatgaaggaaaaaacattaagggcagccagggagaaaggtcaggttacccacaaagggaagcccattagactgacagcagatctcgctgcagaaatcctacaagccagaagagagtggggaccaatatgcaatattcttaaagaaaagaattttcaacccagaatttcatatccagccaaactaagcttcataagcaaaggagaaataaaatcacttacagacaagcaaatgctgaaagatgctgtccccaccaggcctgccttacaagtgctcctgaaggaagcactaaacatggaaaggaacaatcagtaccagccactgcaaaaacataccaaattgtaaggatcatccaccctctgaagaaactgcatcaactaacaggcaaaataaacagccagcgtcataaagacaggatcaaattcacacataacaatattaaccttacatataaacgggctaaatgccccaattaaaagacacagactggcaaattggataaagaataaagacctatcagtgtgctgtattcaggaaacccatctcaggtgctaagatatacataggttcaaaataaagggatggaggaatatttaccaagcaaatggaaagtggaaaaaaagaaaaagcaagagttgcaatcctagtctttgataaaacagactttaaaccaacaaagatcaaaagagacaaagaagggcattacataatggtaaaggaatcaatgcaacaagaagagctaacaatcccaaatatatatgcaaccaatacaggagcacccagattcataaagcaagttcttagagacctacaataagacttaggccccacacaataatagtgggaggcttcaacactctactgtctatgttagacagatccatgagacagaaaattaacaaggatattcaggacttgaactcagctctggaccatgcagacttaatagacatctacagaactctccaccccaaatcaacagaatatacattcttctcagcaccacactgcacttattctaaaattgaccacataattggaagtaaaacactcctcagcaaatgcaaaagaacagatatcataacaaacagtctctcagaccacagtgcaatcaaattagaactcaggattaagaaactcaatcaaaaccgcacaactacttggaaacttaacaacgtgctcctgactaccagtcagtaaataatgaaattaaggcagaaataaataagttatttgaaaccaatgagaacaaagacacaacatagcagaatctctgggacacagctaaagtagtgtttagagggaaatttatagcactaaatgcccacaggagaaagtgggaaagatctaaaattgacaccctaacatcacagtaaaaagaactagagaagcaagaggaaacatattcaaaagctagcagaagacaagaaataactaagatcagagcagaactgaaggagacagaaacatgaaaaacccatcaaaaaaatcaatgaatctaggagctggtttttgaaaacatcaacaaaatagaccgctagtcagactaataaagaagaatagagacaagaatcaaatagacacaataaaaaatgataaattgtatatcaccactgatctcacaaaaatacaaactaccagcagagaatactataaacacttctatgcaaataaaatagaaaacctagaagaaatggataaattcctaaccacatataccctcccaagactaaaccagggagaagtccaatccctgaacagaccaattacaagttctaaaattgaggcagtaattattagcctaccaaccaaaaacaacccagcaccagacggattcacagccgaattctcccagggtacaaagaggagatggtaccattccttctgaaactatttcaaacaatagaaaaagagggaatcctccctaactcattttatgaggccagcgtcatcctgataccaaaacctggcagagacacaacaaaaaaagaaaatttcaggccaatatccctgatgaacatcaatgcaaaaatcctcaataaaatactggtaaaccgaatccagcagcacatcacaaagcttatccaccatgatcaagttggcttcatccctgggaagcaaggctggttcaacatatgcaaatcaataaatgtaaaccatcacataaacagaatcaatgagaacaaccacatgattttctcaatagatgcagaaaaggccttcgatgcagaagaggactttgataaaattcaacaccccttcatgctaaaaactctcaataaactaggaattgatggaacgtaacttacaataataagagctatttataacaaacccacagccaatatactcaatgggcaaaagctgtaagcattccctttgaaaactggcacaagacaaggatggcatctctcaccactgctattcaacatagtgttggaagttctggccagggcaatcaggcaagagaaagaaataaagggtattcaaataggaagagaggaagtcatattgtctctgttagcagatgacatgattttatatttagaaaaccccatcgtctcagcccaaaatctccttaagctgataagcaacttaagcaaagtctcagaatacaaaatcaatgtgctaaagtcacaagcattcctatacaccaataatagagagccaagtcatgagtgaactctcattcacaactgctacaaagagaataaaatacctaggaatacaacttacaagggatgtgtaagacctcttcaagcagaactacaaaccactgctcaaggaaataggagagaacacaaacaaatggaaaagcattccatgctgacggataagaagaatcaatatcgtgtgaaaatggccatactgcccaaagtaatttatagattcaatgctatccccatcaagctaccattgactttcttcacagaattagaaaaaactactttaagtttcatatggaagcaaaaaagagcctgtatagccaagacaatcctaagcgaaaagaacaaagctggaggcatcacactacttgacttcaaactatactacaaggctacagtaacccaaacagcatggtagtggtaccaaaactgatatatagaccaatggaacagaaccaaggcctcagaaatagcacgacacatctacaaccacctgctctttgacaaacgtgacaaaaacaagcaatggggaaaaaattgttttgggaaaactggctagccatatccagctaactgaaactggaccccttccttagacattgtacaaaaattaactcaagatggattaaagacttaaatgtaagacctaaaaccataaaaaccctagaagaaaatctaggcagtaccattcaggatgtaggcatgggcaaaacttcacgactaagacaccaaaagcaatggcaacaaaaggcaaaattgacaaatgggatctaattaaataaaagggcttctgcacatcaaaagaaactaccatcagagtggacaggcaacctacagaatgggagaaaatttttgcaatctatccatctgacaaagggctaatatctagaatctacaaggaacttaacaagtttacaagtaaaaaacaaccccatcaaaaagtgggcaaagggtatctacaggtacttctcaaaagaagacatttatgcagccaacaaacatatgaaaaacagctcatcatcactggtcattagagaaatgcaaatcaaaaccacagtgagataccatctcaggccagttagaatggcaatcattaaaaagtcaggaaacaacagatgctggagaggatgtggagaaataggaatgcttttacactgttggtgggagtgtaaattagttcagccattgtggaaaccctgtggtgattcctcaaggatctagaactagaaataccatttaactcagctatcccattactgggtgtatacccaaaggattttaaatcattctactataaagacacatgcacatgtatgtttattatagcactgctcacaatagcaaatacttggaaccaacccaaatgtccatcagtgatagactggataaagaaactgtggcacatacacaccatggaatactatgcagccataaaaaaggatgagttcatgttctttataaggacatggatgaagctggaaaccattctcagtaaactaacacaagaacagaaaaccaaacaccgcatgttctcactcataattgggagtcgaactgtgagaacacatggaaacacagggaggggaacatcacacaatggggcctgttaggggatggggggctagcagagggatagcattaggagaaatacctaaggtagatcacaggttaatgggtgcagcaaaccaccatggcacgtgtatacttatgtaacaaacctgcacgctttgtgcatttatcccagaacttaaaatataataataataataataataataataatgataatagaatagtgctctcacttcagtaacaacaaaaaatgctggacaaactttaaattaacaacttttattaaacttatcagagaactcaggttgtagggcaaacaactatagtttactttcgaacaacatgagtgtgaggggcaccaactccccaccatgcagtaaaaaatctatgtataagttttgactctccaaaaacttaacaactaatagcctactgttgaccagaagctttacaaataacataatcgattaacaactattttgtgtattatatgtattatatactgtacccttagagaaaagaaaatgttattaagaaaatcataaggaagagaaaatacatttagaatactgtactgtatttatcaatatcataagtttgtgttatctctttacaagatgaatcgtgtctgaaatggtggacaactgcagctgcagaccttgatttataatatacaccatgcaattcagttttttctcataatgtcatgacttttttctgcttgttaggaacatttccagcatcagtagtggcactttgtatgggttccatgacgcaatttaaggtttttgatattgcactaaacatgatgaaaaatatgtaagaaccggagggatcaccttttactgtgatatgcaatatgctggagagatgaactgctcatactgagatgactagggtcacatggcattttaagcagatatttgcaacacttgagcttgctgcaatagcaataggaggtggctttgaaattatttcagagttgtagtgtggattatagttaatattataccgttatggtttaatactgcatctttacagttttttgcatttctcttgactgcaaatggcacctgtacattctgtaaatatttgtgtatataagttttaataaattttaacttctatgatagatttgtatatattttatggtagtaaatgataatatagactagtatctatatattttctacatattcatggcatagcttttccttagttttttctgatattttaggctaaagctgtttgtctgcctgttttttcagattgtcttaaatctccaaaaacttccaatatacttatagaaaaaagtttgtgcataagttggcccatgcagtctaaacccatgttactgaaaggtcaactgtaatttgaaatctggggagagaaaggtgccaatttgggagaaacaagacctgaatcttcgcttgcttagggcggacacccttggaggccactaaagccaatagaaagattttgcaaaaatttttaaatgaatttctgaaagttgaatatggactaatatgaaggtataaagccccctggggctacagacataaggtctttgtaccgtctttcagcattttcctccatgaccttaccaaccaaccacagggaaaatcagagtcaatccagggaaagcttccttcagggttcttgctggagaaaggaaacagcagccaaagccaaatgtcctctatttattttattgacaaaagcctgtagaggaagaagagtaacaaaactgtcaatttagggcactggatgaaattcactgagctggggaaagggaacaggaaaaaaaacccagacaaccctacctttagaggaatggaaggaatatatgccaggcctgcacaactactggaagagggagagaaacacttttgaagtttatcctgcaaagaaactgtgttcacagtacaaataagagaacactgtatctactgtccacacaccagtttgccaaaatttaaactatatgacatgtaacaaggaaaaataacaatagatacaactggacaaactgtaggagacagattctctctggggaacaaagactgagaaaaaccctctggcaaatagcccatgccctaaataccagacatctctagagaaatttgaaggtttggtgcactgaaggtaaccatagcaacaataaactccaaacccactgtaactactggctagattaatgctaacacccacactaaaggcctagaaaaaaatatgttcatctccaagcataaaaatatttatctccatatctcttgtcctgtacatgttcaacattccacataaatttatgaggcatatgacaaggcaaacacacacagtctcaagaggcaaagcaagcatgctgatacattttaaattttaagttttaaaatgtaaattttaaaccctgggacaatcactaaaagtttttcaagtataaatgttaagtaaatagtggagatgaaatagaaccattaaaatgctcaattaaacccatagaaggcagaaaaggagggaaaaaagaaataaagaacaaatagaaaataacaaatatggtagattttaaatacaagtatatcaatattcattttaatgcttaaacatgccaattaaaagacagtgattctaacattcaattttgaaaaaagcaagactcaactacatgttgtctacaggaaacaaactttaaatacaaaactatagataagttgacagtaaaaaaaaaaaagatatagcttacaaatgccaaccaaaagaaagctagtgtagctgtactaatttcaacaatgtagatataaaggaatattattagagacaaagagtggcataacccaataataaaataataataaaggcatttctcaagaagacataataatgctaactgtgtatgtacctaagacagctcttcaaaatacatgagacaaaaatttatagatctgaaaggagaaatagacaaatccacagctatatttggaaacttcaaaactaatctctctgtaattgatagaacaagtgggcatgatattggtagcctgaaccctatcaactgattgacctaactgacatatatagaacagtcaacacaagagtagcagaatgcacaccatttttttaaaagtggaaatgggacactaatccaaatggattagaaaagatctaaaatcagtaagcaaggcttacttaaaacaagaagatgaaatcaaacccaaagcaagaataaagaaagaaataaggattgtagcaactgtcaataaaattaaagacaaaaagaaaacagataatcaatgaaaccaaaagagagttctttgaaaaggttaaaatcaataaacatctagccaaactggccaaaaaaaaaaaaaaaaaaggtgaagtattgaaaaactgtcatttaacactcccaaaataacaagcattttcagatatgaaaagtaatctcaaatcaaaaatttaaaaattatgacagaaatgggcaacaaaaccttaggaaatatgaaataaaaatcaactgacttcaagaaagtaagtcaataaaaagacaaaatcatctcaaaaataaagataaaattacaaagaacaaatgttctcatctaacaacccaataagggtgactgagaaaaggcatgagaacaaccaataaaacaaacatgaaatgaaggagtttttttaaaaaaaagcagagcagaaagtaataaatatagaagatcagcaaagaaaatataacaaaagtttaattgaagtatctagaaagaagaacaaagcactaaacagaagtaatatttaaaattataattgagatagctttttgtaaataaaaactctgaatctgtatatttgaaagacctactttgtgtctgggaaaattggtaactcattttttaggaaatttctacttttaagacaaaggggaaaaaaatctgctaggccaatatgcaaaaactagatcatttataaaggaaaaaatatgggtggcatcagaattctcacccacaatgaagcatcacaacatatattaaatataacaacgaacaaaacaaagacactgtaaaataatatggcatggctgagcccacgtcatcaactataaccataagtttagataggcttaattcacctactaaaataaaaatatgtttactttttctcatcaaagaacacaatcaacaatatgaaaagacaactcactgagtggggaaaaatatttctaaattatatatctcataaagggtgaatatccagaaaatgtaaagaattcctacaactcaacaacaacaactacaaataactgaatttttaaagtaggcagccaatttgaatggacatttcttcaaagaagatatgccagttagccaattagcacatgaaacgatgctcaacatcaccaatcattaggaaaatgtgaattaaaaccgtaatgaaaataccacctcacatccattaggatgattactgtcaaaaacaaaacaaaacaaaaactagaaaataacaaatgttagcaagaatgtggagcaactggaacatttgtgcactgttggtgcaaatttaaatgatacagcttctgtggaaaacagtatggtggtttctcaaaaaaattaaaagtagacttactatttgatctaccagtttcacttctgggcatatgcccaaaagaaaggaaagcagtgacttgagatatgtgtatactcatattcattgacacgttattcataagagccaaaagaagcaagcaactgaattgtccttcaacagatgactggataaacaaaatgtggtatatacatcaaatggaatatgattcagctttgaaaaatagggaaattctgaacatgctacaacatggatgaaccttgagaatattatgctaagtggagtaagccaggcacaagaagacaaatactgtatgattccatttatataaggtacctatactatcaaattcacagaggcaaaaaggagaatggtggttgccagaggttaaggaaaaaggggatataaagagttattgttaatgggttcagagtttcagttaaggaagacaaaaagttctggagattaatggtggtgattcttgcacaacaatgtgaatctacttactgccactgaactgtacactgaaaaatagttgattttaaattttatcttagttgtattttactacaatttaaaaaactacattttctagtctcccttacaggtaagttggccatgtttccgtgttccagtgagtgaaagatgatggcacattacatctgttgaaatacatatggaatattttttaattggctatatgttaaataacaaggaaaatcttaataaattttataaagtaggcatgataaagcatcttttgatgacactgaagtacaataaaattaatttaaaaaataaatgatcttctactggtttatataaaaactctttttaaaacaacataaaataaaaggggaaacaagtttgcagagtgtgagatggggagaatctgcctctgaatgcacatctccactggggaatctgaaaatccagatcacaggagaaggctttaaccttacctggagctggaatggatttagggaatggtgcaaaatatgaaagtagaagtagcattgagaagagccatataggcattctcagtctccagctcaagcccagggaagccatccctgactatatcttacaggcaccctgagggaaggcagccagcagaattagggaagagtcaggcagccagcagaattagggaagagtcacagggtgaaagaagcttccagcagaatcttgttttaatttatagtgggaataaaccccctttaaaagaatctgtggcacaaatgggaactgtggcagatacgagcacaggtgtgggcacttggcattacaggaagatggggaggggcatggcctgaaagctgtgcttgctttctcagtgggaaagcttatgacctggggcaggtgctcaccaaaggatacctccccacatcaactgagtaaattaaaaactggagaaaaagaaaataaataaataaattgtacaccatgagagaacgagataagcttcaagagatccctgccattccaattccataggagacagtgaactcacccacacaccaagaacataactacaataaccaacatcaggaaaagccagtgcacagagactttataactaaggaactgatacaaagtcttcacctctaaagcataaaaaatcaaaataggcaaaaataaacataaaagtatgatccataagagggaaaaaaagtaattctaagcaaaaaataccgtacataaacagtccagtcaaaaattcaaaaacaatttgaagacataatctacccaaatgagaaggaaccaagaagtaattctgataatatgacaaaacagggttctctaatacccctaaatgatcacactagctctccagcaatggatccaacccaagaagaaatctctgaactgccagataaagaattcagattgattattgagctactcaaggaaataccagagaaaggtgaaaacgaacttaaagaaattaaaaaatatatgtaggatatggatgaaaaattttccagataaatagatatcataaagaaaaaacaatcacaacttctggaaatgaaagacacacttagggaaatacaaaatacagtagaaagtttcaacaacagactagaacaagtagaagaaagaacttcagagcttgaagacaaggctttcgaattaacccaatcagacaaaaacaaagaaaaaagaattttaaaagatgaaccaagtctccaagaaatataggatcatgtgaaatggccaaacctaagaataattggtgttcctgaggaagaatagaaataaaaagtttggaaaatttatttgaaggaataattgaggaaaactttcccggccttactagagatctagacatccaaatacaagaagctcaaagaactcctgggaaattcatcacaaaaaagatcatcaccaaggcacatagtcatcaggtggtccaaagtcaagatgaaggaaagaatcttgagagctgtgagacaaaagtatcaggtaacccataaaggaaaacctgtcagattagcagcagatttgtcagcagaaactttacaagccagaaggaactggggtcccatctttagcctacttaaacaaaatacttgttagccaagaatttggtatccagcaaaactaagcttcattaatgaaggagagacgtaaagtctttttcaaacaaatgctaagagaatttgccactactacaccagcagtactggaaatgctaaaaggagttttgaatcttgaaacaaaacctcaaaatacaccaaaatagaaactccttaaaccgtgaagctcatagggcctataaaacaataatacaatgaaaaaacaaacaaacaatgtatttaggcaataacttacataatgaatagaacagtacctcaccagctgggcacagtggctcaggcctgtaataccagcactttgggcaggccgaggcaggtggatcacttgagttcagcggttcaagaccagcctgaccaacatggtgaaaccccgtctctactgaaaatgcaaaattagctaggcatggtagctcatgcctgtaatctcagctacttgggaggctgaggcaggagaatcacttgaacctaggaggtgcggttgcagtgagccaaaatcgtgccattgcactccagcctggacaacaagagtgaaactctgacttgaaaagaaaaagaagagaagacaagagaagagaagagaaaagaaaagaaagagaaagagaaaagaagagaagagaaaagaagcagagggtaagggagggaaggggaggggagaaggaaaggaagaaaggaaacagtacctcacatctcagtactaacattgaatgtaaatggcctgagattgtgccattgcactccagcctgggcaacaagagtgaaactctgtcttgaaaagaaaagaagaaaacaaaagaagagaaaagaagagaagagaggagaaaagaggggagggggaggggaggggagaggagaggagggaacagtatctcacgtctcagtactaacattgaatgtaaatggcctgaacctgggaggtggaggtatcagttagctgagatcgtgccattccactccagcctgggcaacaagagtgaaactccatcaagaaaagaaaagtaaagagaggagaggagaggagaggagtagtacctcacatctcaatactaacattgaatgtaaatggcctaagggccccacttaaaagatacaaaatggcagaatggataaaacctcaccaaccggctgggcgcagtggctaacgcctgtaatcccagcactttgggagaccaaggtgggcagatcacttgagatcaggagttcaagaccaacctggccaacatggtgaaaccccttctctactaaaaatgcaaaaattagctgggcatggtcgtagatgcctgtagtcccacctactggagaggatgaggcaggagaattgcttgaacccaagaggcagttggaggcttcagtgagctgagattgtgccactgcactccagcctgggcgatagaatgagaccctatctcaaagaaaacaaaaaacaaacaaaaacaaacaaacaaacaaaaaacaaccaagtgttcaccatctttaagagattcacctaacacataaggactcacataaacttcaggtaaaggggtggaaaaacatattccatgcaaatgtaaaccaaaagcaaacaggagtagctattcttatatcagacaacatagacattaaagcaacaacagttaaaaaaaaaaaaaagaaggaaaatactacaatcctaaatatatatgtacctaacactggtgctccaaaatttatgaaacaattactactagacctaagaaatgagagagatggcaacacagtaatggtgggagacttcaatactccactgacagcactacacagatcatcaagacagaaagacatcaaagaaacagtagacttaaactatatgctagaccaagtggacttaacacatatttacagaacattcaacccaagtgcagaatatacattcttctcatcagcacgtggaacattctccaagatagaccatatgataggccacaaaataagtctcaataaatttaagaaaatctaaatcatataaagtatagtcttagactatggtggaataaaactggaaatttattttaaaaggaatcctcaacattaacaaatacatggaaattaaataatctgctcttgaattatctttgggttaataaggaaatcaagatttaaatttagaaattatttaaactaaatgataatcattacacaacttatcaagacctttgggataaagcaaagctgtgctaatagaaaaagcttacagcattaaatgcctacatcaaaaagtctgaaagagcacatctcaaggaactagagaaacaagaacaaactaaatccaaacccagcagaagaaaagaagtaacaaagatcagtgcagaactaaatgaaattgaaacaaaaaatatgcaaaagataaatgaaacaaaaagctggttctttgaaaagatacacaaaattgatagaccattagttagattaaccaagaaaacaagagagagcatccaaacaagctgaattagaaatgaaaggagagatattacaaccgataccttagaaaaacaaaagatcattcaaggctactattaatgacagaccaatatccctgatgaacatagatgcaaaaatccttaacaaaatactagctaaccgaatttaacagcatatcaaaaagattacacatcataatcaagtgagtttcataccagtgatgcagggatagcttaacatacatgggtgaatacatgtgatacatcacataaacagaatttaaaacaaaaattggtggggaaaaagtacttgacaaaatccagcatcccattaatatgaaaacactcacaaaattggcatagaaaggacatatgtcaaagtaataaaagccgtctaagacaaacccacagtcaacgtcatactgaatagggaaaagatgaaagcattcgccctgaaaactagaacaatacaaggatgcccactttcaccacttctagtcagcataataccggaagtcatagacaaagcaatcagacaagagaataaaatgaaaggcatccaaattggaaaagaggaactcaaactgttgctggacaccaatgatatgattgtatacctagaaaaccgtaaagactaatccagaaagttcctagatttgataaatgaatcagtaaagtttcaggacaaaacaaatcagtgtacacaaatcagtagcactgatatacaccaacagtgaccaagctgagaatcagatcaagaacacagccccttttacaacagcaagcaagcaagacaaagagagaaagaaaaattgaaagaaaggaagaaagaaagaaagagaaaggaaaagaaaggaagggagggaggaaggaaagaaagaaaaaagaaagaaagaaggaagggagggagggaggaaggaagcaaggaagggcaaggaaacgaaagcaaggaaagagaaagtctcctcaagtaggtccctgacccctgtgcctcctgactgggagacagcttccagcaggggttgacagacacctcatacaggagagctccagctggcatctggcaagtgcccactaagatgaagcttccacaggaaggaagagacagctatctttgctgttctgcagcctccgctggtgatacccaggcaaacagggtctggaatggacctccagcaaactccagcagacctggagaagaggggcctggctgttagaaggaaaactacaagcagaaaggaatagcatcgacaccaacaaaaaggatgtacacccaaaaaccccatacaaaggtcaccaacatcaaggaccaaaggtagataaatccatgaagatgagaaaaaaacagtgcaaaaaggctgaaaattcaataaaccagaatgcctcttctcctccaaaggttcacaactccctaccagcaagggaacaaaactggacagagaatgagtttgatgaaccgacagaagtaggcttcagaagatgggtaataacaaactcctccaagctaaaggagcatgttctaacccaatgtaaggaagttaagaaccttgaaaaaagttagagaaattgctaactagaataaccagtttagagaagaacatacatggcctgatggagctgaaaaacacagcacaagaacttcatgaagcatacacaaatatcaatatccaaatagatcaagcagaagacaggatatcagagattgaagatcaccttaatgaaataaagtgtgaagacaagattagagaaagcagaatgaaaagaaatgaacaaagcctccaagaaatacgggactgtgtgaaaagaccaaatctacatttgattggtgtacctgaaagtgatggggagaatggaaccaagttggaaaacactcttcaggatattatccaggagaacttccccaacctagcaagacaggccaacattcaaattcaagaaatacagagaacaccacaaagatactcctcgagaaaagcaaacccaagacacacaattgtctgattcgccaaggttgaaatgaaagaaaaaatgttaagggcagccagagagaaaggtcaggttacccagaaaggaaagcctatcggactaacagcagatctctcagcagaaaccctacaagccaaaagagagtggggaccaatattcaacattcttaaagaaaagaattttcaacccagaatttcatatccagccaaatagtttcataagcaaaggagaaataaaatcctttacagacaagcaaatgctgatattgccaccaccaggcctgctttacaagagctcctgaaagaagcactgaacatggaaaggaaaaaccactcctggccactgcaaaaacataccagattttaaagaccatcgacactctgaagaaactgcaacttgtaaatttgtttgagttaattgtagattctacaattgtagatattagccctttgtcagatgagtagattgcaaaaattgtctcccattctgtaggttgcctgttcactctgatggtagtttcttttgctgtgcaaaagctctttagtttaattagatcccatttgtcaattttggcttttattgccattgcttttggtgttttagacatgaagtccttgcccatgcctatgtcctgaatggtattgcctaggttttcttctagggtttttatggttttaggtctgacatgtaagtctttaatccatcttgaattaatttttgtataaggtgtaagtaagggatccagtttcagctttctacatatggctggccagttttgccagcaccatttattgaatagggagtcctttctccatttcttgtttttgtcaggtttgtcaaagatcggatggttgtagatatgtggtattatttctgagggctctgttctgttccattggtgtatatctctgttttggtaccagtgccatactgttttggttactatagccttgtagcatagttcaaagtcaggtagcatgatgcctccagatttattcttttggcttaggattctcttggcaatgtgggccctttttggttccatatgaactttaaagttgttttttccaattctgtgaagaaagtcattggtagcttgatggagatggcattgaatctataaattaccttgggcagtattgccattttcacaatattgattcttcctacccatgatcatagaatgttcttccatttgtttgtatcctcttttatttcactgagcagtggtttgtagttctccttgaagaggtccttcatgtcccttgtaagttggattcctaggtattttattctctttgaagcaattgtgaatgggagttcactcatgatttggctctctgtttgtctgttattggtgtataagaatgcttgtgatttttgcacatcgattttgtatcctgagactttgctgaagttacctatcagcttaaggaggttgtgggctgagacaatggggttttctagatatataatcatgtcatctgcaaacagggacaatttgacttcctcttttcctaatgaatacactttatttccttctcctgcctgatagccctggccagaacttccaacactatgttgaataggagtggtgagagagggcatccctgtcttgtgcccattttcaaagggagtgcttccagtttttgcccattcagtatattgactgtgggtttgtcttaggtagctctgattattttgagatacatcccatcaatacctaatttattgagagtttgtagcatgaagcattgttgaattttgtcaaaggcctttcctgcatctattgagataatcctgtggtttttgtctttggttctgtttatatgctggattacattttttgattttcatatgttgaaccagccttgcatcccagggatgaagcccacttgatcatggtggataagctttttgatgtgctgctggattcggtttgccagtattttactgaggatttttgcattgacaaacaaccccatcaacaagtgggcaaagggtatgaacagacgcttctcaaaagaagacatttatgcagccaaaagacacatgaaaaaatgctcatcatcactggccatcagggaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaagtaccatttgacccagccatcccattactgggtatatacccaaaggataataaaagatgctgctataaagacacatgcacacgtatgtttatggtggcactattcacaatagcaaagacttggaaccaactatgatagactggatgaagaaaatgtggcacatgtacaccatggaatactatgcagccataaaaaatgatgagttcatgtcctttgtagggacatggatgaagctggaaaccatcattctgagcaaactattgcaaggacaaaaaaacaaacactgcatgttctcactcttaggtgggaattgaacaaagagaacacatggacacaggaaggggaacatcacacactggggcctgttgtagggtggggggagcggggaggggggagggatagcattaggagatacacctaatgttaaacgaagagttaatgggtgcagcataccaacatggcacatgtatacatatgtaacaaacctgcacattgtgcacatgtaccctaaaacttaaaatataataaaaataaaaaatgaaaaatagaaaaaagaaccatgaatgataaaaaaaaaagaaaaaaaataaactgcatcaactaacaggcaaaataatcagctagcatcataaagacatgatcaaattcacacataacaatgttaaccttaaatgtaaatgggctaaatgtcccaattaaaagacatagtctggcaaattggataaagagtcaaggcccattggtgttcagtattcaggagacccatctcatgtgcaaaaacatacataggctcaaaataaagggatggaggaatatttaccaagcaaatggaaagaaaaaaaaaaagcagcggttgcaatcctactctctgataaaacagactttaaaccaacaaagagacagagaagggcattacataatggtaaatggatcactgaaagaagaagagctaactatcttaaatatatatgcaccgaatgcaggagcacccggattcataaagtaaattcttagatacttacaaagagacttagactcccacacaatgttagtgggaaaatttaacactctactgtcagtaacagacagatcatcaagagagaaaattaacaaggatatccaggacttgaactcagctctgcaccaagtggacctaatagacatctacagaactctccaccccaaatcaatagaatatacattcttctcagcaccgcatcacacttactcccatattgaccacatagttgaaagtaaagcactcctcagcaaatgtaaaagaatagaaatcacaacaaactgtctctcagaacacagtgcaatcaaattagaactcagaattaagaaactcactcaaaactgctcaactacatggaaactgaacaacctgctcctgaatgactactgagtaattaacgaaatgaaggcaaagccttcattcataccaaagcctggtagagacacagcaaaaaaaaaaaagacttttagaccaatatccctgatgaacatcgatgtgaaaatcctcaataaaatactggcaaactgaatccagcagcacatcaaaaagcttatccaccatgatcaagtgggcttcatccctgggatgcaaggctggttcaacatacgcaaatcaataaacgtaatccagcatataaagagaaccaatgacaaaaaccacatgattatctcaatagatgaagaaaaagcctttggcaaaattcaacaacccttcatgctgaaaactctcaataaactaggtattgatggaacatatctccaaataataagagctatttatgacaaacccacagtcaatatcatactgaatgggcaaaaactggaagcattccctttgaaaactggcacaagacagggatgccctgcctcaccactcctattcaacatagttttgaaagttctggccagggcaatcaggcaagagaaagaaataaagggtattcaattaggaaaagaggaagtcaaattgtcccagtttgcagatgacatgaattttatacttagaaaaccccattgtcttcacccataatctccttaagctgataagctcattgtagattctggatattagccctttgtcagatgagtaggttgcaaaaattttctcccattctttaagtttcctattcactgtgatggcagtttcttttgctgtgcagaagctctttagtttaattagatcccatttgtcaattttggcttttgttgccattgcttttggtgttttaaacatgaagtccttgcccatgcctatgtcctgaatggtattgcctaggttttcttctagggtttttactgttttaggtctaacatttaagtctttaatccatcttgaattaatttttgtataaagtgtaaggaagggatccagtttcagctctctacagatggctagccagattccccagcaccatttattaaacagggaatcctttcctcatttcttgcttttgtcaggtttgtcaaagatcagatggttgtagatgtgtggtattatttctgagggctctattctgttccattggtctatatctctgttttggaaccagtaccatgctgttttggttactgtagccttgtagtatagtttgaagtcaggtagcgtgatgcctccagcttttttcttttgacttcagaatgtcttgacaatgcgggctttttttggttccatatgaactttaaaatagttttttttgtttgtttgttatttgattccctttattacattaaattatacatttgactcatttttccataatgaataatttgcgtgtgaataaaatgaccaacttaaaataaacaaataaaaagtatgtattcactaacagttatattataaataagtacattcataatcaatctctcattattcctgttcctctctttcatagaaagcacttataagtgtaatcgattatatctttaagcatcttggcattctgaggtttatagattaattggggaaaactgtccattttaataagctttggttttttgtcccttttttttttaatttttttagtatttattgatcattcttgggtgtttctcggagagggggatttggtaggttcataggacaatagtggagggaaggtcagcggataaacatgtgaacaaagtctctggttttcctaggcagagggccctgcggccttccgcagtgtttgtgtccctgggaactagggattagggagtggtgatgactcttagcgagcacgctgccttcaagcatctgtttaacaaagcacatcttgcaccgcccttaatccatttaacccttagtggacacagcacgtttcagagagcacggggttggggataaggttatagattaacagcatcccaaggcagaagaatttttcttagtacagaacaaaatggagtctcctatgtctacccccttcaacacagacacagtaacaatccgatctctctttcttttccccacatttcccccttttctattcgacaaaaccgccatcgtcatcatggccccttctcaatgagctgttgggtacacctcccagatggggtggcggccgggcacaggggctcctcacttcccagacggggcagccaggcagaggcaccccccacctcccagatggggtggctggctgggcggcggctgccccccacctccctgacggggcggctggccgggcgggggctgccccccacctcccggatggggcagctgccgggcggaggggctcctcaattcccagatggggcggctgctgggcggaggggctcctcacttctcagacggggcggccagtcagagatgctcctcacctcccagacggggtggcggcggggcagagacactcctcagttcccagacggggtcacggccgggcagaggagctcttcatatctcagacggggcggcggggcagaggtgctccccacatcccagacgatgggcggctgggcagagacgctcctcacttcctagacgggatgactgctgggaagaggcgctcctcacttcccagactgggtggccaggcagaggggctcctcacatcccagacgatgggcggccaggcagagacactcctcactttctagacagggtggcggccgggcagaggctgcaatctcggcactttgggaggccaaggcaggcggctggcaggtggaggttgtagcgagccgagatcacgccactgcactccagcctgggcaacattgaacactgagtgagcgagactccctctgcaatcctggcacctcgggaggctgaggctggcagatcactcgcggtcaggagctggagaccagcccggccaacacggcgaaaccctgtctccaccaaaaaatatgaaaaccagtcaggcgtggaggcgcacgcctgcaatcccaggcattcggcaggctgaggcaggagaatcaggcagggagtttgcagtgagtcgagatagctgcaatacagtccagcctcggctgggcatcagagggagactgtgcaaaggggagagggagagggagagggagagggatagggagatagtttttttttccaattctgtgaagaaagtcattggtagcttgatggggatggcattgattttcacaatattgattcttcctatccgtgagcatggaatgttcttccatttgaagaattctccaacccgaatgtccatcagtgatagactggattaagaaaatgtggcacatatacaccatggaatactatgcagccatataaaaggatgagttcttgtcctttgcagggacatggatgaagctggaaaccatcactcagcaaattattgcaaggacagaaaaccaaacacagcacgttctcactcataggtgggaattgaacaatgagaacactgggacacagggtggggaacatcacacacaggggcctgttttggggtgggggatggggggagggatagcattgggagatatacctaatgtaaatgatgagttaacgagtgcagcacaccaacatggcacatgtatacatatgtaacaaacctgcacattgtgcacatgtagcctagaaccgaaagtataattaaaaaaagctgataagcaaattcagcaaagtctctggattcaaaatcaatgtgcaaaaatcacaaccattcttatacaccaataacagacagagagccaaattatgagtgaactcccattcacaattgcttcaaagagaataaaacacctaggcatacaacttacaagtgatgtgaaggacctcttcaaggagaactacaaaccactgctctaggaaataaaaggggacacaaacaaatggaagaacattccatgctcatggataggaagaatcaatatcatcaaaatggccatactccccaagttaatttatagattcaatgccgtctccatcaagctatcaatgactttcttcacagaattggaaaacactactttaaagttcatatggaaccaaaaaagagcccacattaccaagacaatccaaagccaaaagaacaaagctggaggcatcatggtacttgacttcagactatactacaaagctacagtaatcaaaacagcatggtactggtaccaaaacagagagatagaccaatggaacagaacagaggcctcagaaataacaccacacatctacaaccatctcatcttcaacaaacctgacaaaaaccagcaatggggaaatgattccctgtttaataaatggtgctgggaaaactggctagccatctgtagagagctgaaactggatcccttccttacactttatacaaaaattaattcaagacggattaaagacttaaatgttaaacctaaaaccataaaaaccctagaagaaaacctaggcagtatcattcaggacataggcatgggcaaggacttcataactaaaacaccaaaagcaatggcaacaaaagccaaaattgacaaatgggatctaattaaactaaagagcttctgcacagcaaaagaaactgccatcacagtgaataggcaacctacagaatgggagaaaatttttacaatctacctatctgacaaagggctaatatccagaatctacaaagatcttaaacaaatttacaagaaaaaaacaaaccaccccatcaaaaagtgggcaaagatatgaacagacacttctcaaaaaaagacacctatgcagccaacagacacatgaaaaaatgctcatcatcactggccgtcagagaaatgcaaatcaaaaccacagtgagatatcgtctcacaccagttagaatggcgatcattaaaaagtcaggaaacaagaggtgctggaaaggatgtggagaaataggagcacttttacactgttagtgggagtttaaattagttcagccattgtggaagacagtgtggtgattcctcatggatctagagctagaaataccatttgacccagccatcccattactgggtatgtacccaaaggattataaatcatgctaatataaagaaacatgtacatgtatgtttattgtggcactactcacaatagcaaaaacttggaaccaacccaaatgtccatcaatgatagactggatttagaaaatgtggcacatatacaccatggaatactatgcagccataaaaaaggatgagtccattttcctttgcagggacatggatgaagctggaaaccatcattctcagcaaactatcacaaggacagaaaaccaaacaccgtatgttctcactcataggtgggaattgaacaatgagaacacttggacacaggacagggaacatcatgcatgggggcctgtcatggggtaggggtcagggggagggatagcattaggagaatacctaatgttaatgataagttaatgagtgcagcaaaccagcatggcacatgtatacctatgtaacaaacttggacattgtgcacatgtacactagaagttaacatataataataataataataataataaaaagaaattttagatgcttgctttagtaaatgttttattgaaataaaatgacatatcctacaatttacccatttaaagtatatgattcaatgattttgagtatattcagtgaagtttgtaaccatcaccaaatcaatgttacgatattttcattactctaaaaagaaaccacgtacctattaccagttactcccctttctctccaaaccttgcaaccctaggcaataactactttagtctctgtgtgtatgaatttgtttgttatagtcatttcaaagcaataaaaccatacaatatttggcattttgtcactggcttttttctcttaacaaaattctttcacgattcattcatgtcgtatgagtactttattcctatttattggtgaataagattccattttatcatattttatttatttatttttcagtgctttttgaggcctaggcaggaggattgcttgagcccaggagttccaggctgcagtgagctatgatcatgccactgcactccctgccttgaaaaaaaaaaagtaactttgtgtttaacatttagaggacataacagactgctataagaagtggcctcatagaatgagttgggaagtgtttcctcctcttctgttttttttggagggtttgtgaaaaattgatactaattcttcctcaaatgttgggtagaattcaacagtgaagccctctgggcctgggctattctttgtgagagatttttccaattacaaattcatttcattacttgttttgtctattcatatcttctaaagtcagttttgatagtttgtgtttttctaggaatttatccattttgtacaggttatctgatttgttggaatattgttattaataatactccattacaatctttttaattctctgagataggtccctcttttcactctttttttttttttttttttttttttgagatgaagtctagctctgtcaccaggctggagtgcagtggcgagatcttggctcactgcaacctccgcctcctacgttcaagtgattcttcagcctcggcctcccgagtagctgagactacaggcacacgccaccatgcccagctaatttttgtattttttttaatacaaaatttagacgggatttcattatgttggccaggatggtctcgatctcttgacctcgtgatctgcccacctcggcttcccaaagtgctgggattacaggtgtgagccaccgtgcccggcctttgctcttgattataataatgttagtttctcttcttgtcttggtcaacctagctaaagttttgtcaaccgttttgaccttttcaaagaagctgcttttttccagctttattgaattatgagacaaaaattgaatatatttaaggtatacaactcaatattttatataaattaacatccatcgcgtcacataattgtcattttcttccttctcccctcccctgcttcaccctcgcaaccaccattctactttctctaagtgtatttccacttttgcatatgtgagataatgcaatatttgtctttctgtgtctgaattgcttcacttagcataatatcctccaggttcatccaagttgtcataaatgtcaggatttactttattataaaagctgaataatatttcagtgaattagtgtgtgtatgtgtatcacattttctgctttagtaaactaatagattgcgtgactcatccaaggacgaagtcagtgagcagtggggacaggactacagctcaaatctcctggttcccatcaacaatacctgctttccaatccctaatgatgccattaggatgggagaatggtggaacctgcagggaagagaaggagactgggcacacagtaggatccaagccctggccctgccccctgggacacatttgtcactctattgcttgttttctttgctctgcaaatgctttttagtttgattcagtcccacttaactttgtaatatattttgaaatcagaaagtgggatgcctccagcgttgttattcttgttcaatagtactttggctatttggggtcttttgtggtttcatgtgaattttaggattttttttttctatttctgtagagtatttctttggtattttcatagggatttcattgaatctatagatcagtttggatagcatggggattttaacaatatcaattctttttttttttttaagacagtctttctctctcacccaggctggagtgcagtggcacaatcttggctcaccgcaacctctgcctcccgggttcaagcaattctcctgcctcagcctcccatgacatgcctggctaatttttttttgtatttttagtagagatgggatttcatcatgttggtcaggctggtctcaaactttttacctcaggtaatccacctgcctcgacctcccaaagtactgggattacaggcatgagccaccgcacccggcaatattaattctcccagtccataaaaacggaggtctttccttttatctgtgttcaaagaaccaacttttagattatttgcttttgtatatattttttctttaatacttcattaatttgtgctataatctttatttccttttttctgtttgctttcagtttagttttttttatttttctatattttaatgtgaatggtgaggatattgatttgaggtaattttgttttcttttttccttgttttgagacagggtcccattctgtcacgcaggcaggagtgcagtggcatgatcatggatcacggctcactgcagcctcaacctccctggctcaagtgatcctcccacccgagcctttcaagtagttgggactacaggcctttgctaccatgcccagattattgattgattgattgattgattgattgattgagacagggtctacctatgttgcccagtctggtctcaataccctggactcaagcaatctttccaccccagcctcccaaagtgctgggatttcaggtgcaacccactgggctcagcctttttttcttttcttttcttctcttttcctttctttaacatacttgcttatggctataaattttcctctcagcattgcttaagctgcatactggagtttttagtatgttatatcttcgtttcattcttcacaaagtatttttcgtttctttcgtttgttattcagtcagatgttagtatagccactgaagattccttacggctgctatttccatgttatgtccttttttatggtttgctttaaacttttttgtatctttgatcaaagcgtgtctcctgtagaaagcatatagttggatactatttgcttgttttgtgcagtcatactatatcttccttttgattggaatgtttaatcaattcacatttagtgttattgttggtactgttagattgatgtctgtaaatttagtttttattttccatatgttcatgccttttttccttgtactcctcctttactgattttttaacattaaatgaatatttttaaaaaatttaatttctatttatttatttatttactttaagttctgggatacataggcagaatgtgtaggtttgttacataggtatacatgtgccatggtgttttgctgcacctgtcaacccatcatctaggttttaagccccgcatgcattaggtatttgtcttaatactctccctccccatcacccctaccccacagcatgccccagtatttgatgttcccctccctgggtccatgtgttctcattgtccaactcccaattatgagtgagagtttggttttctgttcctatttaaatttgctgagaatgatggcttccagcttcatctatgtcccggcaaaggacatgaactcattctattttacggttgcatagtattccatggtgtatatgtgccgcattttcttaatccagtctatcactgatggacatttgggttggttccaagtttttgctattgtgaatagtgctgcaataaacatatgcatgcatgtgtctttatagtagaattatttataatcctttggatatatacccaggagtgggattgctgggtcaaatggtgtttccggttctagatccttgaggaaccaaaacactgtcttccacattgattgaagtaatttacactgccaccaacagtgtaaaagcatttctatttattcacagactcaccagcgtctgttctttcctgactctttaatagccattctaactggcgtgagatggtatctcattgtggttttgatttgcatttctctaatgaccagtgatgatgaaccttttttcatatctttcttagctgcataaatgtcttttgagaagtgtctgttcacatacttctcccactttttgatggtttttttttcttgtaaatttgtttaagttccttgtagattctggatattagacctttgtcagatggatagcttgtaaaaattttctcccattctgttggttgcctgttcactctgatgatagtttcttttgctgtgcagaaactcataagtttgattagatcccatatgtcaattttggcttttgttgccattgcttttgatgttttagtcatgaagtctttgcccatgcctatgtcctgaatggtattgcctaggttttcttctaggattttttatgtgtttaggtcttacatttaagtctttaattcttcttgagctaatttttgtataaggtgtaaggagtaggtccagtttctgttttctgcatatcgctagccagttttcccagcaccatttattaaatagggaatctcttccccattgcttgtttttgccaagtttgttgaagatcagatggttgtaggtgtgtggtattatttctgaggtctttgttctgtttcattggtctatatatctgttttggttccagtaccatgctgttttggttactgtagccttgtagtatagtgtgaactcaggtagcgtgatgcttccagctttgttctttttgcttaggagtgtcttacctatacgggttattttttggttccatatgaaatttaaagtagatttttctaattctgcaaagaaagtcaaaggtagcttgttggaatttcattgaatctataagttactttgaacagtatggccatttcacaatattgattcttcctatccatgagcatacaatttttttccgtttgtttgtgtgctctctgattacctcgcagtggtttgtcattctccttgaagaggtcctttacgtcccttgtaagttgtattcttaggtattttattctctttgtagcaattatgaataggcgttcactcatgatttggctctctacttgtctattatcgatgtataggaatgcttgtgatttttgcacactgattttgtatcttgagactctgctgaagttgcttatcagcttaaggagattttgggctgagatgatggggttttctaaatatacaatcttgtcatctgcaaacagagacaatatgacttcctcttttcctaactgaatacctttcatttctttctcttgcctgattgccctggccagaacttctaatactatgttgaataggagtggtgagagaccgcatccttgtcttgtgccagttttcaaagggaatgcttccagcttttgcacattcagtatgatattggctgtgggtttttcataaatagcttttattatttttacatatcttctatcaatacctagtttattgagagtttttatcatgaaaggatgttgaatttgatcaaaggcccttttctgcatctattgagataatcatgtggtttttgtcattcgatctgtttatgtgatggattatgtttattgacttgtgtatgttgagctagccttgcatcccaggggtgaagtcgacttgatcttggtgggtaagctttttgatgtgctgctggatttggtctgccagtattttattgaagatttttgtattgatgttcatcagggatattggcctgaaattttctttttttcttgtgtttctgccaggttttggtatcaggatgatgctggcctcacaaaatgagttagggaggagtgcctctttttcttttgtttggaatagtttcagaaggaatggttccagctcctctttgtacctctggtagaatttggctgtgaatccatccgttcttggacttttttggttggtaggctattaattactgcctcaatttcagagcttgttattggtacattccaggatttaacttcttcctgttttagtcttgggagggtgtatgtgtccaggaatttatccatttcttccagattttctagtttatttgcatagaggtgctaatagtattctctgatggtagtttgtatttctatgtgatcagtggtgatatcccctttatcatttcttattgcatctatttgattcttctctcttttcttcttcattagtctagctagcagtctattttgttaagcttttcaaaaaaccagcttctggattcattgattttttgaagagtttctcatgtctctgtctccttcagttccactctgaacttagttatttcttgtcttgtgccagcttttgaatttgtttgctctttcttctctagtttttttcattgtgatgttagtgtgttgattttttatctttcttgctttctgatgtgagcatttagtgctataaattctgctcttaacactgatttagctgtgtcccagagattctgggttcgttgtctctctctttgttctcattggtttcaaatagcttatttatttctgccttaattttgttatttacccagtagtcattcaggagcaggttactcaatttccattagttgtgtggttttgagtgaatttcttaatcctgagttctaatttgattgcactgtggtctgagagactgtttgttatgatttccattcatttgcatttgctgaggagtgttttgtttccaattgtgtggtcaattttagaataagtgttatgtggcactgagaagaatgtatattctgttgatttgtggtggagagttctgcagatgtctattaggtcttcttggtccagggccaagttcaagtcctgaatatccttgttaattttctgtcttgttgatctgtctaatattgatagtggggtgttaaattctcccactattgctatgcaggagtccaagtctctctgtagtcctctaagaacttgtcttatgaatctgggtggtatattggctcatatcccagtatgtggataccactgtattgggagcatatatgtttaggatagttagcacttcttgttgcattgatccctttaccattatgtaatgtccttcttttccttttttgatctttgttggtttaaagtctgttttatcagagactaggattgcaacccctactgttttttgctttccatttgcttggtaaatattcctccatctttttattttgagcctaagtatgtctttacatgtgagatgggtctcctgatgcagcacatcgatgggtcttgattctttatccaatttatctgtcttgtctttaattggagactttagcccatttacattaaatgttaatattgttatgtgtgaatttgatcctataattatgacgctagctggttattttgtacattagttgatgcagtttcttcacagtgtcattggtctttatatttttgtatgtttttgcagtggccgttactggttgtttttttttttccatatttagtgcttccttcaggagctcttgtaaggcagacctggtggtgacaatatccctcaacatttgccttgtctggaaagcattttatttatgtgcttattaagcttagcttggctggatatgaaattctcgtttgaaaattattttctttaagaatgttgaatattggccccctcctgggttcaagggattctcgtgcctcagcctcccgagtagatgggattaccggcacgtgccaccacacctggctaattcttgtatttttagtaaggacagggtttcaccatgttggccaggccggtgttgaacacctgacctcaggtgatccacctaccttggcctcccaaattgctgggattacaggaatcagccattgtgctctgctcttcttctcctttttttgtccaattttttgttatatgttttatatctatatgtgctgcaaatccaataatacattatttaaattaaattattattaaatcttatataattgtatgtcttttaagaatgttgacaaaaaatgtagatcaagtatatattcacagaatctgttacattgatgtttttgcttatcatttttggttttcttcatttgttgctgtagattcaaattaccaactggtatcttttccttgttccaatacagctttgctctcacccaccttctttttcttgttattggcaaatatatatacagatctcacaatacaattatatacatattgttttatataattgatttttaagtcagttaagaggtggttggagaatacatatgcaattatgtcattgtaattatctacctagttacctttactggtactctgttctttgtgtagacttaaattacttgctgggtcactttctttcagcctgaaggactttttttagtattttttgtaagatagctctgttatcaacaaattctctcagtttttgtttatcttgaaattatctttatttcatctttatttttgaaagacagttttgctcaacataagactcttggttggcagactttttttcttctactattttaaatatgtcatatcacattccattgcctttcagcctccattgtttctaaaagttagctgttaatcttaatagggttcttttgtacacactgctttcaaggtgttttatttttttttcttttaagcatgtttactgggatgtttctgagtagagatttctttatcctacttggagtttattgaaattcttaaagcatagataatgtttttttcaaatttaggaaagttttcaaccattattttaaaaaatgtttgtattcctttctttccttttcttctatttcaattatgtatattcttgtgattaacagtattccatatttctttgagattgttcatactccttcattctttttttctgttttttttttctgtgctattgcaataatctctgtgttcttccagcatcagtctcttacaccctcaaaattgctctattaaatgaagacacattaatatttttgaaacattgctttacactcatcactccctaacttgaaagcttctcataactctccattgtctatactgaaaataagtttagagattgccattgattggctattttgtacctcattaacattatttcccctatttcccttcacaaatcttttaatctagtcaaattggcctgtcagtaaaaccagttttaatctcaacctctacagcactttatgcttatcactcatttcattatagtacttcatattgtcatttttacttattttttaatacagtgaattttaagcctctggaattcagttgtttaataccctaacacttggtacactactctgaatgttaggaatagtaagaaatataattgtcgataatgttgtgatacacaacatgacatttaatcatgtttcaattagtgacagtcaataagtataatcaaagcacaaaaattctctcccaagaataaattggtagagttggaaattgaaggaaaatgttaacttaacaagtaattatataattattctttcccactgaaatcaattgatgactctgatgtatattgattaaaaatgctttaatatgtacaaacaactgcaaatatactgttttgttcaattaatggtttgacaatttagtgaagtgctggatggaaaagacatataaactaaggggagtggatctctcccctggctgtgtcacttttttatttctctctattcccacatcattaccaaagccagtaatctccaaccatctatttctcaatcttaagactattgttcagggctgggcttggtggctcatgcctgtaatcccagcactttgggaggctgagaacaggtggatcacgaggtcaggagattgagaccatcctggctaacacggtgaaattctgtctctactaaaaatacaaaaaattagccgggcatggtggcacacacctgtagttccagctactcgggaggctgaggcaggagaatcacttgaacccaggaggcagaggttgcaatgagccaagatcgcaccactgcactccagcctgggtgacagagcgagactctgtctcaaaaaaaaagactattgttcagacaagttcctgagcaaaagttttctctttctaagacatcatgatctacatataatgttagcaattctattttacatatggcacagtatgtatatttttgtacagtgtgaatgattatggtcaattttttattatttttttcttctttagtcaacatagggtaaaataaagaaaaggcaatttcagaaagcatgccaagcagcagatattgatttgttgtttgttaattccttgccctttaaacaagttgaataaagctatcttgatatcctatttggatatgcttatgttattctgaagctaatctgaaaatttaaagctatatgcatgtaaacttctatgtaatagatatgtaatagataaacaatgtattacataggtatctatgtaatagataatgtattacataggtatctatgtaatagataaacaactgtggtaatacaagaataaataagggtacttactgaaaataaaaaagaaacaaatattgcatttcagaacacaagccagtttaaccaaaatgagaaagaattaaactgaaagcataactagaaagataagcatgttatgtgcagaagtagcttcatttctatttccttctctttttgatcctttattcaaaatcttagggagtctaaacagaataacccatcccctataagaaattatcatttttgttttatgcaaaatgaatacatcattaaaatgatttttaaaaatcatgaaatgtagtatctgtgttcattgtctaatggaagtttttaaaaatgtatttgatagaataattttaatagttcattgtatgctttaaatagcaagtatttctctgtatgaaaggagtttgcatgtattatagataaaatattgatcctagtatggattgtcattgttgtcctagtctgtttcatgttgctgtaacagaatactacacactacgcaatgtataaacaatagaggtttatttggcttatgattctggaggctgtaaaggccaagattgaggggcaacatctgatgagggacttcttactgtgttataacatggtggaaggtatcacatgttgagagatgtgcaagagagggaagggggctgatctaatcctttcatcagaaacccactcccatgataaccaacccactctcacaataactgtattaattcatccatgagggcaaagcccccatgtcctaatcacctcttaaaagtctcattctcaatactgttgcattggggattaagtttccaacacatgaattttgggggacacattcaaaccatagcaatagtaatacatttcattatgtagataagtatgtatgtgtggtcttcaattctaaacttattttgtcttcaaactttaataattaaaataactccacatgaaattagatttatgtgtgaaggatgtaaagtgataaaagttatataattttacaggtaattttatgaattatatagcagacaattattgcaactctaaagattgtttacaaattcaacaaaaatattgggattcatagatataagtttatcctattatgacaaacatagaattaacattattattcctttatctttaaattcccttagtcaaattttttaattcttacagatgaatataatttaaattagattcaattaaatattttttttctttaggaaaaagtcaaagagaaggaagaaaatctgaatcttgtaaaccaattcttaaagtagaatacaagacctgcaaaaacaggtatgcatttttactttagggaaagagggatacgaagcagagacaaaaaatgcagatgacctttaatgttaagatattgtttaaagttttacaaaattgtaaagacaactgaatcctcaatattaacataattgacttgtctcatagacatatctctgatgattattattatgattattataaattacaagtgttaattatttcaggattcttaatgaacatttagacaagtattatacacattaattttaacagtaaaggacttctggccatgcatattacaagtagcaggatttattaagcagaagcaatgtgcccgttaatattgcatgtgaaagacttaaatacataaccaagtgtctatactttaagatcttacattctgaagttggaagattacagtttgttcgaaagataaagttgtgtatattaatgtaataaaaagtactaaattttaaggtgttgaaaaatacaaaaataataatatttagtaaaatattattttgtgtttaaagtagctatatccggctgggtgccctgcctcacgcctgtaaccccagcactttgggaggctaaggcgggtggatcacctgaggtcaggagatcgagaccagcctgggcaacatggcaaaaccctgcctctgctagaaatacacaaaaaaattagctgggcatggtggcatgtgcctgtaatcccagctacttgggaggctgaggcacaagaatcctttgagcccaggaggtggaggttgcagtgagccaagatgctgccactgcccttcaacctgtgcaacagagcgagactctgtctcaaaaagaaaaaaaagtagccatatcctataaatcaacaagttccttttacttggcaataataattagtggcaatacactcattgagaattaccataataaatcttgcctaaacattaaatttattttaattcaaattaaataatcctagtttatattaataatatgaacattttataatgttttcttggtatcataggtatactgaatgtttgtttataactgctcttttaaaattttaatagtacaaaattatgctcatttttaacctgttattttatctatatatagatatctctttagcctactatgcattcactgataaaaatgaacactgtttgaacagagccctcagaaataacaccacacatctacaactatctgatctttgacaaacctgacaaaaacaagaaatggggaaaggattccctatttaataaatggtgctgggaaaactggctagccatatgtagaaacctgaaactggatcccttacttacaccttatacaaaaattaattcacggtggattaaagacttaaatgttagacctaaaaccataaaaaccctagaagaaaacctaggcgataccatgtaggacatagacgtgggcaaggacttcatgtctaaaacaccaaaagcaatggcaataaaagccaaaattgacaaatgggatctaattaaactagagagcttctgtctggtgaaagaaactaccatcatagtgaacaggcaacctacagaatgagagaaaatttttgcaatctactcatctgacaaagggctaatatccagaatctacaatgaactcaaacaaatttacaagaaaaaatcaaacaaccccatcaaaaagtgggtgaaggacatgaacagacatttctcaaaagaagacatttatacagccaacagacacatgaaaaaatgctcatcatcactggccatcagagaaatgcaaatcaaaaccacagtgagataccatctcacaccagttagaatggcgatcattaaaaagtcaggaaaaagcaggtactggagaggatgtggagaaataggaacacttttacactgttggtgggactgtaaactagttcaaccattgtggaagacagtgtggcgattcctcagggatctagtactagaaataccatttgacccagccatccccttactgggtatatacccaaaggattataaatcatgctgctataaagacacatgcacatgtatgtttattgcagcactattcacaatagtaaagacttggaaccaacccaaatgtccatcagtgatagactggattaagaaaatgtggcacatatacaccatggaatactatgcagtcataaaaaaggatgagttcatgtcctttgtagggacatggatgaagctggaaaccatcattctcagcagactatcccaagggcagaaaaccaaacaccacatgttctcactcataggtgggaactgaacaatgagaacacttggacccaggaaggggaacatcacacaccggggcctgtcatggggtggggggaggggggaaggatagtattaggagatatatctaatgtaaatgaggagttaatgggtgcagcacaccaacatggtgcatgtatacatatgtaacaaacctggatgttgtgcacaagtaccctagaacttaaagtgtaatagtaaaaaaatactaataacaaaaaaacccactgttttataccattataactaaagtattagaaagtttcaaatttaatcattattaatggaaatatgaaatatatgacatatattttgcctcttgaaatattacttatagtttaagctttgcttgagttttcaggttcaacattatttacaatatttcttatgtggtattgcacttcaaggattattaaggtgcaggacactatattaactgttcctagcagcttgtggtattattttatgggtttttttcacattatatatagtttattatactttaagttttggaatacatgtgtaaaaagtgcaggtttgttacatagttatacacgtgccatggtggtttgctgcacccatcatctacattaggtatttctcctaatgctatccctcccctagcctcccaacccccacaacccccaacaggccacggtgtgtgatgttcccctccctatgtccatgtattctcattgttcgattcccaattatgagtgagaatatgcagtgtttggttttctgttccggtgttagtttgctgagaatgatggtttccagcttcatccatgtccctgcaaaggacatgaacttgtcttttttaatagctgcacagtattattccatggtgtatatgtgctacattttcgttatccaatctatcattgatgggcatttgggttggttccaagtctttgctatagtgaatagtgctgaagtaaacatacatgtgcatgtgtctttatagtagaatgatttataatcctttggatacataaccagaaatgggattgctcggtcaaatggtatttctggttctagatccttgaggaatcgccacaatgtcttccacaatggtggaactaatttacactcccaacaacactgtaaaagcattcctatttttttatgtttttttattttttatttttattttattattatactttaagttctagggtacatgtgcacaacgtgcaggtttgttacatatgtatacatgtgccatgttggtgtgctgcacccattaactcatcatttacattaggtatatctcctaatgctatccatcccctctccccccaccccatgacaggccccagtgtgtgatgttccccttcctgtttccaagtgttctcattgttcaattcccacctatgaatgagaacatgcagtgtttggttttttgtccttgtgatagtttgctgagaatgatggtttccagcttcatccatgtccctacaaaggacgtgaactcatcctttttcatggctgcatagtattccatggtgtatatgtgccacattttcttaatccagtctatcactgatggacatttgggttggctccaagtctttgctattgtgaatagtgctgcaataaacataacgtgtgcatgtgtctttatagcagcatgatttataatcctttgggtatatacccaataatgggatggctgggtcaaatggtatttctagttctagctccttgaggactcaccacactgtcttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataccctttgcccattttttgatggagttgtttgtttttttcttgtaaatttaagttcattgtagattctggatattagccctttgtcagatgagtagattgcaaaaattttctcccattctgtaggttgcctgttcactctgatggtcgtttcttttgctgtgcagaagctctttagtttaattagatcccatttgtcagttttggcttttgttgccattgcttttggtgttttagacatgaagtccttgcccctgcctatgtcctgcatggtattgcctaggttttcttctagggtttttatggttttaggtctaacatttaagtctttaatccatcttgaattaatttttgtataaggtgtgagtaagggatccagtttcaggtttctacatatggctagccagttttcccagcaccatttattaaatagggaatcctttccccatttcttgtttttgtcaggtttgtcaaagatcagatagttgtagatgtgtggtattatttctgaggcctctgttctgttccattagtctatatctctgttttggtactagtaccatgctgttttggttactgtagccttgtagtatagtttgaagtcaagtagtgtgatgcctccagctttgttcttttggcttaggattgtcttggcaatacgggaccttttttggttccatatgaactttaaagtagtttttttcaattctgtgaagaaagtcattggtagcttgatggggatggcattgaatctataaattacattgggcagtattgccattttcacaatattgattcttcctacccatgtgcatggaatgttcttccatttgtttgtgtcctcttttattttgttgaacagtggtttgaagttctccttgaagaggtccttgacatcccttgtaagttggattgctaagtattttattctctttgtagcaattgtgaatgtgagtttactcacgatttggctctctgtctgttattggtgtataggaattcttgtgatttttgaacgttgattttttatcctgagactttgctgatgttgcttatcagcttaaggagattttgggctgagacgatggggttttctaaatatacaatcatgtcatctgtaaacagggacaatttgacttcctcttttcccaattgaaaaccctttctttctttctcctgcctgattgccctggtcagaacctccaacactatgttgaataggagtggtgagagagggcatccctgtcttgtgccagttttcaaagaagcattcctattttttctacatcttctccagcatctcttatttcctgactttttttctttctttttttttttttttttttgagacagagtctcgctctgtcaccaggctggagtgcagtggcgtgatctcagcacactgcaacctctgcctccggggttcaagcgattctcctgccccagcgtcctgagtaactgtgactacaggcatgtgccaccattcccagctaatttttgtatttactttagaagagacagggttacaccatgttggccaggatggtctccatctcttgacctcgtgatccgaccgcctcagcctcccaaactgctgggattacaggagtgagccaacatgctggcctgtttcctgactttttaaggatcgccattctaactggcatgagattgtatctcattggggttttgatttgcatttctctaatgaccagtgttgatgagctttttttcatgttttttggccgcataaatgtcttcttttgagaagtgtctattcatatacttcgccaacttttagatgaggttgtttgttgttttcttgtaaatttgcttacgttccttgtagattttggatattagccctttgtcagatggatagattgcaaaaatatcctcccattctgtaggttgcctgttcactctcatgatagtttcttttgctgtacagaagatctttactttaattagatcccatttgttaattttgccttttgttgccattgcttttagtattttagttatgaagtgtttgcccatgcctacatcctgaatgatattgcctaggttttcttctagggttttatggttttaggtcttaagtttaagtctttaatccatcttgtgctaatttttatataaggtataaggaaggggtccagtttcagttttttgcatatggctaaccagttttcccaccaccatttattaaatggggaatcctttccccattgcttgtttttgtcaggttcatcaaagatcagatggttgtagatgggtggagttatttctgaggactcggttctgttccattggtctgtatatctgttttgataccagaagcatgctgttttcgttactatagccttgcagtatagtttgaagtcaggtagcatgatgcctccagctttgttctttttgcttagcattgtcttggctatacaggctcttttttgcttccatatgaaatttaaagtagctttttctaattctgtgaagaaagtcaatggtagcttgagggggatagcattgaatctataaagtattttgagcagtgtggccattttcgtgatattgattcttcctatccattagcatggaatgcttttccatttgtttgtattctctcttatttccttgagcagtggtttgtagttctccttgaagaggtccttcatgtcccttgtaaattgtattcctaggtattttattctctttgtagcaattgtgaatgtaagttcactcacgatttggctctctgtctgttattggtgtataggaattcttgtgatttttgcaaattagttttgtatcctgagactttgctgaagttgcttatcagcttaaggagattttgggctgagacaatggggttttctaaatatgcaatcatgtcatctgcaaacagagacaatttgaattcctccctttctatttgaataccctttatttctttctcttgcctgattgccctggccaaaacttccaatactatgttgaataggagtggtgagagacctcatccttatcttgtgcctgttttcaaagggaatgcttccagcttttgcccattgagtatgatattggctgtgggtttctcataaatagctcttattattttgaaatatgtttcaatacctagtttattgagagtttttagcatgaaggggtgttgaattttatcaaaggccttttctacatctattgagataatcatgaggtttttgtcattagttagttctatttatgtgatggattacgtttattgatttgcatacattgaatcaaccttgcatcccaggtatgaagccaacttgatcgtggtggataagttttttgatgtgctgttgtgttcggtttgccagtattttattgaggatttttgcattgatgttcatcagggatattggcctgaaattttgttgttgttgttgtgtctctgccaggttttggtatcaggatgaccctggcctcataaaaagagttagggaggagtctctctttttctattgtttggaatagtttcagaaggaatggtaccaactcctctttgtacctctggtagaattcggctgtaaatccatgtggtcctgggcttttttgggttggtaggctattaattactgcctcaattttagaacttatttgttcagggatttgagtttttcctgggttagtcttgggagggtatatgtggttaggaatttatccatttcttctagattttctaatttatttgcatagaggtgcttatagtattctctgatggtagtttgtatttctgtgggatcagtgatgatatcccctttatcactttttattgtgtctatttgattcatctcatttttcttatttattaggctggctagttgtctatgtattttgttaatcttttcaaaaacccgcacctggattcattgattttttttgaagggtttttcatgtctctatctccttcagttgcactgtgatcttagttatttcttgtcttctgctagcttttgaatatgtttgctcttgcttctctagttcttttaactgtgatgttagggtgtcaattttagatctttcttgctttctcctgtgggcatttagtgctataaatttctctctaaacactgatttagctgtgtcccagagattctggtacattgtgtctttgttctcattggtttcaaggaaattatttatttctgccttaatttcattatttacccagttgtcattcaggagaaggttgatcagtttccatgttgttttgtggttttgagtgagtttctcaatcctgagttctaatttgattgcactgtggtctgaaagactgttatgatttttgttcttttgcatttgctggggaatgttttacttccaattatgtcatcaattttagaataagttcattgtggcactgagaagaatgtatattctgttgatttgtggtgcagagttctgtagatgtctattaggtccacttggtccagagctgagttcaagtcctgaatagccttgttaattttttgtctcattgacctgtctaatattgacagtggggagttaaagtctcccactattattgtgtgggagtctaagtttttttttgttggtctctaagaacttactttatgaatctgggtgctcctgtattggttgcatatatatttaggatagttacctcttcttcttgcattgatccctttaccattatgtaatgcccttgtttgtcttttttgatctttgtttaagactgttttatcagagattaggattgcaacccctgcttttttttttctttccatttgcttggtaaacagttctccatccttttattgttagcctatgtgtgtctttgcacataagatgggtctccgtaatacagcacactgatgggtcttgactctttatccaatttgccagtctgcgtcttttaactggggcatttagcccacttacatttaaggttaatattgttatgtgtaaatttgatcctgtcattatgacactagctggttattttgcccattagttgttgcagtttcttcatagtgtctatggtctttacaatatggtatgtttttgcaatggctagtaccagttttttgtttccaaatttagtactttcatcaggagctcttgtaaggcaggccttgtggtggcaaaatctctcagcatttgcttgtctgtaaaggattttatttccccttcacttatgaagcttagtttggctggatatgaaattctggtttgaaaattcttttctttaatagtgttgaatattggccccaacttttttatggcttgtagggtttctgcagagagaactggtttagtctgatgggcttccctttgtaggtaacccgacctttctctctggctgcccttaacattttttccttcatctcaactttagtgaatctgacgattatgtgtcttgaggttgctcttctctaggagtatctttatgatattctctttattttctgaatttgaatgttggcttgtcttgctaggttggggaagttctcctggataatatcctgaagagtgttttccaactctgttccattctccctgtcactttcaagtacaccaatcaaacataggtttggtcttttcacatagttacatatttcttggaggctttgttcattccttttcattcttttttctctaatgttttcttcatgctttatttcattaagttgatattcaatctctgatatcctttctttcacttatcaatttggctattgatacttgtgtatgcttcatgtgctatgtttttcagctccaaggtcatttatcttcttctctaaactggttattctagttagtagttcctctaaccttttttcaaggttcttagcttccttgcattgggttagaacatgctcctttagctcagaggattttgttattacccacctctgaagcctacatctttcaattcatcaaactcattctccatccagttttgttcccttgctggtgaggagttgtgatcctttggaggagaggctttctggtttttggaagtttcagcctttttatacttttttgtctcatcttcatggatttatttacctttggtcttggtgaccttcggatggggtttttgtgtggatgtcctttttgttgatgttgatgctattcctttctgtttgtcagttttccttctaacagtcaggcccctctgctgcagttttgctagagtttgctgaaggttcactccagaccctctttgcctggttatcaccacgggagtctgcagaacaggaaagattgctgcctgttccttcctctggaagcttcgtcttagagggacacccaccagatgccagctggagctctcctgtatgtggtgtctgtcgatcactgctgggttgtgtctcccaatcaggaggcatgggtgtcaagggcccacttgaagaggctgtctgtcccttagcagagctcgagcactgtgctgggagatctgctgctctcttcagagtcagcaggcaggaatgtttaagtcggcttaagctgcgcccacagccacccctccgccaggtgctctgtccaagggagatgggagttttatctataagccctgactggggctgctgcctgtctttcagagatgccctgcccagagaggaggaatctagggaagccctctggctacagcctctttgtggagctgtggtgggctctgtccaggtcgaacttcctggtggctttgtttatactgtcagggcaataccacctactcaagcctcagtaatggtgacgcccctcccccaaccaagctggcacttcccagatcgacctcagactgccgtgctggcagcgagaatttcaaaccagtggatcttagcttgctatgctctgtggggttgggatccactgagctagaccacttggctccctggcttcagccccctttcctgggaagtgaatggttctgtcttgctggcattccaggtgccagcgaggtatgaaaagaaactccttcagctagctcggtgtctgcccaaatggcttcccagttttgcattttaaacccagggccctgatgacgtaggcactggagggaatctccttgtctgcgggttgcgaagaccatgggaaaagcgtggtatatgggccagaatgcactgttcctcacagcacagtccctcatggcttcccttggctaggggaggaagttcttcaaccccttgcacttcccgggtgaggtgatgccccaccctgcttctgctcaccctccgtggtctgcacccactgtctaatcattcccagttccatgagctgggtacctccattggaaatgcagaaatcacttccttctgtgttgatgtcgctgggagctgcagaccagagctgttcctatttggccatcttgctagcccagattccgcttcactttcatatatttttaaaaatcttttctctttccttcagttttgagccatgaggatttcttataatctttattgtgttatctactagtatccaatctttgattttctgtagactaagaaacttgaaagccaaacttgtaaaatgagagcaaatagatccatataatgcctgagaggttcttccatgacaatgtatacatgcctggactttatgacgtctattttattgcttggaggtctttacaatttgtatttctgttggattctcaacagtattcagcttaattcagttaaaacaacatttagtagttactactatagtttagtagctattactatataatatatagtataatatatatactatagtataatatactatataatatactatatataatatatatacactatatacagtatataatataatatatagtataatatataatatactatatagtataatataatatgtagtataatgtaatgtaatatatagtaataatatactatactatatatagtatgatatagtatatatattactatatactatacatagtataatatagtatatatattactatatactatacatagtataatatagtatatatattactatatactatacatagtataatatagtatatatattactatatactactagcttatatataatatactatatatgctagtataatatactatataatatatagtatatagtattatttagtagttattactatattactaaacaaatgcgatttgtttgatgttctgaaataagattactgcttgcttttgaatttgttatattctagcagtagaggcaaggacataaactagtgatttccatacaacatggaagttacttttatagagatatgctatgggagcacacaaaaagagcacctaacccagccttgaagggagtagggaggagaaccatgaagagagaaatcaggaaaattctttggcaaggagatgcctgagatgggactttaaggatgatcagatgttgccaagcaaagggaggaagagatgaaagtgaagagaacatatttttagaaatcaaaaactcaagttaaggcagtgtaaagtaataattaaaatcattggctttgaagtaagacagttgtgtgaccttgcaaagtttaattaactctcttaaagtttagtttccttatcaacaatacctgtctcactatgatattcatgagaattaaatgaaataatggatacagcctgtaatgtcgtcagtttgatgaagacacatagtgggtttcttagtagttactattattattgacatcattatttcatgtagttaaaattattcaagtattcttaattttttgctagtcaataatacaactatgtgtaaattaatcttcatatttgtaatgtgaaacaatcatattattgatgataattactgtcatcccacctacttgtgtacattagtacattgcttctgttttttgtgattactactttattacctctggagcttagcacacaaggaggttaaaaagcagaggggcagtgaggttaagaatactaaaatttattgccacagcaaaatgggccacagttaggaagtggaattatatagctatatccctgctccaactattacacggcagaaactgtacagttataagtcaggatggctgtcacagaaacaggaaccttaggaagagctctaccatataagctgcagcagtagggtctcttactggactgcataggtagcacatgtaagggatgtgttttcttctcggttttatgtcagaccagccaatcgcagacttgctttacatttccagagataaacagctatgtatatgggaatcatttatccccaatcaccaatttgcttactgacactccaactaagatggcctctaggcttaataattttatcctcttcaagataggaatattgatttatatactgactaccactagaattattaggtgctcttaagctaaagaaaattattttctgctaatcttttaatctgttcctattacggcagcctactgataggctttatgtataattaagttctccaagcctcaatatacccatctgttaaatggagataataatagtagttatctcattgggatgttataaggattaaataaaagaatgcatgtaaaattctgcatgcgatgcctagaatatcataaatactcaatatatgttagcatttaatatttattatgttacacaacttgtttaatcttgttgccttcattggaacaaacttttaatgctgttttctgtatgtattttacaaattatacatacagtaaaattaactatttttcttttggtgtacagtttcatgttttaaacacatgtatgatttctaaaactatcaccacaataaaaataaagaatatttccatcatttcccacaactctcactttctgtccctttatagtcactcctctccccaactcctaacccttggcaaccactgatttgttctccatcactatagttttgccttttggagactgttacatataagtggttatatattatgtaaccttttaagcctagcttctttcactcagcagaatgcctttgagattcatccaagttatgtatccataatttgttattttttattaatgctttctttaagtatgaggacatttcaagtatatggtcatttatttcttttataagaatccatctgataggtatcccttaatagaatctttgtattaaataacacctgacacagtttaggctggtacaacatttagtgtggtacagcattatcaaacaactgtgttcctttaatcactaatgatattcatgcaataaaaaggatctgtaatctaataaatgtgagaaattttgaattctataaaagtaaattggattgcttgccatatgatttctcagaatttttaacatatgctatgaaatgcaaaattcctgaaaggagatatggttttgcaagtgcaaattatcaaattatcaaaattaatttttttctgctcgacaactaccaagttgtattccacagtttgggaaacattaaactaaaaatgaaaaatgtgggcttttgagtctgggtttgaatctttgtcctggtactcactagctgcttgaccctggacaagtttaatctgcattaatcccagattattcatgtataaaatgggactaatagtactttcttcatcaaggttgttgtgaggattacacaaaatttactttatatatacacatagcacaatatatgccacatggtaagcactcagtaaatggtagctatttattactagaggcaatatataggagtgtttagaatcataggctttggagtctggtagatctcaattttcttttggttgttgcttcttagctgttatttaacctcattaataaaatgaggacattgcttatgaggattaaagatgataattaaatatttagtacagttaaccatgagtggttccctgagcactttcctgaggaaataactttttattcagtcactcagtagtttatagagaaatgcatatatattaacaactaacttcagacccagagtattctgatgcagagtcgtaattagagcagaagaggttttacttcctttcaatattagagaggacatatttccaatgtatatacaaaaaagcagggggggtaaattgctccttatcctatgcttggattagtattaggggatgagagtaaattcacctacttttacacaggaaaaaaatagatacgtatggcctttattaatattaatagtaggtagttaagcttaatattattattaatattatgaaaagatactacattctcttaagtcgtggcctttttttgcaaaacagagcaaaaaacaaaggtaaaaacccccacactatttcataaataactatattagaaatgctttttaaatctggataaatcttattaataatataaatatacattttatagaaataacaaatgtgctttttaatggcaccattagtaggttggtcatttaccatatcaaatcactggtgcaagactattactcaaatcaactgaagtaaaataagttagagtatttttgtttattttgcttataactcaaatatttatgtcagaatactgatagaattataaatagaaaataatacacacattttatatgtatgtttgtatagaagctttgttaaaaaaaaaaccctttttggttatatagccagcataagattagtaaatgtcccactgataatgtttggcgccacacacagtacaaaacggaagagaaaaggaaatcttacagagcgatttctagaaacaagtagattcttcagcttagcaaataggatgtaagtgaattatgtagatgagcattatattctcaaataatttgatacaataaaagcctctaggtctttaaaaaaattagaaaagaatattttcaatttggtatttacttcttacttcttgaaaatattttttgctaacacactttttcttttgtacacatacactagagatatgtaagtattgatttgagaaatgaaaaatgaaaaactgtgaaatgacttcataattttcagatagctataatgttttagaggaatcttaaccccactctattatctaattatatcttataaagcaacagaccaaaaatcttgtttaaagttagttgagcaagatatatggagtttatactgatctatagactggccacaagtaaaatagaaaaggcaatttatctttgattagctatccttctcttacatattagctttctccatctttttatctttactcttttttcacagaaactccattatctagaattcttattttaccctctgccattctgagctttccactgtcacatttcattttatattaaaatttgtctcttttctcttgtacagattttaggccccataggccagctaattaatctgatattctgacatagactaatattccaatgatagtgatttagagtttgggaaccaagtaaagtacgtgaagatgtccttttgagagtcagtgagcacatctaccttcctccaagctcactgcctttccccaaacctaccccaatatgtttagactggtccattagtaaatttaatgtgagaatgtacatctagaaagtgggaaatggtagaatagtaggttattgaatgagaaattttgagccgggcaagttttttgctgtctgtcatgttatatggtatgcaacaaaacctgttctttataggttcagtcctgtgactttgtgtcattttaaaggacttctgagtctcattcatgttttttcctatgtagcgaaccattcataatattctctggtgggctgtcctatgacaaagcttgtagaagaccaagtttaaccatcatgcatggaaaagcaattacagtacttgaaatggatcatcctattgttgaatttctaactttatgtgaaacgccctatccaaatggtaagtaactaaaatgaaactattaatgttgaaaatcattttggaaatgacaagtttctaacaaaattaaggttaaatattttcagatgtctactgtggtataacgctgtgagctacaagtgctggaacaggttctgcaactgtacctacttgagaaactggaaataacacagatgtagtacagcaatgctggcatttcaggttctaatatcaggtaagtgctttaaactttgattagatggtggaagctgagctgggagggtctgataagggtccagggtgaaatcacttggggaagctgaggtctcttaatagcctctctcagaccagctccatcaattccatcccaaagccaatcaaagttaaagcacttacctgatatcagtaatctgtaactgtggtggtgctgcatctgtttcacatctggctttgcttcagatgcaactgcagcacctctgattactctagtaatgcagatgtgtggttaatgactttttaaaattttgagaatagtcagaagggactttgggaggagaaatgcttatatatttttattatactgaatataaagactttttgtaaacataacaactagtctaaacttatatgcaatctgtataatgaaatctaataatgatgaaatattttaataatgtggccaggtgtggtgactcatgcctgtaatcccagcactttgagaggccaaggcaggcagatcgtttgagtccaggagttcaagactggcctgggcaacataatgagattccatctcaaacaaataaatagataaataaataaataaatctaaaaagtgagaaaagtgaaaacataaaaaaggaaatatgagtcatgttacaacaacatagtatgtgtgtatacattactatatttttaagacagaatatgcagatataagagaaagagcactggacttggggacagaatatgtgaggttatgatttagctctgccacttactagctaggtgaccttgggcaagtcactttacatttattagttttatttatcgtttgtagaaagagaatagtaatatggtctccacatgactactggaaggttaagtgagcatacttcttaaactataaaaatatatatgttgtgagttccactattatatgtattaacttactttaaattatttagtctcacatttaaaagatgggataaattgatattaaataataatcaatgtagcactttatttccaaagttactaggacagacaatttacttatgtttttaattgtcaaataattattgaatcattctatggccccagtactacaagaacttgttgagcatacagataaagtattaaactaatctctgatgtcaaattgcataaaatctggtcagatgagtgagattattatgacttgttaagtttaagtaatgaaagaccttaattaagtgctgagttgtatggttcagagtataaataatgtattaatttttaagttaaatagtcgtggtttcatgcatagtaatagcagtttttggaaagagagaaaggtaagtctgattatgagagagtagagttgtttagggaacagaagaagagagaaactgtcttacaatatttatgaatcatcagaatataagtgttttttggagttacaaaaatgaataatgaaagaatgtaggaagagagaacagaagaccaacagctgagcttaggaaaatgcctcctatgaaaagccttgaggaagaagatgtgtgagcaatagaaattgagaatgtgtggtctgtgtgtatataaatttctgcacgttggtagagatgttaggacaatttctaataaggttcaatgaagcataaatgcaatgtaaccattcctattcactttcaagccatatataaaaatctttgttttttagcaatgtggtaatgaggatggaacttttcacttgtcaaaagctaggagatgtactttaactctattgacagtgccggaaaggtttctgaccatatatccacctcaagcagaacctagtccaaaccaggaccccagaaactttcctaatctagctccttcattagaggattattctccatgtaaatcacatccttgagtacatccccagctgtaatctctgggattatcattggtgttggattgtgccccaggactctcggggcacaattggtagctcgtggagaggagggtgagcactgttagtgaggccaactcgagagatgagaattagggtaaaagccatttctgaggccagatctcctggtgagataacactaatattatttcaccctttttgggagaaggaaatatggacctggcagatttgtacaaaattctttcccaggagctgtacggaggccaatgggacaagcagaaatgactgccaatgaggagtcctaattggaaggggatcagtaaagattagagactaccacaaatgtgttggctaccctgaccacctagatgaatttagaactctacaaaggaacattgaaagcatgccagggttaaggaggactaaagaaagggccttgggccatggcaggctaaatgccacaccacaaatctttgccaattgggcttttattattcccttggtctgtttcaccagtccagaggactagaggtggtaagcacaatggagatgttgataaataggccaaattatacaaatgttttcaataatttgccctgtaaaatgagttcctcgtgcattatgaagcccttgagagacttctcaggttggtataaattttccaacagggccttagctactgccatggctatggcctgttgacaatagaaggcttcaatgcaatgctaaaacatgtaaactgtaactagtacatactgatatccttgagagacagggagctgaaaaaaatattgttgccgtgcctcaaagggactttttggtaatgtgaagtggtccatgaagccacgaaatggttttccaatatggtattgtggatatatttcacacagatactaaggttgtgagctatcccaaggcatgcttgccatctgtataaataattggctgttttacctttggctaaaagacatgtctagtaagagcatgcagttctgcctgttggacagacctgacatcaggaaagataagtaaagtggcagaattaagcaagttatattgggtcatggtaaggggaggtgaggatagaaaaagaactgcatagtttgctagactctttgtgatgtgaattgaggagagccccattagagtgtggaatacagacagtgaggggggccccgttactattttcattgtggcttttacaaaagaagagacaacatcaacttctttgagacaaggagactatagtatcctatgggtacggtttgtgtccaattctgatattttaattcacctagttggttagattttaaaaggggaaatcccctgaatgtcccgagagcatccctagtctggactggggaaagagggctaggggactccatcaggatttagttataaccaaatgttagaggatcttaggagaattcagaatctagtccagtctatagccaaataacaaggactttagggcaatgcacaatgttacaatctaataacagatacaattttgcttttcttagaagcataacttttcctctccacattgatcatataagaaatctcagctattagaacctcttgaagctagatggccagaccaagtcaggcattagattttacttatagtcttaaggttcttgggcctaccaggaagtgatagtttttacttactcactgtaaaactaggaactcttgaagacaagcattttaggcacatttttacatataacatttcagttcataccttggtaatataaccaatgttcccaattgtatcctgctttcaagagagataagatttttatttaacttatataaataaaaataagaatattcatttatagcttctgaattttaaggaatcaagtagggagaaaaagcaaatgcttccacctttgttcaatagaggatactttaccaaaatattgcaagctatagatagcttatgtcagaaaatttccttgaatttggaaaacaaaacatttaagcaacaaaaacattatccttatcaattacttaatttcatttaaataattctgtttggttggccaggtgcagtggctcacacctgtaatcccagcactttgggaggctgtgtgggagaatagcttgagctcaggatttcaagaccagcctgcacaacatagcaagatctgtctctactaaaagtcaaaaaaattatctgggtgtagtggtacacgcctgtagtcttagctactccagaggctgaggtaggaggatcaagcttgagcccaggagatggaagctgcagcgatctatgattgcaccactgtactccagcctggggaacagagtaagactgtttcaaaaaatttttttttctttattttgattagcaattttggactatagcccattgcaaatacttctagagaatttaaaacaataactgtggatgacaaaaacccagaacaatcatagccaaagatatgatgagaatttccaattgacaaggcaatttagatattttggtggcatacaatcatttaacataataatcattattatggcacatatcttggcatatcagaattttatacaattttacactttttaataaagccacaaatataacttaagggaagttaaacaccattcataatttgacagcacttcctgtattatttaccaaataaacctaatcatttaatatctgtacaagatgagagataaaccctttgaggctcttcagggggcctatgtggaaaattgtaaaattaattttaggccaaaaggcttaacttaagatttgggtcctggagagacctgccaaagatgttaaaaatttcaaaaactactttctttaatagaatggtgttcactgctaaataatagttacttattcaaccaaagtaagagtaaaaatcagaagatttcaaaagcaatacagaaagttacatggatgtaaaaaccttaacccttgtaaagttcagttttctgaagtagtcaaaacccaacaaggacagcatgaagtacaggaagtttccttggtaaaacacagaatctgtgtttcctaggctcatatattccttgagcaaggaatatgtggttcttagcaagagcatatgaagttctggttacataaaataattcagacacataaagaaaagccaagagtactcaatcaagttataccgagtaaaacattgcttttctggaccttcaggataaaagtaaaaccagagaaactaggtagttctcaggaagaaatgtgacagaaatagaaatttgtttgtaattcagaggatggttgttaaacacatttcagaattaaaaatcaaaacctcttgcaatcttactaaaagcaattgaacctttgttggctgggtgcagtggctcatgcctgtaatcccaacactttgggaggctgaggcagtggatggcctgaggtcaggagttcaagaccagcctggccaacatggtgaaacccccgtctctactaaaaatacaaaaatcagctgggtgaggtggcacacatctgtaatcccagctactcgggaggctgaggcagaagaatcgcttgaacctgaaaggtggaagttccagtgagccgagatcatgccactgcactccaacctgggcgatagagtgagactccgtctcagaaaagaaaagaagaaaagaaaagaaaggaaacctttgttgttttaacataggtgaccagatttttaaactttgtatcagtgtattttaacatcaaagtttattctttagaaagactgtcacaaataatttcttttaattatagccagcttaatcacacccagaatttccttcataagttcccattcatgaaccttatcatgatttactcagaccatctatggattactgagacaccctgcctcactctatacttcctctttcttcttaagtaaccagttatatcgctctaggaaaaagatttaccatgcaagactatctcatgcaaaattattctcttatctttacatctataactctccttacatctctttctgtctctactatttacagttcctttctatcttgtttctatttccttcctaaatccacattttgacactccctttagataacctttgaattagaaaaagttattttttctcaataaaagacatttttttctcttattaaacacaccttactttggcatactttatatacagaattatatatcaattggaatttttagcttctggtaaccttaaattttattaaaaacataggaaacacaaaatcttgatttgcctgttacatatcattatttaacagataacaaccattttatttttattatttttcatttttttactttttagagacagggtcttgcccttttgcccaggctagagtgcagtggcatgatcatggctcactgcagcctcaaactcctgggctcaagcaatcctctcacctcagccccccaagtagctgaaactccaagtgtatgtcaccatacctggctaattattttatttttttgtagagatgtcttgccttgttacccagggtggtctcaaacttctggcctcaaacaatcctcccaccttagcttcccaaagtgctgagagtataggcttgagtcaccatgcttggccaagagccattttataattgtcagaaaaacgtgtttccctataacatatttttatgcatatttagtctttctcttagtatttctagtctttctattaaatttaagaagccaaggacaaccctatttatgttcagcagtttgtttcagtttttatcgtatttgaaaatgacttgtacatttaatgagtcatctattatttaatttaggatttcaaattacataaaaatttatagctatttatcccatttacctttatttatttattttagcagtgtgctgagattacttatgaaaactgagataatagacaaactagtcatcattccaaattatttatctattacttattttatacaactgcatatcaggcaaatattataaaagtaatgaccttaaagtcaaataattcagaggacacaggcattcccatcaaatcaacaaccttagactagtcccatttgccaaaagatttctaagtcaaatgtgaacttgaaaagtgcctggtcttatttgcttaatttatgagtactcatctatttataagccaatttggtaccatagacaaatacaaccagacttgtacatgcagccagatacaagtctggttgtatttgtctatatcgggcaaatattataaaagtaatgaccttaaagtcaaataattcagaggacacaggcattcccatcaaatcaacaatcttagactagtcccatttgccaaaagatttctaagtcaaacatgaatttgaaaagttcctggtcttatttgcttaatttatgaatactcatctatttataagccaatttggtaccatagacaaatacaaccagacttgtacatgcagccagatacaaataatgatcaagctttaaataaagctttagccatatgtcaggcataactcactagttaaaagggatagttagattcaaacttcgtcactgttaaactaacaattttagtttaaatttttctgttccacgtggctgaagccccttactgaattttagagaaaccagagtagcaaagtagtcgggcggaccggcaggaagagaggagctagttgaagaaggttagctctagaatcaattagaaagccaataagtctcttttctacattagattacctaaggttcctagatcatagaggatccccagtcccattatttttaatcactatcagaaactggtatctggtgggctgattaatgggcagcttctttctctacctgccaggatgattagggcactcccatttccaatggtcctcttgtttataatatgcacattgtggcctcaagagtgtacggccattttggccagcagtggggtccctaagggtcttacccatggccatttgtttttcctagcatgctccatcttgtgcctcgactggtggtggccaagagccacagcaagcagcatagcttgttgtctcatgtcgcattgcttttgcccttcctggacttgaataagatgattaaatgccttaaaagcaatctcgactactggagatattgatattcccaacaccttttctactttttgtagttttcctcttatgccaggggcactgtgactgataaaactctcaggttacctggatgttcggggttaatgtcagtgtattgcctgaaggctttaaggaccacaagaaaggaagaagcattttctttggccactgttgtacctttatggcttgtgctgctggagtcctgctacaattaacattccccattttgcttggaagtttatctcagatggctagagcaaggccctgcactagaaagagatatatatattttgggtctgcaatgtggtacttatggagattccttcccagtgaatcacccaatgggttgggtatcctctagtctcctaggagtacctaaaagggctggagggagcaatgtagtccctctattaaataattttctaattaggctgtttctgtgccatcaaaatattaactgctgcttaagccaaatattactgctcatatcagaatacaaacagaaacagaaaaagccaatcaaacaagacaaaccacagcattttggactctgagtttgatccactcaaagggagcaaacagacaaggctcaaacttgtccctgcaagcttcagacatctttagtccattctggatggggaaggttgacctccagccaataatcaagcaaataatttactcagtctagttgactggaacagacagcgaccctgagtcaggcctccttggctgccactggcagctccttcagggtttgctgagtggtcttaacaacataaacaagtgactagacaaaccctaaacttgacacatatacatatacacatccaagttccaagttcccagtcaagttcctagtcaaatttataatcgagtgccacgtgaacatacccccttattcttctttcaatcaaagttgaaatcccctaacaaagcccccttgtggaggttgacaaggctccctagtggaagttgataagaaaggagctgagagttggtcacttgtacagagattaattcaccacaaaataaaaataaaaaagaggaaaaaaaatgtgttccaaaattcaaaacttctttttgctgcaaaaatgaaagtaaaagcaccaaaagtcagcagggccatgctggggagacaggaaccaagagtaaatcactgagtaaaacacctggacagctgctcagaccctcaagtggatcccatccctgatatggagctggtgagccacagtcaaaactgtcctgaaaggatttagagaagtccgatttgggtcaccaactttgttattgaactaaactgggtccatttgcccatgcacaatggaaagccaaacactgaagcagcaggtttttgcagcaagaaaggtttatcatgagtgaactggcaaggagacagatgtcaaatctgtctccccaagctggggattgaggaaggttttatagtcagcgcgtaataagtcatgatctgattggatcttgccataggatgatgccaggaggtatgctctgactggatccttccctggtgtgataccagggctctatctgatcggatcctgcagcctaccatgcaatgtatgcttcttaattttagtccctgttccttgttctgggcacttaggttctacctgtggttgcatgctttgtttatcttggcatgttcaggttacgtggccttcaatctgggagtccatggcaactgaagagctttgttatgtaaaagttgaaccagattgatatgatatggttacacaacctataaatatatttcaaattacattgaattgaaagtaaactttttattataagcagtgttgctcttatacagatgtgaatgtatgtcatatcccagagaagcagagatactattccctcagtacatctccttgtaggcataaaatcagatctaaaatacaaaggttatggaagaataagataaatgtttgtgagatcaggtgacagattcactgtcttcacataatccaatattatcatcactccatgattattgagatatatttatactatgctacttttaatttttttcttgttctttctagtgatcttaatattaaatttgagaagcacaactttttttaagtgctctttgttacttcttactttggcttatagtttggtcttctcacatcatttaaataatatttgtatagggataaaggaaatgcaattttgctgattttatagtatatacaatatgaaaacttttcattttttatttttacttgtagaatttcaagaaccctatgctgtcgtggtacttctggagaaagatctcattgtagttgatctgacacaaagcaagtaagttatccatgtacagattaacacttttaaactctatttattttagattattggcatttgtattcttttgataggaagtattctttgtgtgaatattggtttgctagaattacagaaatgcactttggttcaatggtgaaaattaaaccagaggaatttgggaaacactgagaaaattgtgagacaacttaaaggcagcacctgatgtttggacagaagcattggagactcaggacacataaaattgatcacatttttgttgtttccttaaagaaaatcaatcattatgaaaacttgtacaatgtgatagctgagtaatggaaaatgacacatgatagaagtattattgcactactgctgcagacaacacagaagaccagaatctcaggggcagagaagacaggggccttcttttacttttattcctttttcattatgtcacaggcaattgaaacaactgtagaataatgctataatagtggtgctctccactcctttacattgtcagtaaaaatctaactgtacatttttattataatggtaatagcatgaaactaatttccatcattgtatgttcttcgcccactgatcttttagcctcatatatttgtaacacaattttgtaagttgtctctccttggcctggaatgactttctcttcattttttcttcttattaatatctgtaagattctcaagtcagatatcacttccttatttaaaaaaattcattatctatataatttggccacatattctagtatgggctctcataccccccacatttctctcttcatagcttttgacacagatacaattttctatttgctgttgcttaaagattgtctccccactaggctgtaggctccatgaaggaggggctctgtctccacatggagtcagctctcaataaatttttgttgaataaatcagtccaaattctactcttcaagttgtttgtaaatgtaagatccagggttcttcctcatactaatttgcagatattgttctcggtgtttggaaagggatgtaggatttgggccattaaatcatcataactgggaattctgcttagctgccctatttatcaacattaacactttttgggtagatgtaaggatttatgcttattcttctaagaagttctaatatgagtcttattaaaacatactcttctaatctcattggtactcaactcgtctttctacgtcatatttgttggttactcgtactttgtctaagtatctaacatctttgcaggcccattatactttacctttcatgcccactttcttcagtatatatatatatatttttttatttaaattttgttttattgtgatagactatgtataacataaaagttaccattttatgtatacatacattcttgtgcttttcattaccctatataagtatgtgaattaacattttgtttgcaagttttcatctaacatttaccttctttagcatgtattaaaatctatgtggcattcccatttcattggttattacatgaaatttaacatgtcaaaaactgagtatgttctctttccttccaaatggttacctctcagctatactgaatgttaaacaagttgtaactttggaatctctttcaatttttttctttttatctttttctttccatttaatccccaacccgaaggcaagcattagggtttacaaattatttctattcttgatttctttatgtctaaattcctctagtaagtttttagttattatttctctttttaatatctttttgcctactctttgccaatgtactaaaacaatttttctcaaaaattttctcaatatttcactttgtcaggagcctattatcgttacctcttgctattatcaaattctaaattgtaggcctggtcttcaaggggtccatttatcttctaactctgtaatcttagaaatattaataatttctactctgaaacagagaatctctgatatatctagtttaacctctggtacctctagtttaacctacttgtcccttaactagacatgagtttttcctttacctgattttgcatatataactattcttatttgggatactatctgcaacatttcagattggtggaaagagaactcctgccagaacacacacacacacacacacacacatacacacacacacacacacacactatattctctggagattggactaaactcctaatttttaattaagttcctaataatatggcaaaaaactgttttgtaacaagcacctcctaccctaaaaaaacacagtgtgtcagaagttataggatgacacagacctggaacagatatagcatagaataatactaatttcctcctagtacagtgccttgtacatatgatgttctaaatagctacaggaattttaaatttgattctgaactcatttcctttttaaggttatagtaggcttgaggatatgaaagttattacatccataagtctttattccaactatgttctctagtttacataggaaatgatcttttagatatacacagtcacatacacacaaacctacatatgacacacatcttttcattattcctgcaaaaaaatttaaaagtttcctatatattacctctttgtcttagtcccttttatattgttataaaggaatactcaaggctagataatttataaagaaaaattatttgtttggctcacaattctgatgtctggaaagtccaaggttgagtgtctgcctctgttgagggtctcaggctgtttctactcatctcagaacgtgaagggaagtcagagtgtgcagaaatcacatggtgagaaagaaggcaagagagagaggggacaggtttcaggcttttttaaacaaccagctctcatgggaacgaagagtgggaactcgtccttaagggaagacattaatctattcatgaggaatctgcccctgtgaaggggaaagacatcccgatcatagcattcttcacctgaatccccaaaactcatgtcctcacataaaagatacaatcattcttttccaatagtctcaaaagtcttaattcattttaacatccattcaaaagttcaaagtccgaagtctcatctgagacacaaagtaagttactttcagctgtaagcttataaaatatgaaacaagttctttacttccaaggtaaaaatggttgtataggtattgggtaaacatttccattccagtaggaaggcgtaacaagtctcatgtagctttaaaacacagcagagtagacattaaatcttaaagctccaaaataattttctttgactccatgtcctgcatcctgggaacattggtgcaaggggtgggctcccaaggccttggcagtcctgtccccatgtttttgctgtgcacagcccatgtggctttcatatgttggagttgaatgcctgaggcttttccagactgaggttgcacactgctggcggctctgcctatgtggcaggtttcagcatgggcacccaggctttttgatatatcctctgatatctagggggcagctgccaagcctccatggctcttgtgttctgggtgcctgcagacttaacaccatgtggatgccaccaaagctatggcttgtgccctctggagcagcaaccccagcagtagctgggtccatttgagccatagtgggagctggagttgtagggatgtgaggaacagtgacccaaaggggcacagggcagtggtgccctaggcctgtcccccaaaaccattctgttctcctaggctcctgtgattgtgatgggatgggtggcctcaaagatttctgaaatgccttttgtccattgtcttgactattaataccttgctctcttactggtcatgctaatctctttaggaagtagttgcttagattcctctcctgaaaacactcttttctttactaccacatggccaggctgcaaatttttcaaatgttaatgctcgtgtcccttttaattatagattcttcctttaggtgattccattgtggacataatttagtgtaagctgttaaaagtaacaatgccacttcttgagcactttgctgcttagaatttttttcttccagatactctaggtcatcgctcttaagattagccttccataatgcagccaaattctctgctacagtgcaacaatgcagccaggttctttgctacagtgcaacaatggggatatttgctccagttccaataagttcctaatttctgtctgagacctcattagcatagccttttctgcccatatttctgtcagtattttggtcacaactacttaaccaatctctaagaagttccaaactttccctcatctttttatcttctgagctctccaaactcttccaacctctacccatcactcatttctaaagtgcttccacaatttcagttatctttatagcaacaccgcgctccttagtactaattttctgtcttagtctgttttgtgttactaaaaggaatacctgaagctagtaatttattttttttcaaaaaaaatgtttattttgtttacaagattgggcatctgtatgtggtgagaacctgagctgttttcactcatggtgaaaggtgaagcggggctgagctggtgtgtgcagagattacatgatgaaagaagaaacaagtgagaaggagaaggctccaggctctttttaacaaccagctctcacaggaacaaaaagggagaactcattcacctccaagacaggacattaatcaattcatgaaggatctgccccataagccaaacacctctcattaggctccacctccaacactggggactaaatttcaagatgaggtttggaggggacaaacatccaaaccatagcactcccattgaaagaaagtcaaaatttacttatattttaatatttataaggatactaaataaatatttaccaatgtatataggtaaagtgcttggtttatttttaatgaattaactaagtaaacttgttatataatagtttcagattaatagaattcattgtatctatattagcaaagcaatgccactgtggaatgttagaattatgagaagtaaattttgagcttgagtaaaattttactagtattaatattacattttataaattactattacaaaaagagcatttttgttcatacaattcttgttttatggtacttaaaaaacaagcaaaatttatagtgatgtttagagacattttagggcttactttatcaaaattattttctgtttttttctttgtaaaataacactgatatattgtctttatctattagttttccaatctttgaaaatccatatcccatggacattcatgaatcaccagttacatgcacagcatactttgcagattgtcctccggatttgattctagtactgtattctataggagtcaagcataaaaaacaaggatacagtaataaggtaaaagtagaaattataaataactttttttgtattcatatcacatgatcatacttttttccattactttattttcttacattccatataggaggacttaactaaattctttttaagttataagccaacatctattaaatacataacttcttaaattcaaattttctaaatgctacatagctttaagcctatagaaatataatttcttatacagaaggtatataattatatactaagatatacttatctagtatgtacatttatatactaagtatgtacttatactaatatatatttgagtcataagatgtaacctttattttagatgaaaaaatatgtttaaatgtccaacaatgatagattggattaagaaaatgtggcacatatacaccatggaatactatgcagccagaaaaaagatgagttcatgtcctttgtagggacatggatgaaattggaaagcatcattctcagtaaactatcgcaagaacaaaaaaccaaacacctcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcgcattgtgcacatgtaccctaaaacttaaagtataataataataaataaaataaaataaaataaagaaaataaaaagactcaggtcttcctagtttataattaattaatggtttaggaaacataattattaaaagttatttgttaaataacattctagaattttttattatagtttactacaagattcaactatttacaattgtaacagattatctattatgatttctattattctcccagggctcttgggatggacaacttcaagagacactatttacatagcttctatgttaaatggcaccacagtagtttggtggtacacagactatatgatgcatgtagcaacactgtatttgtacaattaaaaatacttctttgatttgtttatataaatggtaagattgattaaaatctatatttttaagggagatggaattgtgcatttagaggtgtttgttcaatgaaagaattaaaagacagctacacacttcattcttgatgattttacacttatttttctttaagtgagctttttatcattattttaagctattttcattttaaatttctaagccatttaaacatgtatatatattctttctggataatctgtttaggagtggccaatcagtggaggagcttggaaccttggagcacaaacatatccagaaattattattactgggtaagtagatgtgttttgtgagttattagttcatcaacaaaaagatgtttactgagtcttgatacttttccataattgtgttctatgcagaataatagtttaagtaaaagtaaaaatataagaaatagcttctacccaaagattctcatcttgacagaggatataatcaaaccattggaaacataataacagaaaagaaagcatagattatatcaccaggagaaggtcaaagttgggaagtcatgagatattagtcttcatggaaatcacagaatattagctttacaaaggcccttacaaacacttatctatttctgccaaattcaggaatcactgctctgtatctgtacgagatggttattttaaatatttctcaaaacttacagcaccagaaataacactcctttgtatgacaacccacttgatgttttaatattaggaacaaaaatagagacatagctaatgataaatatgagatttaaaaagtaattaagggatctgctaatgggaagatagagtaaatatattttttcctattcttcccactaaacaactaaaaactctggatattacatataagacaaacataagatgactgggaaatgtgaagacgcatcagaccaagtaggacccctaagtcttagagaatgacatggaagtcagttccctaagttttctttctgcctcatatatcccagaattagagctaaagaagctagtaacctagaactgggaataaacacaaattaaaaatcccaacaaaatctagctctctttaatcatagaatgaagaaagtggcagtgtatcaagacagaaaacatatggaaaataatctctctacttaggtttaacaacaacacacacacatacacacacacacacacacacacacacacacacacgcacacacctttctcccacacacacaagtgtggccccaccccaactcactccagtaaaagccaagtggagagcttagagtttcacccttatcagggtataatgaggtacccccaacttccccagagtgtcagataaagcagagtagggagctggggctttgaatcatggtgggtgaaacccctcccctgtggtgtcagtggggagctagaattctcaccactgcctagcagtaatgagtagctaccactccctatccccttccctgtgtcaacagaaataaatgaggaaggaagagaagaaagagggtgggactgcaaagtattaaggaaataatggctgaaaacttatcaaatttagcaaaacaacatgaaccttcagattccagaagctgagcaaaccccaataaatctataccaagataaattattgtcaaacttctgaacagtaaacactgaaagaaaaaaaatctggaaagccacagtagagaaatgacatctgacctatggggccaaaccaatttgaatgacagcagagttttcatcagaaaccctgcctgccaaaaggaaaaatgagtagttttcaagtactgaaagaaaagaactatcaatcttgaatcctataaccaatgaaaatatccttcaagaattaaggcaaaatcaagatcaaaatctatcatttccagatgcaataaactaaaagaatttttcaacaccaaatctaccattaaaaaagtagctaaaggaagttccctacacagaaaggaaatgaaccttggttcatcaagaaggaagaaataatgcaataataaaagtatggataaatacaataggctttccatctcttggatttttaaatgtatattttatggttgaagcaaagattatagtaacagagtctgatgttactataatcacattgtctggtgtggttctaaatgtgtatagaggagatatttaacacaattataaataagagagggtaaaaggatgtaaatagagttaaggcttttatatatcttgaactggtaataagatgacactcatagaatgtgataagttgtggtacaatgtaatacctaaaaaaactgtaaaaattatgcagaggtacacttaaaaacactactgacacgtcaaaatggaagcactataataattcaggtaacaggaaggcagaaaaaaggaaacagaaaaaattatatggtatactgaagccctaatatatcaataattatattaaatagaaatggtctaaatacttccattcaaatatagagattgacagagtgggttaaaaacatgaccaactatatgttatctgcaatacactcacttcaaatataacagcatagacaatttgagagtaaaaagacagaaaaaaaaactaaaaaaagaattaattgagagtgatatcaacaaggtgacagaataggaagccctagactttgttctccacaggcacacttactttacaacaatatgtggtccaaaaagccattaggacaacttcagaaaccgtttaggaagtcacagtaccccagacaagctcaaagccaagaatggtcacattgaaatgggtaagaaaagcagggcgtttcagccacatcagtcctttttccaagctggcagagctcacaattaggaggaaaagtgcaactcatggcttcacctttactcatggcttcacctttttgagggaaagaaaagagcggaagatatacacaatgttctggatatatgttatagcggctgctcaagggactagtttctgtgtcatctgatagagatctggcaaactttggattcctgggtgccactgagagcaaaatatatttcagtggcttgtagcatcagagaacctgcagtatttcagacagatactagagcagcaagatactacaagttcctgaaagaaactggaaaacttcactagttaggaattacatgcacaagcccagagaagacaaattcccataaaaggtttgagaggctcttagaatgtctacctgggctgatttatgaaaaatgttccctgtacaaagtcagtccataaggatatgactaatttttcacattaaagtcaacaaaaataaagcatacaaagagacagggaaacatggcccaatcaaagagacaaaaaaaaaaaaaagtccagtaactgattttaacccttttcctacttgccccgagaatactcactggcagcacttgcagctataacatttatgccaagataactttgcctcaaaatatctcacttttattattattgttgtatcactctagtatattgactttggaaataaaagacatcattctatttatagcattctggttttagtagtggtatttccatttacaaaatatagtaattctccatcactgaaaatgtcttatcctaggaaacatagcattcctacgtgtgaagttaacatcattcttgtacagttgttggctgaggattcatttggtgaatttattttttccgaaatagactattctgatgttagttctgttcagaaataactccaggaacagctttcatattttattttcaccttgaaaaccagtcagattttcttcagcctcaaaaagtgtgtttacgtaaaattaaaggagcactggaagcaaactgtactttttattctaaatgggaaaagggttaaagaaacagaaatctgtgtattacctgacaaagagttcaaaataatcatcttaaagaaactcaatatattagagaatacaaatagaaaactaaacaaaattagggaaatgatgcatgaacaaaatgagaatatcaacagagtttgaaattattaaaaaaaaacaattctagatctgaagtatatgataattgatttgaaaaattcattacagagtgtcaacaacagacttggccaagcagaagaaagaatcagtgaacttgaaaataggtcacttgaaattattgagtcagaggaacaaaaagaagagggcctaagagccttacaaacacattcaagtggactgatgtacacattatgggaatttaagaaggggcggggagagagagagagagacagagagagagagaatggagtagagagaatggagcagagagcttacttgaagaaataatggtcaaaaatttcccaagttggaggaaagaaatggaaattcaaattcaagaagcttaaacaagtccaataatatgaacccaaagaagctcataaagagacacattataatcaaactgtcgaaaatcaaaaacaaaaagaaaatcttgaaagcatcaagaagaaaagttcttatcacatgcaaggaaatccccatgagattgtcagcaggttttttagcagaagcatggcagactagaagggagtgggataatatactcaaagtgctgaaagaaaaaaaaccccaccaacttagaatgctatatttgtcataaccaacttcaaaaatgaaggagcaataagacctccctatataaacaaaaactgaaggaattcatcacaactagacatgtcttacatgaattgctgagagttccttcagttgaaacaaacacactagacaacaccaccgaagcatacaaaaacttaaaagctctctggtaaagttgaatttatagacaaatatagaatatcgtaagattttaaagatggtggataaatcactttgatttctggcatataatttaaacaataacaacataaaaattactataatactatgataatagatgcaaaatataaaaatatgtaatttgtgacatcaataacatgaagagatagtgaatgtaaaggagtagattttttgtatgtagttaaagttgttatagtttaaaatagattggtataactagaagatattttatgtaatcctgatggtaaacacgaagaaaatgcctatagaaggtgcacaaaagaaaatgaaaaaggaatagaagtatgtcactaaaaaaaaaaaacaaaacccaaaggaagccagcaagagaagaaaagaaagtcaaaataaccacataacatatagaaaataataaaatggcattagtaaattattctgtaccaataattatgttaaatgtaaattgattaaactccctaatcaaaagacatagaatggcttgattgaaaaaagtagaactatatgctgcctccaagaaactcactttagatttaaggacacacataggttgaaagtgaaaggatagaaaaagatgtaccatgcaaattgtaaccaaaagaaaatgagatgaatacatttatattggactttaagtcaataactcacaagggacaaagaaagacattacctaataataaaagagtcaatccaacagaaagatataaaaagtacaaatatgtatgaacataacaacagagcatcaaaatatatgaagcaaacattgacaaaattgaagaaacaaacagaataacacaataatagtaatatatttcaatatcacattttcagtaatgaacagatcaactagacaaaagatcaagaaggaaacagggtatttgaaaaacactatagaacaattgggcctaacagacatacaaaacactatacctagcaataggagaaaaatattctccttaagcacacatggaccttgttctaggataagtaatatgttaggccaggggtccacaacccctgggctgcagaccagtaccagtccatggcctgttaggaactaggccacacagcaggaggtaagtggcaggcaagtgagcattaccacctgagctctgcctcctgttagatcagggacagcattggattctcataggagtacgaaccctattgtgaactgcacatgcaagagatctaggttgcacgcttcttatgagaatctaactaatgcctgatgatctgaggtggaacagtttcatcccgaatccatctctcaccacccgcatctgtggaaaagttgttttccacgaaactagtccctggtgccaaaaaggttggggagtgctctgttagaccacacatctgtagatgcaagttattagtaatgttagttctttggttgagtggtttcaatacgattatattctgtatattaaatctatgttacatacattgttattttcatatcaagtattacatgatgaaaaataaaatagaattaaattttgtaagggtatatagagtctcagatcaacatcctgcagatttttcagcaataaaatttaaaaatatctataagtttataattagagtaaacatacaaagtcattcatagcatctttatttgtaacagccaaaaactgaaaacaacccaaatgttcatcatttggtgaaggggtaagtagagcatatccatacaatggaatactatttagcaacaaaaaggaacaaattattaatacatgtaagaaatattatcctcaaaaacattacgctaagtgcataatgcagacacaaaatgtagtagatattatgtgggttccacttatataaaaattctaagaaaaaaagaatctatataagcagaaagtagattattggggatctactagggatgagaaagagggttgcaaattgccatgaggtaactttttggggtaatggaaatgttctaaaactggatgatggtgtcaatgtgacaactgtgtaaatttactaaaaattatcaaactgtacactcccagtgggtgaattttatagttatgtaaattacatctgaataaagctgttaaagtagagtaagccactcagtgactaaccccctctcaaaataaaaaatcagttggctatatacatatggttctatttctggactctctaatatgtttcactgatatatgtgtctgtttttcaccactagcacaaaaactttattggagctttagggtgagacttaaaccttatgtagtttgagttctccaactttgtttttatttttcaaaattgctttggctaatctagtttcttttcttttgaaaaaataatttcagcttttattttagattcagggatacatgtgtaggattgttacatgggtatattagacacaggtagcgagcataatacccaataggtagttttcaatccaaatccctcgccttctctccccactctagtagactgcagtgtctattgtttctgtgtttatgtccatgtgtacttaatgtttagctcccagttatatgtgagaacatgtggtatttagttttctgttcctgtgctggcttacttaggattatagcctccagctccatccatgttgctgtaaaggacatgatttcactctttttttatggctgtgtaatattccatggtatatatgtactatattttctttatccaatccactgttgttgggtacctaggttgattccacatgccattgtaaatagcatggcaatgaacatatgagtgcatgtgccttttaggtataatgatttatattgctttggttatatacccagtaatgggattgctaggtcaaatggtagctctgagttctttgagaaatctcccaaccgctttctactttcagtagtggcttaactaatttacattcctaccaacaatgtttaagcattctcttttctctgccatctggcaagcatctgttactatttgactttttaataatagccattctgactgttgtacgatggtatcctactgtgttttgattttctttttttttcttcttttttttgatttttgagacagactcttgctctgttggcctggctggagtgcagtggcacagtctcggctcactacaatctctgtctcctgagctcaagcaattctcctgcttcagcctccccagtagctgggattataggcatgtgccaccatgcctggctaatttttgcacttttagtagagacagggtttcaccattttggccaggctggtctagaactcctgacctcaggtaatctgctggcctcggcctcccaaagtgttgggattacaggcatgagccaccgtgcctggccatgttttgattttcatttctctaatgattagtgatgatggcattttttcatgtttgttggctgcttgtatgtcttcttttgagaagcatctgttcatgtcttttgcccactttttaatgggattatctggttttcgctttttggtttgttcaagttcctcatggattctgggtattagacatactttgtcagatgcatactttgtaaatattttctcccattgtgtaggttgtctgtttagtctgttgatagtttcttttgctgtgcagaagctcttgagtttaattagttcttacatgtcaatttttggttttgtcacaatcatttttgggggcttggccataaattctttgccaaggctgatatcaagaagagtatttcttaggttttcttctaggattttagtagtttgaggtattacatttaaatctttaatccattttgagttaatttttgtatatggtgaaaggtaagggtctagttttcactcttttgcatatggctagccagttatcccagcacccctttattgaataaggagttctttccccattgtttgtttttgtcagccttgtcaaaggtcacatggttgtaggtgtgaggctttctcagttttctcttctgttccattggtctatgtgtctgtttttgtaccagtaccatgctgttttggttactgtagccttatagtatagtttgaagttgagtagtgtgatgcctcctgctttgttctttttgtttagctatacaggttcttttttggtttcatatgaaattttgaatagtttttttttctacttctgtgaggaatgatgtttgtagtttgataggaatagtgatgaatctgcacattgctttgggcgtatgaccatcagtttgtttatttctacaaaaaattgttttaccatattttaattgtgattacattgaatttatatgccatttaggggaacaaacatctaataagtcatacaattatcaataatatatatctccttttattaatgccttattttttggtcaacatcttacaattttcagcatacagatctggcacaaattgtgttagattttatctatttcttggttttggcactgttgtaagtggtactattttgttatttccaaatgtctattgctattcaatggaaatgcaattgatttttgtatattgatattgtgtgttacaattttgctaatcatttatgagttccagtatcctttttatagaatctctgagattttctacatagccatataatctgcaaatacaaacaattttatttcttcccttttagtctgtatgccttttatttctttttcttccctatttcagtgcttaacacctccaataagatgttgaataagaatggtgagagtgaacatttttttggctttgctcctgatcttaggggaaaacatgcaatctttcattattatgtatgttaggagatatctgtaggttgttcctacacaccctttatctggttatagaaatttcctgtgttcctagtttattgaaagttttttttaggaatggatgataaatcatgtcaaatgctttttctgcatttattgagatgactatatggattttcttttgtaatctgtcaatatggtgaattttaatatggtagttgattttttaagtgtttgccttacattcctaagaaaacccacttagtcattatgtactatcctttctatatattacttgatttgtattgccaatattttgttgacaatttttatgcctattctcatgaggaatatcggtttgtaattttctcttcttgtaatgtttttatgtggttttggtgtcagggtaatgctgagttcatcaaaagtgttgggaagtattttatcttcttctattttctcgatgagtttttatagaattgacatttgattattaccaaataatgatgcaactctagatatatttggtgatttgcttttatattttgaaacttaactgaattttactatgatattcaattcatatttatattaatatcaaaattatctatccttttattgaatataaataattttacatgaaaatatgttgttcactttccacaggccatttttcattgttctccattacatatataacctttttacagtaaagtctaaggaattattgttctttttctaatctttagattttagtatattgtttaagaaatgagccattgttttaagcttagaaatggtttagcatacattagttttcattaaagtggtatttttgaatcaaaattgtatcaacagtaactcaagtttctgtacatttggagtgattatgatttttatttagtatactttaattaatgctaatttatttctcatctagtcatgcagatggatcaataaaattttgggatgcttctgcaagtaagtttcaagtttctgtacaacagaaaccaattggttaatatttacttatagccagctaccactttttagtttgggcaattaaaatttcagatatatttttagcacacatatgtggctgtgttacaaaaatctattacctacactgttagatcagttgaaagtattatctctgctttacttctcttctataatataaggtaaacaagactaagtcactctttgtcagcaacccattatatctacaagaggcatgatacatcagaaaaagtaccaaactctgttaaattaactctgttcaaggaatttccttcaccctctacctgtgtggtcttcgccaagtgcttatatccctctagtcttcacttttttttccccactcatctaccacatcctgcaaagatcaaatgatttgataactataagaactctttttaaattcttgagaattatgtaacttacagaataaataaggtactctgctcaatgttgaaggaatgcaaagatacttaagacttcattatactcatatatacccttcagaaaaattgtagtcattagaaaagataaagaaatgcacatatataactatagggaaaacaatataagaactctcaatgcagtaccccagatctgtttgctatcagaaatgggagagtcttattgagacctggtagatccaggaaaggtattttgatggagttaacatttagtgtgagttttggaagttagttaacttttgacaggaataggagtgaagaacaagttaacagtgactctaagtttctgaagatgagtaaccaggaagatgtaggtaactcttttggaaataaggaataaaagagagctttgaattttttagtaaaaccataaaattcaagtaaaaatatccagcaggtaaggagaacagtcagaaatggaaaccaatgaagaagcagcataaaagtgatgtttgaagctgtagaaatgaatagcttctgaggaagactgcaataaacacacaagcagaggaagaaggttgaatattgatgatactcttagcccacaaggtagagtcccttgagcaagcaaactaactatcagcaagagaaaaggattaaaagatctaaacccacacattctgaagtccccttctgacttcacataataaaaagcaactgcctaaagagaaactccaaaggacaacagactttctgttgatgaatcttctcatgcaaacctgagtttgttcctggaacaaaattcattgcatagtgatgccattgctcctttcccaccacctcaaagtcactttttggcttttaaaatgtggagggccaggcgcagttgttcacatctgtaatcctagcactttgggaggcctaagcaggcagattgcctgagctcaggagttcagaaccagcctgggcaacacggtgaaaccctgtctctactaaaaaatatataatataaattagctgggtgtggcagcatgcgcctgtggtcccagctactcgggaggctgaggcaggagaattgctggaatctgggaggcagaggttgcagtgagccgagatcacaccactgcgctccagcctgggtgacagagcaagactccatctccaaaaagaaaaataacaaataaataaataaataaataaaataaaatttagaggacactttaacactttaattattagagtgaataacacccttaagcatgcataataatattttgagaagttaatttttaaataaatattttatcacatttagaatataaattgcaaatgattgcagcatgtttaatattttcactgtaatcaaggtcatatctccaacttaatggatgtcttaaaaaaattacttagtttgctaactttgtgaaacactgtctaatacagaaagcaaaatgaatttgaataactgagtttatattattatgtatcttagttttctattgctgagtaataaattaccacaatttaacaacttaaaacaatacccatttatcatctcactgtttctgtgtgttaggaatttgattataccttcgctgggtcctttgctcagggtgtcacaagactgtaatcaaggtgttggctggggctgaggtttcatgagactgaaggttctcttccaagcttatgtaatcgttggcagacttcattttcttgcacattcagagctcatggtagcttgctgcttcaaagctagcaagagtgtctctttaccttcagggagggcctcagtccctcttttaagggggccatctgattaggttttggctgttaagaataagctctttgttgattaactcaaagtcaactaattagggaccttaatgatgtctgcaatatcattttactgttgtcatgtaacataaataatcataggaatgataccctatctgacctcagaagccaggctatagcacgcaatacaatcctttgtctattttttaaaaaatctattttagcttgacataatttcaagcttacaaaaacattgcaaaaaaaaaaaaagtactatgaaatggtttatacctctcaaccagattctccaaatattcctttcctctccctggctctctcttttactctttatctcttccttccatacatttttctctcacacacatacatatatacatatagctttttttcttacgcatttgagagtaagttggagacacattacatacccctaaatacttcagtgtgtatttcctacaaacattcacttacataaccagacttcagtcatcaaaaccagtagattaacactgacacaacactattatctaatctccggattttattcagcttttgcaaatttatatatatacatatatatgtgtatatatatgtatatatacacataaatatatatactttttttttttgacggagtctcgctctgtctgcccaagctggagtgcagtggcgcagtctcggctcactgcaagctccgccccctgggttcacgccattctcctgcctcagccccagtagagtagctgggaccacaggcgcccgccaccacgccccgctaattttttttttttcttttttttttttttttgtatttttagtagagacggggtttcaccacgttagccaggatagtctcgatctcctgacctggtgatccgcccacctcggcctcccaaagtgctgggattacaggcgtgagccactgcgcccggccgcaaattaatattctttacgacaaaaaaatccaggattatttttgcatttagtcattgtatcttctgagttttaaaaactctggaaaagttcctgagtcttcatttcatgacactgacatttttgaggagttcaggccggttattttatagaatctccttcagtctggttttgactaatgtttctcattattagattcaggtgatgcacttttcacaggattcatatttaaaactttactcaaggatcctttgtagaatcatagttcttttatagagttattatcatcatggtctccaatggaaaaatattcccccaaatattcttaaaaacagttcacaaacacaatgtatgagattatatctgaccctttcttgacacagagccactcagaaaagatcccttctcaaatagttacagattcttggactcccaatattgctaactggtaaattacaatgtttcttatctgaaggagtgtctaaaaatttgttgagagtagtaaaccctctaggaataccatcaacctctcacctaacaatcaaaggggaaaactgagataaagaatagaggagtctccgctagggaagaattattttcagtattcccattttagactttctgtgccccaatatttttatcaataaataatgataaaaatacttccttcatgagacttttctgagaatgacacaagaaagcaactatatattccttggtatgtagtatatattcaaggaatgtttatttttttccctgtagtctccctctagctgctgtactgatatgaaagcgtggcattgaatgctttactggttaaaatgtaattcactttgtctacttaggtttacttttgttgtttaacaaatatattggaaaagctttaataacatctaagaattaagtttaaattagaagataactgtgcttcgatgtcttatagtaactctgcagatgctgtacaagctaaaaacttcaaaagtgtttgaaaaacagaaggtaggagaaggaaaacaaacatgtgaaattgtagaggaagacccatttgccattcagatgatttactggtgtccagagagcagaatattctgtgtatcaggagtctctgcatatgtcataatttataaattcagcagacatgaaattacaacagaaatagtggtaagttatttaaaatttaactttcacttttacagttattaaaagaaagctattatcatagatttgactactacttggtatggtttccatgaagtgtgcagtatgtggctagtaatacaattcacaggattttaaattattattgttacttactataacatattaataaatgatttggcctaaaaggccaaaacaattctctatcaaaacttggtatttttttcaatgtcaaaacaagcttagtatttaagttaatcttgttacaaattaaacatgttacaattttctcacttttctctttgatgttacatgagttgcatctacctggccgaaataagtcaactctacaacatgatgttttgaactatgtatatattgtggaatatacacctatatattcttctatatatactaataaaatgtataggttttatacatatagttattgatttatttttgtataaaaatcaaattaatgcaggctttgttctatacttttattaatttttaagtttatctgatttgtattttctcatcaactgtttgacataaataattatttctcagctacaataaggttatttttaatgattttctatgtagcaacatttttatggggtagatctaattatggggcaaccttacctaatcttaatttttaaatcaacgaaatactctgcttattcaaaagaataatgattttatgggataaattaattctaaatgaagccacctataaacaactgtccttctctaccttgccccttttaccagaatataaagattatttactataggcctgggtataagtgtttttacctcaacagctaaaattaatatcacccttttattgtatagtagctgaaagctaaggctttgagtcagataaacctaggttttaattctggctttcccattaaatatctgtgtgactctgaacaagccataagtcagtagtagaatgtagctatgattcagtttcatcacatgtacaattccctgtgtaaataaaatgggaaaatggaaaataaaaataaacttggaatataaataccaatttcatagggttcttgtgatgattatataaagacattataatagtgtccttactgtagtaagcactcaataattggtaactgttttgtcaccaccagaggtttttctgtagttttaaaataattatgacaataattttggtgatattcccataatgacatttttgtaagtaattgttttcaatcttaaaaatgctcatttttacattataaggcaaatatgtgttataaaatcagttctaattaaatcatttaatgcattttatgcattcataaagtatttagttttaaaacttttttagtttaataaaggtttttaggtcacctttttattcctatgtaaattattatatgttttttatcaagtaattctgatctgctaattagattaaacaaaagccaaggtaatgaaataaacaaccaaaaatatggaattttgtttggaaaatttttagtgaattaatgcaaagttaaaatgcaatgaaagttttttatactaaaaggctttaaacaagtaattttttcatacacacacaaacatacacactacacacacatatacacgtttgtgtgtgtatatgaaaaaagtttaatttctttcattggaataaccataatcaacttctccttttattttatcatatatcaaattgtaatatataaattgtaatttatactatatcttaaagtatatttattatataaaaactttatcttcactgaggtatttttcttttaattctgaagtttaaaaatttacattttttgtgattgccattgaatattccatataattaactatttgatttagtatgagatacttctcaactttcctgtaaatagtattgaacttattaatttgaaaaaaactgtgtgaatgattcctaaaaagttatcaggtattttaatgtgattatttattatgacttagattaaattaaaacgatgattattagtgtgacttaaattaaatttaaacttgatttttttaagtcattagaggtacgacttcagtatgatgttgaagatattattacccctgaaccagaaacaagtcctccgtttccagatctctcagcccagcttccttcttcaaggagtctttctgggagcactaacactgttgctagtgaaggagtaacaaaggacagtattccatgcctcaagtaagagtttctaccaaattttcaaacaattttagatattaatcatatgtctttgaaactgtgacaaatgaaattaattttctcttattatcaagctattgtcaggtgatctacaattcttcaggggttactctggtcttttctttgaacatctgtgaagagggcataatattttcacccttcattcacttatttatatatttccttcccagaaggactctaaagaaaacatggctttcacagaataggaagtttggcagggcagaaacttggtgacatgcatgatatttccaattgaaaaagtatgtttatggggtgtgatggctcacgcctgtattcccaacactttgggaggctgaggtgggaggaatgcttgagactaggagtttgagagcagcctgggcaacatagcaagaccttgtatctacaaaaaatttaaaaattaactgggtgtgatggtacacacctgtagctccagcttctagggaggctgaggcgggacaatcactttagctcaggagtttaaagttgcagtgagctatggtcttgccactgcactccagcctgggtgacagtaagaccctgtctccaaaaaaataataatgataattttttaaagaagtatgtttatgtaatttctttagctttcttggaatcaaaaagaaaaccaagtttactatctactacaagagttctatattagaaaaaaggatttctctcatgattgctagtatatttcataatctttcttttttaaaactatttattaataagctaaacaaagatttgcatcatgttcaataaaacctaaagttaacaaagcccatagtaatattttatgattttagtaatagagtataaattactacttactgcttctataccatcaaatcaaatatttctagtgttagctggctggagaattaaacctaagcagggaatttctttgagctgcatatctacatttgccactcaaaaaactttagacagctagttttctcatttcttacaaatatgcttatggaaaatttagagataagattttaggagcaaaattcatgcaattagcagatgctatacttttgtaatcattgattgtcctctcaaaattttcttttgatgtacataaaaagaaggaaatatgagcaaatattactgggaggaaaatctacaaagagaaaacatcatcataaaattttagctagtggatatattttttgaaagtagcatcagtagtatttgataattggtttgttgggaagtatgagagaaagatattagtcagctttaaaggaaaataggaattcagatgctagatatgttgaactcttacactggagggtaggttaatggtcatttgttttattgttatgctttataactgatatatatgtaacatatattacattagaaaaataattacataataaaaataacttaaaataatattctcaaaagaaaaaattgaaatgataaaggccagttgaagttgtggacctaactggctgaaaagccacataaagaaataactaagtaatcataagggactcagcatattttgagaaaactagaaggcaccatccatctgcatgctgcctgcaatgcctggtgttgtatatttctgtagcatgattctatgtaaattctcaagataagtttgaccatgtttatttaagctgtatataataggattgtttttgttcttaaagtgtgaagacacggccagtgcgaatgcctccaggatatcaagcagaacttgttattcaattggtgtgggtagatggtgaacctccacaacagattactagtcttgctgtaagctcagcatatggaatgtaagtaattaaacttttttatgatatgtattatttagctaatatgtttgattttttagatgttccttgcttaagtcctaaaaatgaaaagaagcccttacctggatttttattagattaaacaatatataagaaaaataatttaaatttacattatggttttttgttctttcttgaagtcaaacctgtgatagtgttcccaattttgatgttagtaggagattgttaggattttattacacttaaactgtgttgtttgtttttatattgtctttttttctctttatatttcattttggatactttcttttgacttatcctttagagttcactaactccctcttcaactgtgtctgatctgatggtagatccacctatggagttcaatttcagctattttatttttcagttctagaccttacatttgattattttaaaacatcctgttctcttcctaaattatcactctattctttatttctttgaacatattgaatgtatgactttaaaatgtgttactttaaatatgtgtttgatacttccatatttggtatctagtctattacatttcttagttttgggtcacattatattatgttcatgtatgccagtttgtatgatttttttattagttgttcctggttttttttttaattgagaaatgaacattataatttgaggttctagatgatactttcctccagaaagtatctacatttcctctggcagtctaggttaaaaaactattgaagggtcagaacaacataattcaagcagacatcaggtctttgaaagttggattttattcccattaaagcctaatttaatttcagttaatccttatttctaggttgtagccctccacagaggttgtgtcaaactatactcccaccaccaatgtttagaatgtctactttcctacaacctttctaactacaatgtataatcaaactttccatcctggtcagtttgttaagtaaagagtagtatgttattataatatcagtaaaatttttgtatatcttaagtgaaattgaacatcttttcctgttttgtgacattctgtttctattctttgtccatttgtctgtaaagttgttggccttcatagagatttgtgaaaactgtttgcatattagggaagttagctttctctatagtgtaatttgcaatgatcttccctgcttttgtttgctttatgactttgtttaagatggttcttactttaaagaattttttgcaattctattttttgttatcttttatggctctgaatttgtgtcttatttaaaaagtccttcctcacttcaagataataataaaaattaataaaaacaaaaaaattatgttctctctaatatgctttttttcttttatatgtttaaatctttgatctgtctggaatttttttaagtataagatatgaagtaagtattaaactatattttttcctgatggctaagaattgtgccaataccgtttcctgaatacttcatctttctatgcttatttggaatcaacttttatcaaataatacattaccttatatatttcacttttatttctgtacttcctaagctgagtcttataagctccaagagaatgccttgaaaccatcagtaaggagtccatggaaaaaagtcttatctttgagtacctggaattttcttcagggggatgtggaggatatatgtgaacatagagtattgggtgcttgcttctttactagaatattatttgatgggaaagctggcaaccacagttgatggatgatgggagagaaggaatggactgtgggatagcctactgtttcattatttgatacggtaagaatatatgattattctctagcccaagtaattactgtgaaagatagttgagctcaagccatcttctgagttcacttctctagagtttgacctgtaaagacaaggggacttcagaattcagagactataaagatgtgtcacctggttcagaagctgaagtttgttagaatagatcagataaaaaaacacatttcccttataagggaactgtggaggtgaaagttattacagagcttctgaataactgacacttgtatgaaaatgacagcttggacatctatctcatagagagcctccactgcaaaaatcctagttcatgtggctactagagtaaattccaccaagttttaaagaaataaattttacaagtattactttaaatgttcctgagaattattaaagatgaaatcatgttcatctcattttatggccaacataactcgatgcaaaaacttgaaaagggtattacaaaaagagaaagttgtaagtctatatcatttatgaacatggatttaaaatcccaaccaaaatatagataaatctagcaattaaaaaagataacatatcataaccaagtttggtttacaccaggaattcaaagtttttaaacattttaaattaatcagtgtagttcatcacattagcaaataaactagaaaaaccatatgatggtctggtcaggaatgcaaaaaacaaaaacatctgataaaattaaatatccatttatgacttcaaaagaaactaatagctaaaatggaaggaatttttcttaatctgatacattttagcaaatatgctctatggtgaaatgttagagactttgtctttgaggaaaaaataagagaagtttcttagtccatttgggctgcttaacaaaatatcttacaaattggtaatttgtaacaactaagatttattgctcacagttctggaggctagaaagtccaaaatcaaggtctcaggagattcagtgtctgtctctctgctttgctctctgcttcaaatatagcaccttctagctttgtttgcgcttggcagaaggagtgaacaaactccctcagaattcttttatgagaaaatgaattccattcataatggcggaatcctcccaaagacccagtcaccttcccaaggccccaactcttaataccatcaccttgaggattagatggtctgaatttggggaaacacaaaaattcagaccataacattgtgaccttgcttcccaaaatttatgtctttctcatatgcaaaatacattcttttgattctaatagctccaaaagtcttaaaacattttagcattaactcaaaagtttaacgttcaaagtctcatcaaaatatcatctgggctggatgtagtggcttacgcctgtaatcccagcacttcgggaggccaaggcaggtggatcacctgaggtcaggagtttgagaccagcctggcaaacatggtgaaaccccatctctactaacattgtaaaaattagctgtgcgtgatggcacgtgcctgtaatcccagctactagggatactgagaatcgcttgaatccaggaggcagaggttgcagtgagttgagattgtgccattgcactccagcctgggtgacagagtgaaactccatctcaaaaaaaaaagtcacctgaatcatatatgggtgagactcaaggtatgattcattctgaggcaggtttcttctccaactgttaccttatgaaatcaaacaagttatatgtttccaaaatacaatggtgggatcagcacaaggtaaacatacccattctaaaaggaagaattaggaaaaaagaaagggataatagctccaaagtaagtcccataaaactcccatctccctgggacagagcacctgggggaaggggtggctgtgggcacagtttcagcagacttaaatgttcctgcctgctggctctgaagagagaagtggatctcccagcacagcgcttgagctctgctaagggacagactgcctcctcaagtggatccttgacccatgtgcctcctgactgggagacactagctggcatgggtcgacagacacctcatacaggagagctctggctggcatctggagggtgtccctctgggacaaatcttccaaggaaggaacaggcagcaatctttgttgttctgctgcctccactagtgatacccaggcaaacaggttctggagtggaccacccagcaaactccagcagacctgcagcagagggacctgactattaaaaggaaaactaacaaacagaaaaaaatagcatcaacatcaacaaaaaggacattcacacaaaaaccccatctgaaggtcaccaacatcaaagaccaaaagtagatgaatccacgaacatgaggaaaaaccagcacaaaacgatgaaaattccaaaaacaagaaagcctcttctcctctaaatcatcacaattcctcaccagcaagggaacaaaactgaatggagaatgagtttgacgaattgacagaagtaggcttcagaaggcaggtaataacaaactcctctgagctaaaggagcatgttctaacccaatgcagggaagctaagaaccttgagaaaaggttagaggaacagctaagtaagataaccagtttagagaagaagataaatgacctgatggagctgaaaaatacagcacgtgaagcatacacaagtataaatagccaaattgatcaagtagaagaaaggatatcagagattgaagatcaacttaatgaaataaagcgtgaagaaaggattagagcaaaaagaatgaaaaggaatgaacaaagcctccaagaaatatgggactatgtgaaaagaccaaacctatgtttgattggtgtacctgaaagtaacagggagaagggaacaaagctgggaaacactcttcaggatattatccaggagaacttccccaacctagcaagacaggcaacattcaaattcaggaaatacagagaatatcacaaagatactccttgagagagaaaccacaagacacatacttgtcagattcaccaaggttgaaatgaaggaaaacatgttaagggcagccagagagaaaggtcaggttacccacaagggaaagcccatcagactaacagaggatctctctgcagaaaccttacaagccagaagagagtaggggccaatattcaacactcttaaagaaaagaattttcaactcagaatttcatatctagccaaactaagcttcataagcaaaggagaaataaaatcctttacagacaagcaaatgctgagagattttgtccccaccaggcctgccttacaagagctcctgaggaaagctgaggcagattcttctccaactgtgagcttatgaaatcaaacaagttatatgtttccaaaatacaatggtgacatcagcacaaagtaaacatacccattctaaaggaagaattaggaaaaaagaaaggggaaataactccaaagtaagtcccataaaactcccatggagttttggaaagaaaaaaccggtactagccactgcaaaaacataccaaattgtaaagaccatcgacactaagaagaaactgccatcaactaacaggcaaaataaccagctagcgtcataatgacaggatcaaatttacacataacaatattaaccttaaatgtaaatgggctaaatgccccaattaaaagacacagactggcaaattggataaaaagtcaagacccattggtgtgctatattcaggagacccattgtatgtgcaaagacacacataggctcaaaataaagggatggaggaatgtttaccaagctaatggaaagcacaaaaaaaaaaaaaaaaagattgcaatcttagtctctgataaaacagaccttaaacaaccaaagatcaaaaaagacaaacaagggcattacataatagtaaagggatcaatgtagcaagaagagctaactatatatatgcacccaatacagaagtacccagattcataaagcaagttcttagagacagacaaagaaactcagactcccacacaataatagggagacttttacaccccactgtcaatattagacaaatcaacaagacagaaaattaataaggatattctggacttgaactcagctctggaacaagtggacctaataaacatctacagaactctccaccccacatcaatgaatatacattcttctcagcaccacaatgcacttattctaaaattgaccacataattggaagtaaaacactcctcagcaagtgcaaaagaacggaaatcataataaacagtctctcagaccacagtgcaatcaagttagaactcaagattaagaaactcactcaaaaccatgcaactacatggaaactgaacaaccttttcctaaatgactactgggtaagtaatgaaattaacacagaaataaataagctctttgaaaccaatgagaacagacacaacgtaccagaatctctgggacacagctaaagcagtgtttagagggacatttacagcactaaatgcttacaagagaaagcaggaaagatctaaaattgacaccctaatatcacaataaaaagagctagaaaagcaagagcaaaaatattcaaaagctagcagaagaaaagaaataactaaaatcagagcagaactgaaggtgatagagacatggaaaacccttcagaaaatcaatgaatccaggagctggttttttgaaaagattaacaaaataaatagaccactagccagatgaataaagaagaaaagatagaagaatcaaacaggaacaataaaaaatgataaaggggatatcacctctaatcccacagaaatacaagctaccatcagagaatactataaactagtatttctagtttataataaactagaaaatctagaagaaatggataaattcctggactcatataccctcgcaagactaaaccaggaaaaagtcaaatccctgaacagaccaataacaagttctaaaattgaggcagtaattaatagcctaccaaccaaaaaatgtccaggagcaggtggattcacagccgaattctaccagaggtacaaagaggagctggtaccatttcttctgaaactattcaaaacaatagaaaaagagggattcctccttaactcattttatgtggccagcatcaccctgataccaaaacctggcagagacacaacaaaaaaagaaaatgtcagaccaatatccctgatgaacatcgatgcgaaaatcctcaataaaatacgggcaaaccgaatccagcaggacatcaaaaagcttatccaccacgatcaagttggcctcatacctgggatgcaaggttgcttcaacatgtgcaaatcaataaacgtaatccatcacataaacagaaccaatgacaaccacttgattatctcaatagatgtagaaaagacctttgataaaattcaacagcccttcaggctaaaaactctcaataaactagtaattgatggaacgtatctcaaaataataagagctatttatgagaaacccacagccaatatcatactcaataggcacaagctgggagcattccctttgaaaactgacacaagataaggatgcggtctctcaccactcctgttcaacattaatattggaagttctggccagggcaatcaggcaagagaaagaaataaagggtattcaaataaaaagggaggaagtcaaattgtctctgtttgcagatgacatgattgtatatttagaaaaccctatcgtctcagccccaaatctccttaagctgataagcaacttcaacaaagtggcaggatacaaaatcagtgtgcaaaaatcactacaattcctatacaacaacaacagacaaagagagtgaactctcattcacagttgctacaaagagaataaaatacctaggagtaccacttagaagggatgtgaaggacctcttcaaggagaactacaaaccactgcccaaggaaataagagaggacacaaacagatggaaaaacattccgtgctcatagattcaatgctatccccatcaagctaccattgactttcttcacaaaattataaaaaagtactttaaatttcatatggaaccaaaagagagcccgtatagttaagataatcctaagcaaaaagaacaaagctggaggcatcatgctacctgacttcgaactatactacaaggctacagtaaccaaaacagcataatactggtactaaaacagatatatagaccaatggaacagaaccaagttctcagaaataacaccacacatttacaaccatctgatctttgacaaacctgacgaaaacaagcaatggtgaaagaattccctatttaataaatggtgttgggaaatctggctagccatatgcagaaaactgaaattagaccctttccttagaccttatacaaaaattagcacaagatggattaaagacttaaacataagacctgaaactataaaagccctagaagaaaacctaggcaataccattcaggacataggcatgggcaaagacttcatgactaaaacatcaaaagcaatggtaacaaagccaaaattgacaaatgggatctaattaaactaaagagcttctgcacagcaaaagaaactatcatcggagtgaccaggcaacctacacactgggtgaaaatttttgcaatctatccatctgacaaaggtctaatatctagaatctacaaagaactttaacaaatttacaagaaaaaaacaaccccatcaaaaagttggcaaacgataggaacagacacttctcaaaagaagacatttatgcagccaacaaatatatgaaaaaaagctcatcatcactggtcattagagaaatgcaaattaaaatcacaatgagatattatctcacgccagttagaatggtgattattaaaaagtcaggaaacaacagatgctggagaggatttggagaaataggaacgcttttacactgttcgtggcagtgtaaatttgttcaaccattggggaagacagttgtggcgattcctcaaggatctcaaaccagaaatattatttgacccagcaatcccattactggatatatacccaaaggattataaatcattctgctataaagacacatgcacacatgtgtttattgcagcactgtccacgatagcaaagacttgtaaccaaccgaaatgcccttcaatgatagactggataaagaaaatgtggcacatatacaccatggaatactatgcagccatgaaaatgtatgagttcatgtcctttgcagggacatggatgaagctggaatccattctcagcaaactaacacaggaacagaaaaccaaacactgcatgtccccactcataagtgggagctgagcaatgagaacacatggacacagggaggggaacatcacacactgggacctgtcaggggatggggtgctaggggaggggtagcattaggagaagtgcctaatgtagatgatgggttgatgggtgcagcaaacccccatggcacatgtatacctaggtaacaaacctgcacattctgtacatgtatcccagaacttaaagtataataaaaaaagaataactgaaagatatatattgattattaccatattatatacttgaatacacattaaagcgtaatagattgatttcatctaatgaatgcaaacaaagcatttatatataataaaaagggaaaagcagagagagaaaaaccacggccactttctaaacaatgaattttctatttttttttcattgtgagatgctaatgagttagcagccggccaaaagaccagtcagggtatttgcttttggacagctgtatgaatcatcaactaaactgatttcatttatttctagcttttccaaaaggctttagctgttcagtttgtcgcacatatatggaagacattttctgtattatttatgtcattatcatttagtagtatgcctgtctgaattacaccaggtctttatcattcttcttcttataatttctcaatttcacccttttggtcaaactcaacccccaagctgactgaccatgagggcctcagtctctttatagaacagattattagttatatagtacctcattacaatgcctatgtagcagcatttcagtatctggacattagacattaaggggggaaaaaagcataagacaatcatgattattataagaaatatgtggaaaccacttgatgttctaaatcctggttggccgaagtctaactaggaaaataattttcaaggattaatgtggttaactttagttaactcagtggccttactattccattcactattaattgtttactcttttgaagaacatatcaaggggcaactgttaagtcagaaactgtgaagggtctaagatgtttccctcttagaaaatagtaaatttgtctgcgacagtattatatgtgtgtgtgtgtatatatatatatgtatatatatatatagacagaaaatagtcctctgggtcagaacaaagatagtttattagtgacagcaaaagcagcagcttagtgcaagatcttgcatcagttctctgagcccacaggggaacatggtgagtggcagatggtacttgcatgtgcaactgggtgcataataaaagaggaactccaagttttaaaaactcacatcttatgtaggtctgctggtgaactgcccatttatctttactctggaacataagcaaatattctctggggaagaagagaggttttttatctctactaccctgaaatgtctcaaagtagggagatgcccctaagctttactattctgggatgtctctttatacaaacataactgtaaatgccttcactaaaaggactgtgcagtacagtgaagtactaatggagaatggtctaccaattgtaatgtgaccagttgtacattattatttaggattaattgtgccagtttgtttatattagcctgtgagatccttagacttaagttgtgttacttgccatttgagtctatgtttagaagtaaattgcatatctcacgtttcagtttaagaattttttgctggaatagaattcttgtaagaacctttgaaattcagtcttgttcccctttggatatgttgtgatattgggcttttgataaaatatgagtagtcactcatattgagggttttgctctgaacttggaaagataatataacaaatttaagaactgaaaactggtcttactctttcagtgtatgtttcctaagaagaagagctttttttttttttttttacatcataagcatagtgtattttttaaattaagaaattcaacattgattcaggactattttctacttcacataccatattaaatttctagatatgtcccaataatgtcatttatattgtctattcacagaacagaatcaaatccaggatctggcattgcttttagttttcatttcttcttagtctcctttaatcgggggcagttcttcagcattttttttttagatggtgtctcgctctattgcccagactggagtacagtggcacgatctcagctaactgcaaccttcacctcctgggttcaggcaattctcatgcctcagcctcctgagtagctaggattacaggcatgcaccaccacacccagctaatttttgtatttttagtagagatggtgttttgccacgttgaccaggctggccttgaactcctgacctcatgtgatccgcccacctaggcctcccaaagtgctgagattacaggcgtgagccactgtgcctgacccagcatttattttttaaccttcatatttttagagtacagccaattatattgttaactgtacctcagctgagtttgtctgatatttcctcatgatgagagtaaattaagcattttggcaggaataccacagaaacaaggtaatgtcttctcagtttatcttatcagaaggtacatgatcatggattgtcctaattttagtggtgctaattttgattgcttgttaaggtgatatctaccaggtttctccactataaagttgctgtttcccttcatagataatagtttgtggggagatacttgaaagtttttaaacttcttactcatcaaactttcacccattacatttagcatccattggttattctctgttacccttctatatttataagttagattctactattaagagaccataactccctatcctatataaacatttatttacttgtttactatataagtatgaaatcttagatttgcattttattcagtgagttaagatctgtttctatcatttgtgcctgtgatgctctaattcttccagatttgaccatatggaaccccatcaaaatggcttctatgtccttttgatatgttcccatcgttttttagcagtttgttattttccagtacaatgtgatgttcaatatgtatcttgtatattctttagtctacccctggaatcagctatcttagtcttcttttactggagaatgttatttagaaaacaatgtctgggcacaatagatgctcatttctattgttgtcattgcctctagcccctatcagtatacaaagctaagaaaaaacaaacattgaacactttttgatatatatgagatacaattttaaaggatatatagaggttataattttgaagtagcttatcaatttattcttttatattcttgcttttggattcttctaagaaatctttttatcatgaatgtcttgtgaattcagtcaaatccttttactgcatcaattaaaactgtattagtccattctcaaactactctaaagacatgtctgagattgggtaatttatgaagaaaagaggtttaatttactcacagttctgcaggctgtgctggaagcaaagctgggaggcctcaggaaacttacaatcatggtggaaggtgaaggggaagcaagcacatcttactatggtggaacaggagatatttgtccattttaaaattttcttcctgtgattgatttctagttttatactattgtgatcaggaaaggtacttgatatgatttcaatcagctaagatttggtctaacatgttatctgttctgaagaatgtctcacatgtgctggagaagaatgtgtattcttctgctgttgaatggaatattctgtatgtgtccgttagatccatctgcactaacatatagttcaggtccaattttctttactgattttttgtctagataatgtatctattgttgaaagtgagagtgttgaaatgccctacttttattgaattgccatttgtatctcccttcagttgtgttaatatttgctttacatatttaggtattctgatattgggcacatatgtattcatagttgttatatcttcttgatggattgacttctttattgttatttaatgatcctctttgtcttatgacagtttttaacttaaagtctgttctcttctgatataattaagctacctctgctctattttagcttccatttttatagaaattcatgttcatcccttcactttcagcctatgtgtaaggctaaagttaatctcttgtaggcagcatatagttggatcttaatttttgatccattcagccactcttccttttgtttggagaatttaaacaatttacatttaaagtaatgattagtaggtacaaatttacaatgctatttttattttctggttatttttaatggattctttgtccttcctttcttgcttgctgtgttcccttgtgctttgttgattttctgtagtgatatgctttgattcttttctctttatctcatatatacctactatgtttctgttttacaactacgatgaggcttacgtggaacatcttatacttaataacagtctatttagaaatgataacaactcaacttcaatttcattcaaaatctctaccattttacctgtcactctcctccagcacacattttatatttatatatattttatattgtgaatttattaacaaaacaacaaaatattatacctatagttacttttaatacttttgtcttttgacctttatactggacttaaagttgatttatacaccatcatttcagtactacaatattgtgaatttaactataaatttacatttataagtatattttatgcttttatatgatttcatgttactaattaacacccttccatgttagcttaatttaagatccctttagcatttcttgtaagacaggtctagtggtgatgaacttcatcatcacttttgtttgtctgtgaaagtatctctccttcatttctgaagaacaattttgctagatacggtattgttggatggcagttttttttttttctttttgcgctttgaataaatcatcccattctctggtgctgtatggtttctgctgagaagtgttctgttagcactattactgttcccttgtatgtaacaagttactattctcttactgctttcaattttttttaatgtttggcagtttgattataatgtgtctgtgtgaagctgtcttttggattgaatctgtttgggaacctttgaacttcataaatctggatatgtatatttctctcaaggttatcaaagttttcaaccattatttctttaaatgtactctctgtccctttctctctcttcctctgaatctcccataatgtgactattggttctcttgatagtgttcaataagggtttcttttctgttttttgttattttcagtgttctatagggtttctttcctcttttctattcttatctattttttgtactctgatagtataatttcaaaagatctgtcttcaagttttcaaattttttcttttgcttgatcaagtcggctagcagagctctctactgcattttttctttcattcattattcttttagctccagaatttctacttggttcttttttgtgatttctttttgttgaactttaaattttattcacgtattattttccattgtttcttgagttgtctgtttactcttgtgtcttgctcagcttgagcttccttaaaagaattaaaataattattttgaatttgaaaaataattattttgaatcatttttcagataactaatagatctccattttgttgaggtcagttcctggatagctattgtgttcctttgccagtgttatcattccctgcttttttgtgtttttagtgaacttgcattgatgtttgtatatttgaggcaacaagtcacctgatctggtctttttgaagtagatacagtggggaaatgctttcagctgtgaatggctacaagggcaccagctggatggggtgcaacatctcctgttttaagaaagacacaggtatggtctcaatgcagtttaatcagccgaagtcagtgttggcaaatactgcaggtatccatggcagaagccaaagttgcagatgtctgtagtaactgtagtggttaaggctgttaaggtcctcagtattgaaagctgttgagtttctcctattcaacttttatctcacatagggaagttccagccaaagtgattcctcttggcactaagtctgatgtgctggcacacatgcagctgtggtggtgttgggatcctggccactggtgcacagtcagcaatgctggttctgggtgcaggtgcccagagcagccatgaagccagggctctgtggtcagaggcacatgtaactgaggtggtgcctggggcacaggtgcattttttttatttggcattgacaccaatgtctgaggcctgggcatatacagattgcctatagagtgagaacctgtgtcatctttggggaatgccatgatgacttggtcccaggggtgatgagacatagtaatagcatggaacatagcagtaacgtgggtccagcgacaacagggtgtatcagaggcctgtcaggtcacgacaggggcaggatgcagagcagtagtctgaagccccagtgaaagtaggtaaaagccctgacttataacccaaggtaagagagcagtcagttatttacttatgaatatacaactgcttcatcatcatttgttgaagattatatatgtttcttagcacttttgtcaaatattatttgaccatgtatgtgtgagtttatttccaggtactcatctgttctaccaatatctaggtctgtctttataccaataccggcctgtcttgattcctgtacttttaattaagtcttaagattatatagtctgtatcctcaaactttcttatttttcagaacaatttgggctattctaggtctattatacttctctatatattttacaatcatgttttaagtttcttaagtaaaaaagaagtctgctgggattttgtttgaaattgctgtgaatttgtagatcagtttggggaaaagtaacaatattgaattttctaaccattaagcaaggtacatctttcaatttacttaagtcttctttaatttctctcaacaataattataatttttaatgtacagattttccacatttgctgttaaatttattcatatgtatttcataattgcaatgccactatgaatgttgattcaagagttccataaattttagttcagtgaaggaggttcacagtgtcgcttacaaattctatatccctactgatttgttttctctgattattctatcagttattaaaagaggaatgtttgcatactacaccttaattgtagatttgtctattttccctttcagttctattggttttcatgaattttgaagctttattataagatgaatccacatttaggattgctatatcttcttaagaaattgattccttaatcattctccctatatatctctcaaaatttcctttttctgaaatagactttgtctatattagtatagtcgtttcagcattttttaaattagtgttttcattgtaaatgttttccatcatttcgctttatatttaaagtggatttgttgtaggcaccatatagttgggtcttactttttatccactcaggcaatctctgcccataattggagtgtttcagtcatttacattaatatacttatctatgtgattgggcttaagccaaacattttctaatttgtttttctctttgtccccccactcccccttttttttttcttctttttctctgccttcttctcagggaaagattgcatatcttttaatgattctattttaacttcattattgatttattagatatacttcttttagttttttgttctcaggcttacaatatgtatctttgaattatcaaataagtagataaataaatggaatgataccacttttcatatattttaataactttacaacagcatgcttctatttatcctcctgttttttgcattattgtcataaatttacttccatatgttataaaccgcataatacattgttattaattttactttagtcaattatcctttaaagaaatgagaaaagtctttaatattaattttcatatttaacatttttgttgctcttcattatatagtggagatccatatttccatctggaatcatttttttctgtctaagatttcccttattatttttgtaacccatttatgtgagtgatgaattccttcagcttttgtttttttgcaaaaattcttttccactgcttgaaagatgtatttgctgggtatacaattttaggttgacattatttttatttcttactgcaaagatgccactccatcatcttttggtttgtatagtttcatctaatttttttaatgattttatcattttaatttttacatgtaataaatttttttatctgccagcttttaacattttctctttgttattagttgttttcagcaatatgattatgatgcctttttgtttttcttcattcttattctgcttgggatctttaagtttctattatctgcaggcttattactgtcttcaaattttgtctgtcatttatataaattggctatcattttttcaaatatgttttcttttgttcttcctttatgaaactccaattatggagttttgttttttaaagttttaaagatctcatttcattttaggtaatttctgttatttcttcaagtttactgtcttagtctgggatgttgtaaacaaatatactataaattgggtagcttataaacaacagaaatttatttctcacaattctgaaggctgagaagtctaatatcaaggcaccagtagatttgatgtctggtgagaacctgttccttatagatagtaccttctaaattcatcgtcacataatggaaggggtgaggcagctctctagggcctcttttataagggctctaattttatccatgagagctccattttcatgacctagtcaccttccaaagttcccacctcttaatacaatcatcttgggggttaagttttaacgtattaattttgggaaaacacaaacattcagaggatagcattctctattcttttctactataatgtctaatgtgcagataatgtttaaatttcatatacatttatatctctaaggcttttttatgtcttccattccttcctttgtcacatttgtattttcctcaaccttcttgattatctgtaatatgctttgaaaagcactttcattattttccatctgctagttttatcatctctttcatttctggatatgtttctattgagctattttttcctctggttatcatattttcctgattctttatatgcctgctactttttatatactagatattgtgaattttacgtttttggtggtattttgtgcctttttttagtagtgttcaactttttcctggaatgaaattaagttacttggaatctgtagctaatttgtctcactgctgaagtgacactcctatatctgctgttccatgtattaggagagctctgcagtttcattggtagtagcataaaatattcttagccttgtgtgagctctgggaattgttctgccttatctttttggtggctcttttataggtcttgagtagcttctgcacatggatgcacagattagtacacagccgaagtctcaaggacatctttctgcaaatctctggtattctctctctgtgcagtttattttgccttattagttgtagctgtttttgtagtctcagtctctcatctctgcctcctcaactaaatgagaccatcaatctctctttgagttctagtttcctgtgcccaagcctgggaactatcttcagtcactaacacagaacatttgtgaaatgtattaccttggttgctatccttctctcatcttattctatgttgcctgttgaccaatatgtgaaaactgttgtttaatatatttttgcccacttttctagtaatttaaaataggagattaaatcttttctctttaccaactttctgacaactactgcctgacttccccagccctaagctataacttctcagtattcttatttttaattccaagacaaaaataattatttatggtatatagaatgtcatgcatcctagttgcctacattttttcagtcattattgcatttagaaactctatcgtgtctgtaagcagaagtaatttgctatattttaacataaaaagtttaaggatactaatttgttataactggtaacatgtataatattgcatttatttataatattaagatcaattctttttgcatggaaaaatttcaatgtactttaaaaataattttctgacttgatactcataaaagctctgtgaaccagataaatgtagaagtgtaattatcattataaagaagctaaggccaagcaagattcattaatttttctcaaagtcacatatcctgtaagtgatagagatgagaattaaacccagatctgaccagtataacaatactttttttcagtttccaaagtttgtcttactggaagatgtagagctctatgtgaattagcaaaacatctagtatgggtagaagtgttgttgttgttgtgttttaacttgtgtagtgaagtggaaagaaccattttaagagtaagcagatggtttgtaaacaagattcaatctaaataatacaacatggaacgtacataaaacaagcaaaacaacattcatataactaatgtttaatagtttatgaagcaaaaagtaccgacagaattgttcagctagaggacatattgtaaatggagaaaaataagagttaatgtatgcctaatggttaagataatcaaaatgcctacttagaagagctgtcttttttaaatttctcaggagatttagttaagtaattaatcaaatggtctctttatcttttgaaaggggcacaaaataaagagcacaaaagtaagaaacatttaactttttgtatctcctcatttctaatatagtgtcaatgcctttgatatatgaagttaatttttatttttctctctttcagaagataattaatttggagtctagtagttataattttatttgaaaaaggcatctaattacatacgtaagcatctttagctagtgacatttcttaacctatctcccccttgcatagcaaaaaggttttgtgtgattcttctgtgaaaacataaggcctagtttaaagagcggattgggtaatcacgacttacatgataaaactgctggcaaaatataattgccgatcatcctttttttgtggtaaattgtatgcctattatacgaagacagtttatccatcataaaggcaaggcatccttcttgactttacacaaatcactgcccaacttccccaaccctaagacattacttttcaataatcctatgattgatttgaagataaaaataatcatgcttgttgtgatacattctagttgtattttttttctctcttagagttgcatttgggaactgcaatgggttggctgtggtggattttatacagaagacagtactgttaagcatggggaccattgacctatatagatcaagtgacttataccagcgacaaccacggtctcctcgaaaaaacaaacagttcattgcaggtaggagataaaacaagatgagttatgaacttgatttggtcatctgtgttcttatttttagatttcttgtctttcttctctgatactattcaaatgcatggcaaaataaaatcaacataatttacaaaatcatgtaagtaaaataaattgggcagaaacattgtgagaatctttgaaagggtcaggggtgtgtatgtttaaacttcaatttgctattgaagttaggaagcatctcaactttcttaggtttaattcctaagaaataacagaaaataagaagctattaaatgtaaaaatgctatgaaaattagggctctgtagttgaaaaaaactgcttgcaatggttgtgtcaaacaggttaactttcttctaaaatatctggtccctttaaagagataattttaggtcatttactacttttaattttttaaattaattccatattgtagctgactcctttccttgttggatgatgaccttcctgaaggtattttcacaattcaataaacatttttcattaacatttttaaagtactatgacagatggcatttttcttggaaggatcaataaatcgatgtatttaactataaaagaaaataaacttaaggtaattaggatttaatgccaaactttgatatgccaattatccaaagttttactgaaattttagtatatatccaaatagttggctttataaacactgccaaagttttgcatattttctgtccattgacagtccagttggtaaaagaaaattaggccaaaaggttgcagatgaaaatgcttctataatattaagtgttattttagacagtcctttaaagtcttctactttgggccagatatggtggcttatgcttgtaattccagtactttgggaggccgaggtgagaggatttcttgaggccagtaattcaagaccagtctacgtaacatagtgtgaccccatctctaataataataataataataactttttaaattttttaataagtaaataaaataaaatttctacattgtattatttaaaataatttattgaatattgatgatattactaaatatgaccataggaaaatataataaaaaataaaaaaggtacatgatggtaggtgttattttccaagtggcagatatgtcaaatttaacatccaaatgtgataataaatgaatttcctttttggactaatgaaacttgttatactgaaactcttcttgttaacctttcttttgcaaaactcaatgatttctgaattaccagtttagacccttttgaggggcacaaaatttctctttcagaaaccaagggtttttagtgagggatctcaacttttagcaatattttaggagagctagaaatttcagtttctggagattttgcctctatcactaccagattttgaaaggaagacaaaataacaagcaactgtacattcacataacgtgaggtttcctcatgattaggaaagacaagtttgaagttgatggactctaggatagaaaggtgttagggggcagtaggctatttataattaaaaatttagttcctcagtcataataaccatatttcaggtgttcagtttgcaatgctaaaagcaccaatataatcagaaaagctgtgaatcctatgacaatatctaaatcacttgctggatatacacagtggggcaaaaaaagtacataatttgacaaaggtaatacaattattatttaatttaaattaaactgcttgaaccttaacagttactactagagcttagaacattgatgactttaaaatcaggaaaatctgtgaagttataaactcagtttgtgtttagtgtacaagatgacacagtgagaactcactttatattataacaatgaagtattaaagactgaaatctttagctttctttttaattgctgaaggattaaagacaatcattttttattaatgaaataatttatacatattagttacaagccaaagaagtgtattttgtaaaaacatataaggaaaatgtgccatctacttttataagacatttaaataagataaaaataaatatttataaatatttttatattaaatatttaaataaatgttaaaattactaccgcattctcatcattcatctatcgcctcttactttataattgatttattttattaatatctccttctaatttaattacctaatcttgctgcaatttcttcatcttggctgttctagattctggtatgatatcacttcctttcactttagacttttttttctctttcttctgcctgctgctgatgctggtggtctggcatgttccaaagacaacttttgcatgcgtggcctgtctaacttttatcctgatttaacgaaacggatccgtacttcctatcagagtaagttatataaaggttaggcaaatagcctttttaagacataatgcttgagttaaatccatacatcagtgctcagtaatgtgtttcttaaaacacattcagcatgcatgcaaatttttgttttgttatggtgtgcaacctgataattttaataaacattattatagaaatatttcaatccatttttgtcctgtacccattcaatcatacccattgtttcagtgtttatttccaaccatgcagaccatgtcctactattccaagagtcactgtcttttattttgaggaggaagagctatgatgccctgtaaataataaaacttattactgacatgccagtatcagtaataagttaatgctttcttattttggcaaccttatgctttggccattttataatactattctaaccagggtcacaatatttgcttcttttaaataattatattccttgaagataactaagtattcctgatttctgatgatttttattaaaatatacaaacatatttctatggtgatttaaggcactcagacattataaagtaggataattaaggtaaaaagtaaacaaataaataatatcaacctttaccatggtatcaaacacagatccgaagatatctagagtaagcaattataaaaactggtatagaaaggatgaagagtgagagtgtgtgtgactggaggtacagatgagactagtgattttatcggtaaatatttattgacataaaaaatgtttatcatatgttaatatattctgttaaaaagcaggttgtttaacaatatatacaaaatggccttatagttgtataacatatacattatacattatatacacacactcacacatatatgttgtttgtaacctgaattccttcagacctcaccagttcatagatactaatggaatcttatcagtaataaaacctaaaactttactggtttatgcccttagcttacaaaagtcagtctctatgaaatccttaaaatgttcctgggaatgcctagaagttgagtaatttttgctcataaatattctctagttttctactctagcagagcacccccttttaggaatccttcccactctctctgttcctgttgctgtgtgcgagaatattggtatctatgttggcttctgctgctcctaaaacagaagcttatttgatactatgataactgtgatatttcttgacatctgaaaattttataaaatttcagtttctgtaataaagttttattggaacatagtcccaatcattcattatatattgtccttaaatgctttcacactacaatggcagagttgagtagctgcaacagaaactatatgcccacaaggcctaaaatgtttactatcctgttctttacattaaagtttgctgattcctgctctgtgccattttttcatacccatcctctgcaccacataaaggatttcagccaaaacctttctgtaaatagtctcagggtagtttaatacacatattcagatttcagaatcccagtttagccttctgaaggtaggatctcctacatttgtgtgtgtgcttgtgtgtgtgtgtgtgtgtgtgtgtgtgtgtgtagacagaaaagtttctggaacatggctttgtggattttacagacttcttttggctttacagtatactctgatttttctgtaataaacttgtaattattttatgctaagaagctaaattggagactgaaggtcaggagcagaagcgggctcttagttcatcaggatcctataatatcagccatgatgtaaagtttttaaaagttctgagaaatctcaataatatattttcttatattccttatatttccttcagaattttttttcagcccatcattcaggatcctctaaagtataatttctatcaacaacctcaaatggattttctactattctcctcttaagccaaatttttgtatcttactaccattatgttttactcatattatccactctctggaaatgccctgctaaaagtttactttctatagtaagcctttcctaccaccatcagagccctgttgtgccaattcctttatttaaatgcttccagtgtccaggtttgtacacagtacaggcttgcctgaaccatttagttgacatttagcctagattcatttgtatggctacttacttttatacttttgttctgcctttccaaatgcatgacaagaatctcaagaccatatctaaaattctttatattccctgcatctagcacaagtcacaaggtctctatgtaaatgatgatgtcagtaggatagagcatggcagcagactttattctctcacatgaactgccagaaaacttttcaaatctgacaaatgagagaagaactaggtaacaggttcaccagaattttgcaaaagtaatcatagtttctaactagagacctaacgttttaagtcagaagtaaaatcaagtctgttgaaggacttaaagaaatccccgtgtctctaccagtgggccccacaagggctcagacaagctctaggatttcaaatcagatttcctaaaagtcttctctgaatgattgatattgtatattatgaaaagggattgattctttaaccactcaaaggcatatcctacaattgcttttcaaaatacatttaatgaaaatttgacttgaagtttaactattggataatataatctgattatatttctatagtctcactttattatagtagacactgctcagccttttcattaattgcttactaactttcagaaaagcatatatgcattgttcatatttggggtaatagaacccagttccattgattatctattctactctgctagtcagtttgactcagtgttatattatccactagtgattataaccctttgaggcagattgatatatattagtatatttctctacacatgagaaaattgaagttgaaaaaaatgaaattagtctctcaaagccacacagaataagtgggacccaaacttatgcctatctgacactaaaattactcgataggcttttcactgtataatcttggatctctaagtgtcttttttaaagtttcaggaacattggaaaccaagtccgttattttataatcagaaaacacctcagtttttgcacactcaatgaaattatatcaatgactcttttactggtcaccttattccataggttaggctccaaacagctgacctccccaaatttttaaattaccaagcggcaaaactttcacatcatagaataataaaattttgtagttgaaagaaaactttcgtgttctacagattatgatttttagaagcagaaaaacgctttgaaaagaacagcagacatctgatcagaagatttacattgttttaccttttccatttattagctacttcatacatttataatcttaaacaaggcatttaatcactctgagtttctttcttctaatatataaagtaaaaattgcaatttctacctcccttagagagttgtagaacttttctgggttaatgttaataaaagtgattctataaatgttagttattataattattataaaagatgaaccaacccacaccacagagaggttaaataacttccagaatcataagaaatctatggaatacgtagaactaaaactcaggctgctgcctcattgcctagcaacagttctacttatgataatcacataaattttgctatttaaaaactgatattatgccatttgaatcaagggaagtttgaaaagtaggcttaatgtagagaattgtctacattgcttgtgcatcaatttctagttatgcaacaagggatcctttggagagtcccaggcctattatccctttcttttcaaagggtaggggtatgataacagatcctaaaaacacctgaaacataaagaagaaataaaagaaaaggggatgataagagaactatccaagaaaggcaaataagtattgtaaaacgaacagaaagtcaggaatggagaagtaaacaaaaaattaaagaagaaatgctttaagaaacaaaaatcagcaaaaattatggtaaacaataaatggggaaaacattcattcaaataatattttactgagcatctcttgtgtcaaacatttttctaggcattaagtacatagtgatgagtgaaacaattatggtcttttcctttcatttataacaggtaatatacagataaataaagtcatagataattgaagaaaggtggcaatgcaataatagggaaaaatgagataaggtggacctatttttgaaagtgttgtcagggaatggcctatccaacatggaaacatttaagtgaagttttgcaagataaatagtcaaagctttagattctcactaccaaccaagatagaaagatagagtagcaagtaccagatttaacctcctgcctgaaaaccccacacccattcccccaaaatagacaaaataaatgaaaacaatggtttttaagacacggggtatcaaacaatgaaaaaaaaaaatgatgggacagatgggaaacctaacaatcacacgcatttactatggcaagataatttctagactgtagcaaagggaggggaagcccaggaggaaaccactgagctttttaggctgggagatgaagatgagaaaccaaagaaaccaaagcatctacagctcacaaaagaatttcagagatctacagtgtttcctcctagagcaaagtgctgatcaacgtatacatatgatgcagctatccaggaacaggtaaagagccatctgaaaggattaaaggaaacagtgcccaacactcaaataaaggaaatagtgccatttccactaccctaaatagaaatagttcataactcacatccacttctatttaacattgtactggaaattttagacaatgttgtcaagcaagaataagaaataaaagttatctagatttggaaaggaagaagaaggtaaatagtctttattcacagaacacatgattgtctatgaagaaaacttaatgaaatctgccaaaaacagctactagaactaaaaatgtgagtttaacaatgtgcaggatataaggttaatatacaaaattccattgtatttctatatgcatacaacaatctgaattgaaatttaaaattaccatttacaatatcatcaaaaataagaagtacttagccataaatgagacaacagatacgaaagacccacacattgatgggccgggcgcggtggctcatgcctgtaatcccagcactttgggaggctgaggtgggtggatcacgaggtcaggggttcgagaccagcctgaccaacatggtgaaaccccgtctccactaaaaatacaaaaattagctgggcgtggtggcgggctcctgtaattccagaaactcaggaggctgaggcaggagaattgcttgaacccaggaggcagaggttgcagtgagccgagatcgcgccactgcactccagcctgagtgacagagcgagactccatctcaaaaaaaaagaaagacccacacatggaaaaccagaaaacattgctaagaaaagttaagaagacttaaataaatagttacaccaagtttatgtctcacaaaactcaattttattaagatggcagttcattccaaatcgatttgttgtttcaatgctagatcccaataaaaatacagcagatgttcttgtaggaactgacaaactgattctaaagttcatacagaaattcaaaggatttagagtagccaaaacagcttttaaaaagaagaatctgttcttgcattagttagcttagaataatggcctccagctctattcatgttgctgcaaatgacatgatttcattcttttttatggctgtgtagtgttccatggtgtacatgtatgacattttcttaatccagtctactgttgatgggcatttagactgattccatgttattgccattgtgaatagtgctgcagtaaacatacgcatgcatgtgtttttatggtaaaccacaagttatatttcttcgggtatatacataatagtgggattgctgggttgagtgataattctgttttaagttctttgagaaattgccacactgatttccacaatggctgaactaatatacactcttaccaacagtgtataagcattctctttcatccacagtctctccaacatctgttattttttgactttgtaataatggacattctgactggtgtgagatggtatctcattgtggttttgatttgcatttttctaatgattggaggtgttgagcattttttcatatgcttgttggaatcatgtgtgtcttctttagaaaggtgtctatttatgtcttttgcctactttttaataaaatcattttttttgttacaaatttgtttacatttcttacagattctgagtattaaacctttgttggatgcataatttgcaaatattttctcctatcctgaaggttgtctgtatactctgttgatagtttttatagctgtgctcaagctatttagtttgattaggtcctatttgtcaatttttgtttttgttgtaattgcttttggcatcttcatcatgaaatctttgtcaggtcctatgtcacatggacaaaaagaagtgaacaacagacactggggcctacttgagggtggagtgtgagagcggggagaggattttaaaaatacctaccaggcactatacttattactgggtgactaaataatctgtacaccaaactcccacaacatgcagttcaccagccaagtatctgttccccttcaagagactcccccaacacataaggactcacataaacttaaggtaaaggagtagaaaaacattccatgcaaatggacaccaaaagtgagcaggagtagctattcttatatcagacaaaacagactttaaagcaacaatatttaagaaagacatgaagggacattgtttaaagaatgtcccttcttgtttaaagaagacaggaagggacattaaatatgataaaaggactagtccaacgggaaaatataacaattctagatttatatgcatctaacacaggatctcccaaatttatgaaacaattactactagacctaagaaatgagataaacaacaacacaataatagtgcagtacttcagtactccactgacagcactagacaggtcattcagacagaaagtcaacaaagaaacaatggacttaaactataccctagaacaaatggacttaacagatatttacagaacattctacccaacaactgcagaatatacattctattcatgagcacatggaacattaaccaggatagaccatatgataggccacaaaacaagtctcaataaatttttaaaagtcaaaattatatcaagtactctctcagaccacagtggaataaaattcacacagtggaataaactccaaaaggaaccctcaaaactatgcaaatacatagaaattaaataatctgcccctgaatgatagttgggtcaacaatgaaatcaagatggaaatttaaaaattctttgaactgagtggtaatagtggcacaacctatcaaaacctctgggatacagcaaaagcagtgctaagaggagagttcatagcattaatgcctacatcaaaaagtctgaaagagcacaaatagacaatctaaggtcacacctcaaggaaccagagaaacaagagcaaacccaaacccagcagaaaaaaagaaagaacaaagatcagagcagaactaaatgaaattgaaacaaacaaaaaatacaaaagataaatgaaccaaaatgtggttctttgaaaagattaacaaaattgacagaacattaatgatattaaccaagaaaagaagagagaagatccaaataaactcaattagaaacaaatgggaaatattacaaccaatacaacagaaatacaaaaggtcattcaagactactatcatcacctttatgcacacaaactagaaaacctagagaagatggataaattcctggaaatatacaaccctcctggattaaaccaggaagaaatagaaactctgaaccaaccaataacaagcagtgagattaaaatggtaatttaaaaaattgccaacaacaaaaaaagtccaggaccagatggattcacagctgaattctatcagacattcaaaaaagaattggtaccaatcctattgaaactattccagaagatagagaaagagggaatcctccccccaaatcattctgtgaagccagtatcaccctaatatcaaaaccaagaagggacataacaaaaaagaagactacagactgatatccctggtgaacgtacgtgcaaatatcctcaacaaaatactagctaaccaaatctaacagcatatcaagaagataatctaccacaatcaagtgggtttcataccagggatgcagggatggtttaacatacacaagtcaataaatgtgatacatcacgaaacaaaatttaaaatcgtatgatcatctcaatagatgcagaaaaagcatttgataaaattcatcatctctttatgattaaaaccctcggcaaaatcagcatagaaggaaaacaactaagggtaataaaagccatctatgacagatgtacagacaacattttacggaatgggggaaagctgaaaacattccttctgagaattagaaaaaaacaaagatgcccactttcaccacttctagtcaacatagtactggaagtcctagccagagcaaccagacaagagaaataaataaagggcatatgaatcagtaaagaggaaatccaactgtcactatttgccaatgataagattgtatgcctagaataccctaaagacacatccaaaaagcacatggatctgaaaagtgaatttagtaaagtttcaggatacaaaatcaatgtacacaaatcaatagcactgctatataccaatagtgaccaagctgagaatcaaattaagaactcaaccccttttacaacagctgtaaaaaaaataaaataaaatacttagaaatttacctaactaaggaggtgaacgatctctacaaggaaaactacaaaacactgctgaaataaataatggacaacacaaacaaatggaaatacatgccatgctcatggatgggtagactcaatattgtgaaaatgaccatgctatcaaaagcaatctacaaattcaatggaatttccatcaaaataccatcattattcttcacaaaactagaaaaaacaatcctaaaattcattcacacagtaccaaaaaagcccacattgtcaaagcaagactaagcaaaaagaaaaaatctggaggcatcacgttacttgacttcaaactacactacaaggctatcgttaccaaaacttcatggtactgacataaagataggcacatagaccactggaacaaaacagagagcccagaaataaagccaaatacttgcagccaactcatcaacaaagcgaacaataatataaagtggggaaaggacaccctattcaataaatgatcctggcataattggcaagccacatgtagaaaaatgaaactggatcatcatttctacccttgtacaaaaatcaactcaggatgaatcaaagacttaaatctaagacctgaaaccatagaaattctgaagataacattggaaaaacctttctagacattggcttaaacatagactttatgaccaagaacccaaaagcaaatgcagcaaaaacaaagataaatagatgggacttaattaaactaaaaacttcctcacagcaaaataaataatcagtaaacagacaacccacagagtgggagaaaattttcacaaactatgcatctgacaaggactaatatctagaatctataggaactcaaatcagccagaaaaaaaatcaaataatcccatcaaaaagtgagttaaagacatgaatagacaattctcaaaggaagatatacaaatggccaacaaacacgtaaaaatgcttatcactaattatcagggaaatgcaaatcaaaatcacaatgcaataccatctttctcctgcaagaatggccgtaatttaaaaatcaaaaataatacatgttagcatggatatagtgaaaagagaacccttttacactgctggtaggaatgtaaactactacaactactatggaaaacagtatgaagattccttaaagaaccaaaagtagatctaccattcgatccagcaatcccaccactgggtatctacccagaggaaaagaagtcattatatgaaaaagacacttgcacatgcatgtttatagcagcacaattcacaattgcaataatatggaaccaacccaaatggccatcaatcaacgagtggataaagaaaatgtggtatatcatggaatactactgagccataaaaagtaatgaaatgatggcatttgcagcaacctggatggagttggagaccattattctaagtgaagtaactcaggaatggaaaaccaaacattgtaagttctcacttataagtgggagctaagttatgaggctgcaaaggcataagaatgatacagtggactttagggactcaagggaaagggtgggaggtaggtgagggataaaagatgacacattgggtacagtgcacactgcttggttatgggtgcactaaaatctcaggaatcaccactacttatccatgtaaataaacaccacttgttacctaaaaacctattaaaacgaaaaaaaaattttaaattttaaacactaaaacaactcaaatttttattaagtaaatggataaacaaattctggcaaatccaaacaatggtgctctgctccgcaataaaaaagaatatactattgataactactacaacatggatgaatccaaaataattgtagtgagtaaaaataatcaggaaaaaaaaggacacattactgtatgattccatttctatagaattccaggaaatgaaaagcaatgcatagtgacagaaagcagattagtaattgcctgggaatgggaagggacacatatggtgagggctggaagagagggttacaaaagggcacaaagaaactcttgggcatgacagaagtgtttattatgttaattgcaaagatggttttatggatgtatacgtatgtcaaaatgtattcaaatagtacattttataaacattaattaaaccttaacaaggctattttttaaaagaagaactaacgcaaagaagagcagggaacagcacattccaagcagagtgaacagcttataagaaggttctaggccaggtgcggtggctcacgcctgcaatcccaacactttgggaggccaaggtgggtggatcacctgaggtcaggagttcaagacaagcctggccaatatggcgaaaccctgtctctactaaaaatacaaaaaattagccgggtgtattggtgggtgcctgtaatcccagctacttgggagactgaggcgggagaatcacttgaacccgggaggcggaggttgccgtgagccaagatggtgccattgcactccagcttgggcaacaagagcaaaactctgcctcaataagtaaataaataaataaaatagaaggttctaggatggtaaaggacttaactatatcatctagaaacagaaagaatgcaaggaagctgacatagtcatgcggaagagaaaaagtgagtgaagattttgttgtagagatgagtaaggacaagatcataaaagcttctgaagtaattacaagaaattatattttaatttaagcaggggaatgatatgctttgatttatgctataaatatccacactgctgtgtgaagaaaatattgtggagccaaaaaggaaagcaagctggtgtacccattagaaggcgagtattgcactccagcaggaaatgaagtggcttgactagggtgatagcaacgctgttggagaaaaaaggatagattcggaaatcattagcatttacagagctactgattatcattcaatgtgagagataagagagtggaatcaaagattattcccagattttggcttgagccacttattgtcatgatattttttacaaaggtgaagaagcttgagataggagggggcatgtggtggtaggaaataaagagttcagttttagacacgttaaatgttattatgtctgttgtataaatggagatgtcaagtggacaagtaagtctgaatatcagatgagaggtctagggcaataatttgagtctttagcatataggtggtatataatggcatgggaataaatgaaattacctagaagaagggtgggggaaggaggaagcatagaaggaagaagacaagagagaaaaagagaaagcaagagagagagataagggagtagggaagaaaaggagatttgtgaatagagatatcaggaatttcaacatttaatttcaggaagaagaggagttgccagggagaagagaaaaaggaaaagaccttcacagaagaaaaaacaaaacaaaacaaaacaaaaaacctggggaatgtttcaagaagtggtaaactccatcagatgctacagataagctaagtaggataggttcagaaaagtgattagagtgtgtctggctctgtgaaagttgttagtgaccctttaaaaagcgattttagaaaagcaatgaaatagaagccaaaatattgttaaactgaagagtggcaggtgaggaaacagcacaactgaatacctctttaaagatatttggttatgaaggggtgctgaaaaatagattaatacctggattggagtaagatgttaaaaggagtagtttggggtttttttaattttagagaaaagagcatatttttaatttatgtgaatacagaatgatccatagaaaaagagattgaggataagggagagaggggataactaaaggaaaaaaattcttaaggaagtgagaaggaatgggaatcaaagcacaggtacaaggactgacatttaataggaggctttgtctattagtatagacagactttttttaaaagaaatgagagaactacagaatgaagagatacattgaaaagtacattgtttcattgagagatgaaacaagtgattgttatatctgattttcagttcagtattttagtagtttttcctcttaaaatcagttttacagtgtaaatttcttactacaaagctttatgttgaaaatcaactactttgaattgtaattagtaggaaaaaatatgtttctatctttgaatttacaaaaatcaacaaaaacatacaaaatacgggagatattacctagcagtatgtgtgaattttcttgacgttagttaatagtaatctcatcgtgagtcagacaaataaaacagtctctcaactaggaataacattgtaccccagggatatttggcaatgtctgtgaactttttgattgtcacaactgaagagtagggatagtctactgacacctacatctacaatgtatttctacaacaaaatattatctagccaaaatgtgaaatcaaattgaaaacatttagaacacaattgtaaataataatttagtaagcaaaaattttaaagtgtagactatatggatggaaatatttgtatattgggtataagtctcctagagaatactgatattttatttgatgtttacaagttattacttaaagtactatcttattatattaccaagtaagctacatcacaggtgtatatttttaagttataaaagttggtgtgattcacagtagccaggaaatcatatttctgatactcaattgtttatttaccataaaagttctgtatctgttccaaccagaatttattacatactttctgatgaatcactgtaaaaaccttcaagtttagtagccaatttgctttactctattcacatgtcagacacagctttatccacataaaatcttggggaaatttcatcatttagtgctcattagagtattagcaaaagcatgatgtttgacttgtaccctgagtactttagtagaatacctactaatgtcagtaatggattaaccaacttaactggtttccattccactgattcctcctgtcttcaatccagctttcacagtatttccaatatttcaaatataagtgaaagaggggctttccatttccagataggatgttaaaagatgtaaaagaccttaatccccatggtaggaacaatgatgaaaacaacaaaatcctatagtaatgacaataaaattaaaattatccttttctatggggctatggaagagtgatacattcaaagaagtctaattaactgaatgccagacagagaagagccattcacaggtgagcagaaagctactgctgcttccatacctggggctagtgactgacctgggtataggtgggggaaagagtgggcttttgatagatagacagactgaaaggaatagaaaatagccagtgaggtttaatggctgtttggactgacctatagattggaatttgaaagaatttgaaacaaccctaaatagaaaaataaatcattcaagttggcaattgtctgccactaaaccctcaccaatctcagaatttttctgcaaaagtagcaatgcaggtggactggaaggcagagaaatttatgcagtcttaatgtgctgtattctggggtaattatagaatttaaccaaaagttgaattaagatgaattaaaactatctgaaacagcatcccaactgtgtcactgcacaaataccaatacaaataacaatcagtcccttggcaaagggggtataaaagattgagtgttggattgagaaataaagagagattttcatagtccaatttgaaacaacagtggaacttaatcttattaaagctacagcccagccccagcttaaatacttagcagaatctgaatgattctacattatatgtgtgtgtgtgtgtgtgtgtgtgtgtgtgtgtgtgtgatattcctgatattagtgataatatacatatatgaatgattctttagtttttactactgttgtacacagatcataccatcagaaattagaaaacatgcaaagaagcagaaaattgtgactcataattgagtggggggacaaaagtcagtcgaagcagatccatagagacccaaattgaaattagaagccaagaactttaaaagaactattataagaatatataggaaaagaggctgggcatggtggctcacgcctataatcctagcactttgggaggcagaggtgggcagatcacctgaggtcaggaggtccagactagcctggacaacatggtgaaaccctgcctctactaaaaatacaaaaattagctgggtgtggtggctcatgcctgtagtctcagctacttgggaggctgaagcatgagaattgcttgaacccagaaggtggaagttgcagtgagccaaaatcgcgccactgcactacagcctgcgcgacagagtgagactctgctcccaaccgccaaaagaatatataggaaaagatggtttggctgagtaaatatgttggggaattttagaagagaaagtgaaacgctgaaaaagaaccaaatggaaattatagaacttaaaaataaaatatgtgaaattaaaagttcatggttgtttcttagctgttaatgaataatgctgcattgaacatgagaatgctaatatttctttgagaatcctgttttcaattattttggataaatacccagaagtaggattgctggatcatatagtggttctattttttattttttgatgaacctcattgctgttttccatctcagctgtaccattttacatgcccaccaatagtgcacaatgattccaatttctccacatcctcatcaacacttgttattttctgtttttgtttgtttgttttgttttttataatggccatcctaacaggtatgaggtgatatctcatggtagtttcaatctgcatttccctgataattagtgatgttgattagtgatgttattttcatataactgttggctatttgtattatcttacacaatacgtgacaataaattcaaaatgcatttaaaaattaaacataagacctaaaactgtaaaacttccagaagaaaatataggtgaaaaccttcataacattggtcttagcaaagaattcttgaatgtgacatcaaaggcacaggtaataaaggcaaaaatacgtaagtgataccgcatcaaactaaaagcttctacacaacctaaatatctgcagacagatgaatgaataaagaaaatgtggtagatacatacaatggaatattagccttaaagaaaaagaaaatcttgtcatatgctacaacatgatgagccttcaggacattacactagatgaaataagccagtcatagaaggacaaatattatatgattccacttatatggtgtatatctaaaatagtcaaactcacagaagcagaaagtagaataatgattgccaggatctgtggagagggaaaaatggagagctactgttcagtggatacacagtttgagttatacaagatgaacaagttctaaatatctgctgtgcaacagtgtgaatatggtaaacagtactgtaatgtacactgaaaaatttgtttagaaggtagatttcatgttgtgtgttttttaccattgaatatatgtgttgattatatatgtagagttaagtgtctttggggttcttctcctaattataagaacctttgtgaagtcagtgtagggtaacaatcaccaacacaacagcatattttcaattgtatttgctctcctagcagatcttgtaaaaatcaacatggaaggataatatataatcctatattcatctctgacctctgaattgaggtattaagtagacaaaaaatcaaaagcaagtttcatgaaatcatctatcatcgtcattttttgaaaacagtattactatcttttcccactagcaacatgaaaagcaaatgaggaagatattttatagaaataattaagctggtgatgtttttcctccttgaggagtttcatattcatagaaaccttgaggataaaggtttcatattctaaaactgttttttcagagacagtaacatttaaacatctttatggaagtgtcaaggcaccctttatacttactaccaaggaacctaaattggactttttgaataaaaaggcattcctttcaaaaacaaaagttcacatgattgctttaacaatatattgcacagcactaggaactatcagttaacttgaatacacgtcactagaaatgatccaaacagaagcacagagttaaaaaataataataataattaagctaaatgaacatcagtgactttggctgaaattttttccaaatttgatgaaaaacatcaacttaaagatccaggaagctcaaaacaccctaaactagaaaaatacaaaaaggccaggcatggtggttcatgcctgtaatcccagcactttgggaagctgaggcaggtggatcatttgaactcaggagttcaagaccagccggaccaacatggcaaaaccctgtctctaccaaaaactacaaaaagttagctgggcatgcagctgtggtcccagctacttgcaaggctgaggttggaggattgcttgagctgggaggcagaggttgcagtgagccatgattgcaccactgcactccagcctgggcaacagagacctgatctcaaaaaaaaaaaaaaaaaaaatacaaagaaaacgacacttaagactttatagtcaaactactaaaaccaacctacaagagaaaatcttaaaagcagtacagaaacatacacacacatacaaatacaagggaaaaatatgaataatgagtgattttttccatcagaaataattgaagctagagacaacataatgacgtcttttaagtgctagagaaaaacaactgtcaatccagaattctatatctagcaaaaatatcattcaaaaatgaaagtgcatgaattaacagatctgtactataagaaatagtaaagaaaatttttaaagcagataaaaaaacgatggaaaattaggaatacaggtaagaatgaaaagcactggaaataataaatatgtgggtaaatataaaaaggtattttgtctttccgtaaactctgtgttactctttcagaagtaacaatgtattatgggatttataacatgtagaagtaaaatgtatgataacagtaacacaaagtattgaagagaagtatacagaattatactgttgtttttttcaacataggagaagtgatgtaagaataattaaagatgcactgtaatgaatctaacaaatagatgcacattataatccctagaacaaccattaaagaaaataaaacagagaggtgtagctaagaagccaaagagatgataaaatggaatactaagtatattttattttctcaaaagacagaaaagagtaacagtaaacaaacaaaaaaaagaactgaggggacaaactgaaaacaattagaaagatgatagacataaacttaaccccatcaaagattatattaaatagagtacacattccaaaaaaagaaaaagagcttctgagacaggattaaaaagaaacaaatatcaaaaacagtgtatatgctatttataaaagatgcacgttaattataaaaacataaataggttgattactgtagccttgtagcatagttcgaagtcaggtagcgtgatgcctccagctttgttctttcggcttaggattgatttggcaatgcgggatcttttttgattccatatgaactttaaagtagttttttccaattctgtgaaaaaagtcattggtagcctgatggggatggcattgaatctataaattaccttgggcagtatggccattttcacgatattgattcttcctacccatgagcatggaatgttcttccatttgtttgtatcctcctttatttcgttgagcagtggtttgtagttctccttaaagaggtccttcacatcccttgtaagttggattcctaggtattttattgtctttgaagcaattgtgaatgggagttcactcgatttggctctctgtttgtctgttattggtgtataagaatgcttgtgatttttgcacgttgattttgtatcctgagactttgctgaagttggttatcagcttaaggagattttgggctgagatgatggggttctctagctatacaatcatgtcgtctgcaaacaggggcaatttgacttcctcttttcctaattgaatgccctttatttccttctcctgcctaattgccctggccagaacttccaacactatgttgaataggagtggtgagagagggcatccctgtcttgtgccggttttcacagggaatgcttccagtttttgcccattcaggatgatattggctgtgggtttgtcatagatagctcttattattttgagatatgtcccatcaatacctaatttattgagagtttttagcatgaagcgttgttgaattttgtcaaaggccttttctgcatctattgagataatcatgtggtttttgtcattggttctgtttatatgctggattacaattattgatttgcgtatgttgaaccagccttgcatcccagggatgaagcccacttgactatggtggataagcgttttgatgtactgctggattcggtttgccagtattttactgaggatttttacattgatcttcatcagggatattggtctaaaattctctttttttgttgtgtctctgcccggctttggtatcaggatgatgctggccgcataaaatgagttagggaggattccctctttttctattgattggaatagtttcagaaggaatgataccagctcctccttgtacctctggtagaattcggctgtgaatacatctggtcctggacttttttttggttggtaattaattattgcctcaatttcagagcctgttattggtctattcagagattcaacttcttcctggtttagtcttaggagggtgtatgtgttgaggaatttatctatttcttctagattttctagtttatttgcatagaggtgtttatagtattctctgatggtagtttgtatttctgtgggattggtggtgatatcccctttatcattttttattgtgtctatttgattcttttctcttttcttctttattagtcttgctagcggtctatcaatattgttgatcttttccaaaaaccagctcttggattcactgattttttgaagggttttttatgtctctatctctttcagttctgctctgatcttagttatttcttgccttctgctagcttttgaatgtgtttgctcttgcttctcttgttcttttaattgtgatgttagggtatcaattttagatctttccacagcatggtactggtaccagagatatagaccaatggaacagaacagaaccctcaaaaataatgccacctgtctacaactatctgatgtttgacaaacctgacaaaaataagaaatggggaaaggattccctatttaataaagggtgctgggaaaactggctagccatctgtagaaagctgaaactggatcccttccttacaccttatacaaaaattaattcaagatggattaaagacttaaacattagacctaaaaccataaaaaccctagaagaaaacctaggcaataccattcaggatataggcatgggcaaggacttcatgtgtaaaacaccaaaagcaatggcaacaaaagccaaaattgataaatgggatctaattaagctaaagagcttctgcacagcaaaagaaactaccatcagagtgaacaggcaacctacaaaatgggagaaaatttttgcaatctactcatctgacaaagggctaatatccagaatctacaatgaactcaaacaaatttacaagaaaaaaacaaccccatcaacaagtgggcaaaggatatgaacagacacttctcaaaagaagacatttacacagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaatacttttacagtgttggtgggactgtaaactagttcaaccactgtggaagtcagtgtggtgattcctcagggatctagaactagaaataccatttgacccagccatcccattactgggtatatacccaaaggattataaatcatgctgctataaagacacatgcacacgtatgtttactgcagcactattcacaatagcaaagacttggaaccaacccaaatgtccatcaataatagactggattaagaaaatgtggcacatatacaccatggaatactatgcagccataaaaatggatgagttcatgtcctttgtagggacatggatgaagctggaaaccatcattctcagcaaactatcgcaaggacaaaaaaccaaacactacatattctcactcataggtgggaattgaaaaatgagaacacatggacacaggaaggggaacatcacaccccggggcctgttgtggggtggggggagtggggagggatagcattaggagatatacctaatgttaaatgatgagttaatgggtgcagcacacaaacatggcacatgtatacatatgtaacaaacctgcacattgtgcacatgtaccctaaaacttaaagtatataaaaaaaaaatacgttgaaagtaaaagaaggggaaaagaattccatgaaaacactatccccaaaaaagctgatatggctatattaatattagatgaagtagacttcaaggcaaggagataaacagttcaaattaataaaataaatgaccagaatgatataaaaatcctacatacttgcataaacctaataagaactattcaaaatatatgaagcaaaaactgtcaaaactagaaatagacaattctaccatcattgctggaaattcatcatttctcttttgtaactgacagaacaaatagacaaaaattggtaagattataaaaaactaaagcaactctcttggccagattgatctaataacatacacacctacacaatgcaattgaaaatacaaattattttcatgtaaacacgtaacattcacaaggatagactgggcgataaaacaagttataataaattacaaataattgaaattaaatagaatgtgttctctggccacaaaaggaattaaattaggaatcaacagtatgtataaaattccctaatacttgaaaattaagcaactcatctctaaataactcatagcttaaaaaagaaattacaaaggaaattttaaaatatttttgaactgagtgaaagtacaaacacaacatatcaaaatttatgagatattactgaaggagtgcttagaggaaaatttagaacattagatgttatgttagatttttttttaaatctctacttcatgatctaaagctcttgattaagacattaaaaagtaagagcaatgtaaaccacccaatgtaaaggaaataataatcatcaaaaatgaacgaaatagaggtcaaaccagagtagatcaacaaaaccccaaaacagttcttcaaaaatactatataaaaccctaacaatactgatccagaaagaagaaacataattaataccaggagtgaaaaaaaagcatcactgaattctacagacattaaagaaataaagtaagattattaactctattcccagaaattgacaatttagatgaaattaagagattccttgaaagacaaaactcaccaaatgtaacaccaaacacattggaaaatataagtaacccatatcattaacattttttaattcaaaattaaatacccacaacaaagaaaactacaagccacaggtggctgcacttgttaatgctatcaaacatttaaggaagaagtaacaccaatcttatgcaaattcttccaggaaataaaagaagaaggaaatctttccaactgtttgtctgaaaccagcacaatgttgataactaaaacttgacaaaggcagtacaataaaagtacaagtcagtctcatttatggaactagatgcaaaaatcagatataaaatattagcaaatggaagacaaacatataaaagaaagataaagcatcataaccaaggtggatttatcccaggaatgcaagtttaaaatttgaaaatcaatgaatgtaaaatactgattaacataagaaaggagaaaataatacagtcatatcaatacatgtgaaaacatttgataaaattagatattttaaaataaaaatccttaacaaaacaagaatagaagaatatttcctcaatagaataaaccgtactaagaaaaatctacagcatcatacttgattgtgaaatactgacttttttttgtagaatcagtaaccaggggaggatgtttactatcatcacttttattcaacatttagttcataacctagtaaggacaaaaagcaagattaaaaaattatatgcctaaagattagaaagaaaatttaaaactgtctttacttgccaatggtatgatggtgtatgtagaaaacccaaaggaaactacaaaaataataagtgaatttagcaagactgaagaacacatgtcagtagacaacaattaattatatttctatataaataacagcaaacaatttgaaaatgaactttaaaaaaataccatgtacaggatagacttccagctggcagcctgaggagtatcatagacttattcctgagtggaagagcataatttatgaaagctattttaaaaacaaccatgtaaagtctccagaaattgtcgtaagggcatatagcaaatgaagacatatttattcaagaaaatctactgaaacttggtagaaacaatgagagtctgtggcacttgaaccacaactcacttaattcctctcccccttccaggttgccagcatttctcatcccctccaactccaagttgaagagaccaaattcctgggaagtgttaccaagaggtcagaggctcccttctgaccattccccaatgacaggacagaagctctaccccaggcatagacctcagtaccataaaatattgaatccctgattgcccttaccccatcttgctcatagggcagaagttttatgcttgaaaagataagctgagaagaccagaggataccacctttgcccaaggcccagactagtggctcaaaggttttgcccaggaaagaaatgcggtctacgtgaatagagagcttcaaagccctccccaaagtgactagccttatatgaaacagtgtgggaaagttcaagcctaagtgtgctctcaagaccaatgggaaatttggtgataatgaaataagaggaagtaattgatagcacctcttaattaggggcaacagactagaccagtgagaaccaatgaacgagactgctaagaagagccttcctgggatttaaacctcaaagactagcctgaaaaatgaccccttatcaaattaaattagatcagaatactgtacaatgtatgtcccagggtactgtcaaaaataatagaacatctggtggatgctaagcttgaaaaacaataaaataatagaccaattacccagctgtgatttggcagtgtaacagctgtatatgatattaacagaggcagacaggttaacagagagatgaaggagatagttaaagagaatcctgctaaaatcactgccatcccagagtgactatatacactgaatactgtgccttctgagaagcaacctcaaagtcttcacaatgtagaggaaataaacctcatgaaaatagtctagccgagtcactgaataaataaataagcaaacagcaaaaactggagaggggagagaggaatcagtcgtcagtacccagaagtgatacaatatattacctaaaatatccagttctcaacaaaatatcatgagacttgcaaagaaacaaagtgtggctcattcacagggaaaaaaagcaacaaaaatttcctgtgagaaggcccagatgttggattgaacagaccaagacctcaaaacaaccattataaatatgcttaaagaactggaagacactatgcttaaagaagtaaaggaagctatgatgacaatgtctcatcaaatcaagaacataaataaagaaatagaagttacaaaaagaaccaaatggaaattctggagttgaaaggtacagtaagtgaaaagaaaaattcagtagtgggactcaacagtagatttgaactagcaaaaataacaaccagtaaacttgaaaataggttaatagagacagtgcattctgaaggacagagagaaaaaaatatgaagaaaaataaagtctcagagaaacatgggacacaattaagtgcaccaacatatacataataggattagcagaaggagaggagagttagagaagaaaggagaaaaatatttgaagaaataatgactgaaaacttcccaaattttatgaaaaacattaattacacatccaagaagctccatgaactccgagaagataaatggaaaaatatctacaaccagatgcatcatagtaaacatgctgaaacacgctacaaggcaaaaaacaaaaagaaaatcttgaaagcaataagagaaaaatgacttgtcacatacatggaactcttacaagattaacagctcatcagaaacaatggaggccagaagggaatgggatgacatattcaaattggtcaaacgaaaaaactgtcattcaagaaacttatatccagaggggaacaacacactggggcctgttgttggagcagggggagggagagcatcaggataaataactaatgcatgtggggcttaatgcctaggtgatgggttgataagtgcagcaaaccaccgtggcaaacgtttacctatgtaagaaacctgcacgtcctacacatgtatcccagaacttaaaataaaattaaatttttaaaaaaacctcatatccagcaaaagtatttttcaaaaatgtaggtgaaatagacattgtcaggtaaacaaaaactgagagaatttattactagcagagccaccttacaagaaatactacgggaagtttttcaggctgaaagaaagtgaacctagattgtaatttaaatctacacaaaggaacaaagagcatgttaaggtaactatgtaattatgaaagagtataaatgcatatttcttctctcagctgatttttaaagcaatttataaaacaacatatatataattgttatttggggatctataacatagaaattaaatacatttgtcagtaagagcataaaggaagtgggtgggagcaaagttctgtttcagtaaacagattattccagatgatagcctggattcaccagaacaaataaagagaataaaaaatggtaaatggtaaatcagaaggttataaatatatgcttgttcttcttatttcttagcttttataaaagaaataaaattatataaagtagtaattataatgttttattggtttgtaaaatatatagatttaatttgtataccaataacagcacataagagagaatacagctattaaaaattaacatttctgtatctcactggaattaagtcagtatacatctgaagtagactctgattggatatatacagtaagttctaatgtatacggtaagttttaccactaggaaaactccagaaaatatggtgaaagattaatcaaaggaatgaaatgctgcacaagaaaatattcacttaatgccaaacaaagcagtaaaagactagaggatcaaaaaaaaacatgagacagagaaaaccaaaaggaaaatgacaagtgtaacccaactatatcaataatattaaatgttaagtgattaaacaatccaatcaaaagacatagattgtgagacttttttttaaaaaatcaagatctgcctatatgctgtttatgagagagattttagatttaaaggtgtaaataggttgaaaatgaatgggaaaagatcatatgaacaacagccataagaaaactggagttactgtactaataccatttaaaaaaatagattttaaagcaaacagaatgtcactagaataaaaagtgaccttttataatgataaaagtgtcaatcaagatgagacaataattaaaacatatatgtcccaaataacagagttacaaaatacatgaagcaatgcctaacatgatcaaaaagagaaagtcaataataattgttggaaatttcaaagttccacttttaaaaatagatacaagaactagacagaagatcaaaaaagaattagatgactggaaaaatgctatgtagaagacctcgataccaaaatctccaaaatattgcagaaagaaacatttaaaaaattatttaaatggaggggaataccaggtttacaggttggaagactcaccttttaaaagatctttattctaccaaattaagccatatgtttatcacagtcctataaaaaaatctaacatattatttgtagaacttgagaaagtgattctaaaatttatgcagaaatgcaaaggatctggaataactaaaatactcttggaaaagaagaacaaaattggagaacttcactacctgatttcaagatgtgccttaaagccacattaattatgatagtgtggtaattgaaaaaaagataaataaatggatcattacagaataaaaagtccagtaatagatccacacatgtatggccaatttgtttttgacaaaggcaccaataaaaatcaatgaagaaagtctttttaacaaataatggtggaacaactgggcaaacaaataggagaaaaatgaactttaattcctacttcacgtcacaaccaatcatttttaaagttctagaagaaaacaaagaataatatcttcatgatcataggtttggcactgactacttaggaattaaaaagaaattacaataaaaataataaatttttcttcaagtaaattaaatttctgctcatcaaaaggcactattaagaggccaggcatgggctgggcacagtggctcacgcctgtactcccatcactttgggaggccgaggcgggtggatcacgaggtcaggagattgagactatcctggctaacacggtgaaaccccgtctctactaaaagtacaagaaattagccaggcatggtggcggacacctgtagtcccagctactctattccgaaggctgaggcaggagaggggcatgaacccaggaggcagagcttgtagtgagccgaaatcgtgccactgcactccagcctgggtgacagagggagactccgcctcaaaaacaaaagaggccaggcatggtggcttatgcctgtaatcctagcaccttgggaggccaaggcaggtagaccactggaggtcaggagtttgagaccagcctggccaacatggtgaaaccatgtctctactaaaaataccaaaattagccaggcatggtggcccacacctgtaatcccagctacttgggaggctgaagcaggagaatcacttgaagctgggaggtgaaggttgcagtgagccaagatcgcaccactgcactccagcctgggcaacagagcaagactctgtctcaaaaaaaaaaagacaccattaagcaaattaaaagataaatcacatactgaaagaaaatattcacaatgcctatttttgactaataattcttacctaaaacatatgaagaattcttactactacataacacaaatataagcagtccaacataaaaaataagccagaaatttggatagaatcatgaagatatatgattagccaataagcatgtgaaaatgttccaactatccatagtcatcagagaaatttaaaatcataataagatactactatgaccagaaggactaagattttaagagactattacctagtgttggtggagatattgagcaattggaactcccgtaagttgctacggagaatgcaaaatagacagcccctgtcattaccatagtggaaagactatggaagtatttaaaggaaaaacacaaacaaatcaaagattttgacatataggtatttattgtggctttatttagtatagtaaagattggaaaatccaaatgtttcacaatggaggaatgttaaattaaaagtgtggtatatctttataatgatttgataaatttttaaaatggtggaattgtttatgaaataaatgttatatacaaaaatcacaagcattcttatacaacaataacagacaaacagagagccaaatcatgagtgaactcccattcacaattgcttcaaagagaataaaatacttaggaatccaacttacaagggacgtgaaggacctcttcaaggagaactacaaaccactgctcaatgaaataaaagaagatacaaacaaatggaagaacattccatgttcatgggtaggaagaagcaatatcgtgaaaatggccatattgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcaagctaccggacttcaaactatactacaaggctagagtaaccaaaacagcatggtactggtaccaaaacagagatatagatcaatggaacagaacagagccctcagaaataacgctgcatatctacgactgtctgatctttgacaaacctgagaaaaacaagcaatggggaaaggattccctatttaataaatgatgctgggaaaactggctagccatatgtagaaagctgaaactgaatccctgccttacaccttatataaaaattaattcaagatggattaaagacttaaacattagacctaaaagcataaaaaccctaaaagaaaacctaggcattaccattcaggacataggcatgggcaaggacttcatgtctaaaacaccaaaagcaatggcaacaaaagccagaattgacaaatgggatctaagtaaactaaagagcttctttttttttttttttttttttttatggcagaaaaatgtagttttatttgttttgtttttgacttaaggtatgtcaatcttttttttttttttttttttttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaaagattagggagtggtgatgactcttaacgagcatgctgccttcaagcatctgtttaacaaagcacatcttgcaccgcccttaatccatttaacgctgagtggacacagcacatgtttcagagagcacagggttggggataaggtcacagatcaacaggatcccaaggcagaagaatttttcctagtacagaacaaaatgaaaagtctcccatgtctacttccatccacacagacccggtaaacatccgatttctcaattctttccccacccttcccgcctttctattccacaaaaccgccattgtcatcatggcccatcaccaatgagccgctgggcacacctcccagacggggtcatggccgggcagaggggctcctcacttcccagtaggggcggccgggcagaagcgcccctcacctcccggatggggcggctggccgggcggggggctgacccccccaccaccctcccagacggggcggctggccaggcagaggggtcctcacttcccagtaggggcggccgggcagaggcgcccctcacctcccggacggggcggccggccggaaggggggctgaccccccccacctccctcccggacggggcggctggccgggcagaggggctcctcacttcccagtaggggcggctgggcagaggcgcccctcacctcctggacggggcggctggccgggcggggggctgaccccccacctccctcccggactgggcggctggccgggcggggggctgaccccccacctccctcccggactgggcggctggccgggcggggggctgacccccccacctccctcctggacggggcgactggccgggcagaggggctcctcacttcccagtaggggcggccgggcagaggagcccctcactcccggacggggcggccggccgggcggggggctgacccccccacctccctcccggacggggcggctggccgacccccccccccgcctccctcccggacggggcggctggccgggcagaggggctcctcacttcccagtaggggcagccgggcagaggagcccctcacctcccggacggggcggctggccgggcggggggctgaccccccccacctccctcccggacggggtggctgccgggcggagacgctcctcacttcccagatggggtggttgccggacggaggggctcctcacttctcagacggggcggttgccaggcagagggtttcctcacttctcagacggagcggccgggcagagacgctcctcacctcccagacagggttgcggcccagcagaagcgctcctcacatcccagacagggcggtggggcagaggtgctccccacatctcagacgatgggcggccaggcagagacgctcctcacttcctagatgggatggcggcggggaagaggcgctcctcgcttcctagatgggatggcggccgggcagagacgctcctcactttccagactgggcagccaggcagaggggctcctcatatcccagacgatgggtggccaagcagagacgctcctcacttcccagacggggtggcggccgggcagaggctgcaatctcggctctttgggaggccaaggcaggcggctgggaggtggttgtagcgagccgagatcacgccgctgcactccagcctggacaccattgagcactgagtgaacgagactccatctgcaatcccggcacctcgggaggccgaggctggcggatcactcgcggttaggagctggagaccagcccggccaacacagtgaaaccccgtctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatcagagggagaccgtggagggagagggagagggagagggagagggagagggagagggagagggagagcgtaagcgtaaactaaagagcttctgcacagcaaaagaaactaccatcagagtgaacaggcaacctacaaaatgggagaaaatttttgcaacctactcatctgacaaagggctaatatccagaatctacaatgaactcaaacaagtttacaagaaaaaaacaaacaaccccatcaaaaaatgggcaaaggatatgaacagacacttctcaaaagaagacatttacacagccaaaagacacatgaaaaaatgctcatcattactggccatcagagaaatgcaaatcaaaaccacaatgagataccatctcacacccgttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccttttgacccagccatcccattactgggtatatacccaaaggattataaatcatgctgctataaagacacatgcacacgtatgtttactgcagcactattcacaatagcaaagacttggaaccaacccaaatgtccatcaatgatagactggattaagaaaatgtggcacatatacaccatggaatactatgcagccataaaaatggatgagttcatgtcctttgtagggacatggatgaagctggaaaccatcattctcagcaaactatcgcaaggacaaaaaaccaaacactacatattctcactcataggtgggaattgaaaaatgagaacacatggacacaggaaggggaacatcacactctggggactgttgtggggtggggaggggggagggatagcattaggagatatacctaatgctaaatgacaagttaatgggtgcagcataccagcatggcacatgtatacatatgtaactaaccttcacattgtacacatgtaccctaaaacttaaagtataataataataattaaaaaaagaagctcatcaaagtaaaaaaaaatcagaatatgaaactctttattggattaaaaatcatcatggaaggggccaggcgtgatggctcatgcttataatcccagcactttgggaggctgaggcaggcagatcacttgaggtcaggagttcgagaccagcctggccaatatgatgaaaccctgtctctactaaaaatataaaaattagctgggcttggtggcacacacctgtaatcccagctacttgagaggctgaggcaggagaactgattgagacccaggaggcggaggttgcagtgagccgagattgcaccaattcattccagcctgggcgatagtgagactctgtctcaaaaaaaaaaaaaggaagaaaaaagccaaaattatgatgaaattgtgtattttttaatcctctccatcacttttctgtatcttccaagttttctagagggacaaaactttacttctatagtccaaaaaatgtttatttttaaataatgattgttctgaataactatatagtatttaatgatgataattataaaattgtttagggttttgacacgttgtaaattggcacaaggaagtagttttactattattgttagatccatattcagttcagttcctaccttcatcaggaaagtaggtaaattcagaaggagctagggaaaatgacagaatcaatagacagtacagaaatagaaaagatggtattttccagacaaatgagcttagctctttaaccaccaaattttgtattttaaaattttgatgaaactctttctaacatatacatcatgctttcttacttactatcttatagtgaccaaatcccatccttcctcctagctgtttaactttggagaattgatgtaatagcctttcttcccctgttttcttatctgtatgatggggttaatattataacccctctaattatattggtaggtgggaaaacgataatttatataaagtatttagcggaggattaggtacaaaataatagatactagttgctgttattactattactacaaagagcgtgtggcacagtaggcattcaataaatttgattcactgactcaacttacagtgatgtctttaaaacctttcagagatctgtaaaacacccacctgttaaatggtcccagatctctcactcactagtcattacagttcctttctctgcccattttttcactgttgttccacgttacttttcttaatgtttctagttctagcagcctcctcctctttataacttgcagtttctaatttgctgtcagatagcaaagcctgttcaagtcagtacactttcaaggagtgcctagaaaactcttatagcaactctgtggattaacacttactgcttatttagtcaaactttttcctaatttgtatatctagggttaagaccgtgttcgacatagtttagtttgatgaatgcctatttccagattaatggtaatatttatatcagtaaatattatgtgtactatgattacaaacagaaatttaaaattggatgagcattacattgaaagtcttgaaaataatgttcaatgaagtaaaaaatagagcaaacagtaagctttgcatttggtattcagtgctctataagcaattgaaatatgagtgcagaataaaaaatctgagttctgtgtccttttcaagctatgttattgacttacttctctgactttgaataaatagcttaaactctttgaagttatagtttctcacttataaaacacaagagttgggctaggttgtcacaaggcaccttttggttccaaaattctgtgattttttttggacctaccacaagcttattgctataaattgtataaagaagagggtgatgggaaagaataggaacaaagattattttggtcattgaaaatagctctcaaatgtttctgagcatggagacagattaaaatagaaattatgaatatttatttcacaaaagaaagtctgtgagactttctaacaaagatagaaaaaccataatgaagaatattttacaaataccatataaatacagattggcaagtagaaagaattataaaatgtttattaatctgttgtgtctattgttgcatttgtcagaaaagtggcagaataaaaattaagaaatattggaaagagaaaaatatagtgcttattataaggaatttgatactattgaacaaaacacagtatgtaatatacaatactacatttttataaataaatataaaatttagaatttgtagtttttaaagatcttttaaaagccaataatcatatctcctgagaggatatttgattaggtattgttaaaaccccttctaattcttcttatttatgatctattttcagataaaattgggtcatttattaaagtagctatttcttataaaaatagttaaaaaaggattttatatctttgtaccatccatgtttaaatactcttgcatgtcaatcagttacttctccttattttttcctgtatcacttgtttaaacaaattttcagaataggccaggcatggtggctcacacctgtaatcccaacactttgggaagctgaggtgggagtattgcttcagcccaggagttcaagaccaacctgggcaacatagtgagaccctgtctctataaaaataaaaaaaaaattaataaaaatatttttaaaattcagaataattgacgtaacttggacatgataaagtagttttcacataaaaaaaagccttttaaacttgtaggaattaagaaataagaataacctacaaaatgctagcaaaatttatctcattttttttcattgtattttcaggtttaactgaactgaatgacagtccagttcccctagaacttgagcgctgcaagtctcctacctcaggtaaacatgagtggtattttgcagacttctggtaattcactgcagtaatctgttgctttattttcatgatctttataatgtgaaatttataattttagtaattaggtataattccattcattaaatttactgtaagcaaatttgattccaaatatcaaatacaaacaaatgtcttttaaaatatttttatctcaaaataaaattaagatcagaggtaaaagtgcaacactttaaaagacattttaaaggaaagttattttgcagatacattaataatgcttactaagtattgaataaaaattggtgatatagagaaacttgtcatcttcaggctagagctgaattagtgggaaatatacagtatatatgcagaagcaaatgataccattcctctagaccacagtttggaaacatgtatatttattcacaaggaaaaatgatgatagaatatgatatgaagcaaaacatcaagacaaagtgtgcacccattaaaatatatttaaaatgtgagaataaagattcctagggataaatctttaaggtactgtctgttaaaaaaaaagttaacagttatttttgggtggtgggaatatgactggttggcctgttttttaaaatttttacatatttgataattctgatttttctataatgtatatatagttttgtgtgagtttttaaacaccaaaatcattaggtatgtctttactgaatgatagatctgttcttacagacaagaaactgtagttcctttttatttacattattttaatttgaaccttatacaaatttataaaagtttaataatgccattataaagcaacgaatttggacttgtagaaattaatttagaattgcagcatttcttccatttattccatccctgaaaagtggttagttctttattcttattcttcaggaatctaggctatgtataatctagttatatcctatgtaaatttttctcttagtcatatatttttaattcttattttactgatcttattgtaaagactgtctcatatgtttaccctgccttttgcattctcattgacaccaacccaatttaggtatttattgcctcatacctatggtatcatacaaatattctagtagatgtctgtattttctctcttcaccttttacaattaatgttgcatgtcatgttgtaaaattaatattcttaaaatattactttgatcatattttcccatgcttataaatcttcgatataaaatataattcaataccctttatcaaatttacatacgtaacttcaaattttgttatagctggccaggcacagtggctcatgcctgtaatcccagcactttgggaggccaaggggggaggatcacttgaggccatgagtttgaagaccagcctgggcaacatagtgagaccctgtctcattaaagatgataataataataattttaaaagttttttaaagatcattatagctgttctacctttttgtattttcatataacttttataaagaatttgtcagttcacacacaaacatgcttagatttttattatgatttcactggatctatagatcaactgggcagaattaacatattcaacaatattgaatttttcgtttagtatctctctgtttatgtgtgtctactttctttcggtaatatttttgggtttttttgtagaggtcttgcatatctttcattaaatttattcctttgtgtttgtttttttcctattattgtgttatttttatgtctttttctaattatttgtggttagaatatgaaaatacagctaatttttgtatattgagcttgcatccaggaaacttgctaaatctatttcttaattcttatagttggtaaaattcttttggattatctacgtatctaagtatgccccttgtgaaaatgaaacctccattttctccttctaaaggaaaaaattggctagggccttcaatacaatgttgaatagatgtggtataagtagactttttttcttgttcccagtctcattgataaggctttcaataactcataattaattattataattgctgtcagtttttggtagatatgctgtttttagccctttgcctatgatgtttcttcttttgttaatgttacagcagatttaggaacaccaccacaacgcacaacgaccacactttttttttttttttttttagacggagtcttgctctgtcacccaggctggagtgcagtggcgcaatctcagctcactgcaacctctgcctccgaggttcaaggattctcctgcctcagcctcccaagtagctgggactacaggagcgtgtcacacacccagctgattttttgtatttttagtagagacggggtttcactgtgttagccaggatagtctcgatctcctgacctggtgatctgcccgcctcggcctcccaaagtgctgggattacaggcgtgagccaccgtgcccggcccacactttatttttaatttcaaagcagactcagaaaactgtgcatgcaattaagtagattgtttcaaagcaggaaaattttgactatttttgtattatgttacttgaggcagaaatgatggattgtgataagatccatttgtcacttcaataccttacttgatactggtctactagacaggtcccactcttctttagtagcaactttaaattataagtaataataattgaggaatgagagatttttttttccttataacagttttgtaatcattaaatgttatatttgttaaactatgtgaaatgcatccttctgggaaaagtgcgaatggagtttactacttaagaatattggaaataatcacaatatttactgatttcattcattttccatgaaagagaatgataattaattgtgctatattagagggtcatttaaaggacagtgtgcccattattatttccaaaattcaatacaatacatatacaatagccacacatacacctaaaactacattctgtaatctcttgctgttgtaggaattgctgcattctgattcagtagatctgaggtggggcctgagattttgtatttctagcaagctcttggctgatgctaaggcttctggtctccagatcacttgagaatcactgccctatgaaacattttaaaaatattttttcagtagttacctcccctgtaggtatctgtttgggaatctcagctctcacccctttaaatctgctacagatgaaaagattgatgcaaatgtctctgaataaaggaggtcaggaattaggcaaaccagaaaccagtaatcattttataactctgatattctccttttaatataatttcaacttttattttagattcaggggttacaagtggaggtttgttacatgggtatattgcatgaagccaaggtttgagatacaaatcttcccatcaccccggcagtgagcatagtaccctacagttagtttaccaaccctactcttgtcccccttccttcctttcccctctagtagcccccagtgtctatggttgccatccttatgtccatgaatacccaatgtttagctctcacttacaaataagaacatgcagtatctggttttcagttcctgcattaatttgcttagggtaatgacttccatccagctgcatccatgttgctttaaaggacatgatttttggctgggcgccgtggctcacgcctgtaatctcagcactttgggaggccgagatgggcggatcacctgaggttgggggtttgagaccagcctaaccaacatggagaaacccagtctctactaaaaataaaaaattagccaggtgtggtggtgcatgcctgcaatcccagctactagggaggctgaggcaggagaatcacttgaacccaagaggcggaggttgtggtgagctgagatagtaccattgcactccagcctgggcaacaagagcgaaactgtgccaaaaaaaaaaaaaaaaagacatgactttcttttttatggctgcatagcattccatggtgtatatgaaccacattttctttatccaatccactgttgatgggcacctggttaattccacgtcttttctattgtgtatagtgttgcaatgaacatatatgtgtatgtgtctttttggtagaactatttctttttgtgtgtgtgtgtggggtggggggttgagggggtgcggatatatgcccagtaatgggattgctaggctgaatagtagttctaagttatttgagaaatctccaatctgctttcctcaggggcagaactaatttacattcccatcaacaatatataagtgttccctttcctctgcagcttcaccagcatctgttgtttgttgactttttaataacagctattctgactggtttaagatggtatctcagtgtggttttgatttggatttctttaatgattaatgatgctgagcactttttgatatgtttgttggctgcttgtgtcttcttttgagaagtgtctgttcatgtcttttgcctactcttaatggagttatttgttttgtgcttgttgaattgtttaacttccttgtagattctggatattataacttagttggatgcgtaggttacaaatattttctcccattctgtagtttgtctgtccaccctattgattgtttctcttgctgtgcagaagctttttaattaggtcccactcatcaatttttgtttttgttgcaattgtttttgaggatttaagtcataaattctttttcaaggccagtgttcacaatggtgtttcctaggttttcttctaggattcttatagtttgaggtgttacattgaaatatttaacccatcttgcattcatttttgtgtatagtgaaagattataactctgattttctatgtgggtctcaaacttccttataccacagtgaactacagataaaatagagtgagggttcagacctaaacattttcttgaggataatacaggagaaaagagcagggattgggagcttgaagaatccattgagtcaaatggaatgccaatgttctcagtttccaagataatataacactttatattatctattcattcactcaactatacatcaaataatttccagtttctacagctagacattatgctattcactgaggataaactaatgaacaaaataaacatacttcaaatgcagaaataaacattaaactttaattatataaattgttcatacttttttaaaggctgtacaaccttttttttctcaccaacttgtactgtacagcttgacctcccaagagggtgagtaggtgctaacaatcagccctagcttcacttacctggtacaggactacaacctcttaaagagaacagatcctttttatttggacgaagaattgaaaacttaccaagctttcaactgtggggctgtgtctttctaaatgttgtttgtttttctaatgtcctattgaatgtatgccttttttctaattctttacttggattaatatctttttctatactagcattaggtcctgacactgctgctacctgtgtagacattcaccttcataattctcagtgcacaatctacaacacatttattatgctatcaagttcaaatgaaggctaggatgatagaaatatatatctttatcaaaatatcatagaggttagtcacaaaatactaacaaaggagtatcaaactctgttgttctcaggattgggtcagagcttggtcttacagcctagtttgaatgctccttctgggcattcctatgtgcctaaagtcctattttagtctccaaaaacctttcttctccctccaaacagtcctttgttggagcagtatttatctttattttagataaggatacaaaatgcagatctttccaaatagttattatgaaattcagctttattaaagataaaaattattggttcacttaggctaaggtactccatgccaatagttttatattcccttcctttaggacttgctaccagaacccctgagtcagcactaggcttttataggaatgaaatatcagctatgagacagaggaatcaagtatatcacttgccaggtgaagatgaaaatctctttatgaacaaacaaaagttattcatatcttcacaattttctaggcttcacaacttgtctcaaaactttattctcatttgttgtggtggaaacacaagtccttcatggtgtatgaaaacaaatttttctgaagcaaatataacgccagagacacttcatgagatatgaattaggaatccctaaggcttttgtgaaatgtttggaaattttccacaaaattttggtagtgttgtttttgtactctaaacctgattagttttctcaggtctctaagaaagtaagggggtcgcgggtacggtcaatagagaattcagtgaaatcttaagatccaaacaatagtaagattttttttatattctctgtaattcttcataataccatgaaatattttctatcatcagaaacaactatgattgcctcaaagaggcaatgttatctctcaaaaacagtaaatggaaaggaaggtcctataatctaaattttatgcagtctttgacatttgcttttttttaccccatgctagctcatagtgttaaaaagaaaaaaaacactcaaacacaggttgcacagcctcctgaaattaggcattatcgcaaaatgactgtggccagttttacaactccacaaagtgtgaactattaatgttctagtccccaaataaagtcagtagccaaggaagatagagataatagttatccacagtttttcaaacagtattttatttttctcttatgtaatacaacaccccagcatatgcctttttctggtgagaaaactaaagttcagactatttaagtgagtagaggtggaattccaagttagttatatttgttttttccctagtgttcgttaattaaatgagaaaaattaatttgggaattacaaaaaataatcacaattaaaattatgggacattcaaacagtgagaaaatgaaaagtagctgagctgtgaaatgttttaacaaagaaatttaatagaacttaagaaatatacattccatgaaacatcagaaaaaatatagtttaccattaaagtttctggaaaaactgattttcaaaataatttttagttcttacagttcataaatcaacaacattatcaccttttgagtatattaagccttttttactaaaaattataatcaacatttgtatagtactttaaagcaaacaaggtatttttcatatgtattatctttaatccttacatctatgtaatactattattgttcttattttgtatgaatggagaaattatggctaagaaaagattctatagctttcccaaggtcactgtgctagtaatggcttagtctgaacccaagtcttcaggtcttcagacttcaaggtcctctgattatttggcccaaattatttggcctcctattatgtctactaaaaaaaaaaaaagtgggttgaaaaactcagttatcactgtaagtttataactcaaaatagacattaatcttaacagaaatgaagttttataatcatcgaacaactatatgacattaatagtcatggactcattaacattgtccaaatagaaatatattatatattttaagatgaaggtagtgtcacaacattaaacattgtcatgctggagcaaattctaataaaaaatacctctttacccagttgtatcttaaccacatcttgggaaaaaaggggaaaattgcaacaaaattagagatatgtaggctttttatggctttaccatggcgtggtgaccccagaatgcttgcttttttgtttttaactttgtctctatacataccaggtgtttttgtcttatcttagtttctggcttagggaaaggtagagacaaatgaaatttgttactgtattccaaccagtcagctaattaatcagtaaatagataaattcataagtacataaactaaaaacattttaatctaaacaacttttattttaatttaatgttgtatttatttatttcagagaatatatccagaccatacaggtggtatcttctgtatcaaggagattatgttgcttagtggaaatggcatagctttggagtcaattttagagaaaaatttgaccttaccctctcactttctacagttataactttagcaggtttcttacacttaattgtgtgccagtgttcagaacatagatgctcaataatatatggtagtgattattataaaagcagtggtgaatatccatggcctgaagagactcagcttggtccctttgaccattctggacttccaaatattcgttgtagcttagccataacaaagtagaaattcttcactggaaatcaaaaagtaaattctgtcatttcaaagtaagaagcaattaatcagaagctttgaattagaaacttctgacctatctctttgtgatatctcccattaaagtagtagccatatgcagactttgattcaggatttaacctgttcctaaaattttaattcagatgtagaaccaatgatctgactgagacttatttgtagccaatacaacatccttatgatgaaccaggctgcactatccattgactttgaattgaattaggagtcagcagaaagacatacgaatatacagatgattgaagaaagatgatacagtcaaaacacacgaagtcccctagacaaaaccataatgtaatgcctgcaattctatttttatttagggttaagcataaaacctcattctcacataagctatggtaagccaccaaactgttgattactctgctgcaatgctataattgaacataaatttggaaagaatgagtctaggagtagagataaatactttcacaaaggtttataatctgctgctgttgtgaggctaggccatcatctgatctttaggccagaatttacagatgactattattgtgtattttgccatcagtgaatactttcactcattttcataatttttagtctctcatgctataccacttaacaattactagttaattcagaagttgatagatgtaactaggtaagtgattaacccaatctgtggggatgctttcctatgtattttgtttctttttttagtcatatttattaaagtacaatttatgtaaaataacattcacattttagtgtataattctacagattttctttcttttgtttttgatttggtttctattttcaaaaagtatgctacagcatgttaaagtaacaaaaatttcctgacaatttgcccagaatctaacaagtccgtgggcataagaaatcaaattgttataattctaacacttgctgtggtaatattccctcactccaactggattacatatggtactttttgccgtgttacttttgtgagctaagacaggcagtttttcagggtgtgaaggattaaagagaccattcaatgtgaggatgcacaatgtgacttaaggagatttttagagaaaataaataagcccgttataattcaagtttgttaggacatactattgtgcaaaggaaataacagtattatatacaattgaaggctttatcaagtgtgctgtttaatgccaggcactagattttcagtagaacatgttgcccagataaattatttctgacatggaatactatagaatgacaatcttttcttgccaattaagtttaataatgaaaataatagctaacattgaatgcttgccatataccatacactatgctaagggctttacacacattccttccattaatcctgacaagattcttgtgaagtacagacaattgttatccttattttacagaggaagggaagcatcaatctttctgaaattaagtaactattagcccagggcagatggttgagtcatgatttgaatccagctcatttgtgttcttaaaaactaggcttcacggctgggcctggtggctcacgcttgtaaactcagcactttgggaggccgaggcaggtagatttcctgaggtcaggagttcgagaccagcctgaccaacacagtgaaagcccgtctctactaaaaatataaaaacttagccgggcatggtggcatgcgcctgtaatcccagctactcaggaggctgaggcagaagaatcgcttgaacccaggaggcagaggttgcagtgagctgagatcgcaccactgcactccagcatgggtgctagagcaagactctgtctcaaaaaaaaaataaaaaataaactaggcttcgcttcataaatgctaggaaacctaccatggagaaaagcaagagtgtctgtgtggagctgtacaaagggaaaaaaatgcatctaacctctcctaataggggcactactgttccttgtaactaccaccttctattcctcattagaaaatggaatataaaaatatgatgaaaaattttaattacttaaaaaaagaactaatcataatcaccttaaaaagcccagaaaagttatatatatacacacatatatataatgcatatgtgtgtatgtatatatattatatatataatgtacatttgtatctgtatgcacatctatgtctaattcaacaactaagaacaatatggcttctcttgtatggaaaatctgagctgcacttcaggaagtacttcttatgtaccttcttatcctgggtaaaagtcccgtaggttggttaatactcatgaagacttaaaagattgctttttgaaatgccatctgtcaacctcttgatgtcagtataacctgcaattcttcttaaaatacaattcctgctgacctaaggatacctggaggtgtccactaagtctctccaggtgctttaagatctggcatgtgggagcaagaactagttaattactcattattggtccagaggttagaactgagacaaatcaataaatggtaaagaaaagtagtttgagcttgaataggaggaaattctgtggcaattatagcaatcccaaattagaatttttttatacttttggaggttctatcatggaaatactcaaacagttagaatgtcaagaatgtagtaggggtgggacgggtggcccatgcctgtaatcccagtgctttgggaggctgaggcgggaggattgcttgaggtcaggagttcaagaccagcctgaccaacatggtgaaacctcatctctactaaaaacacaaaaattagccaggcatggtggcaggcgcctataatccacctacacgggaggctgaggcaggagaattgcttgaacccaggaggaggaggatgcagtgagccgatattgcaccactgcactccagcctgggtgacacagcaagaccctgttcccccacattcctcttgccgaattaaagaagaaactacttgtcacaccacatatgaaaaaaatctacataaagatacacttatttaatgtaagacaattgcttttcacatatttctgtttgcatattaaatatttactactgaatagcaaaacactaatattggaacaatatttctgcttccatacatgctcactaaatggaatgttcatcagggttttaataattatacaatatttctgcttcatgggcagactgggaggggcatggcctgaaagccacagtttctatctcaacagggaaggcttatggcatagggcataagccttctgagtgcagactgctcagaacctagctagctgctgctagtggaacactgtaggtgtgaaacctgccttgccaagtatgtgggagctggatggggcttactgctgcctgctactccccactgccctagcagattcttctgggaagcagaggcagctacacttctccttggaacattaccccagcagcagagaactgccttctgatttccccggggctgcttcttgcacccacatgtggagagctagagtgcagacttaacctgacccagccaccacctggctttgctcctctacccaccctaatggcttaacacaaaggacagaaacttttgggagttctatgaccccactcattgcttgagacagtagggtacctttcctgggtaacacttgagacatcagagtacctcccctgggtaactaacattagacaagcacaaataccaccattaccaccacagctgttgctctttgcaaatgctaccccctggctggagaccaactaacacagcccacaacagcatctgcaggcagaataacacagcacccaagaaggagaaaacttgtgcatgacctcagctaccaacattgcctgcatcaccctggccaacggagagatcctgagtctgttcacatgacccgttcattactactacagctggcatttgagaaagccaacacagtaagcctatttataaccaaggaatctcacagaatctatatcactcgcctgtcaccaccatcagagctggtgctaatacctgctgctgggagacttgaggacaggtcatgtgcctggatcccttgcagacagtccccactaccatcctgaagcgtggcagccccacagggcagctagacccagaagagcagcattcacagtagtctggccttcagggactcctgcggctaggggaagagggagtgcacaacattaaggaggcatcctgtgggacagaagaatccagatggcaggtcttgagtaccaaactttccacatgtgggaagtttctttcagcagaggcactggtgcagtgctgagctcagcaagaaaagtctgcagctctcccccaacagtcaggcagcccgggtgctcatgaaagatctttgagatggaaacttctcccccttgctcgccactgcagacacagttgaggcttctcccatgggagcttagcatgagtgtacctgtagacaccctttctggaacatttcagggtgactgcttttccacagaaggagcatcctccaagttcaggcttgcatgaaaggtagaatcatagttcctctctacttggaatatcaaaattcctgcagatgaaaagaggtgcctgtctaatctgaataggtgaaacactgggtgaagagtgtgtctgggagttgagtagctttccttctggtctggcagaggagctgaggtagctctctcccttcctcctgaaaagaccacagtgcatttcactgagaattctcccagctacctttgtcaaggccgtgatctctccccaacattgggtattgcatctacccacatactttagctacatctggtttttacccccagacacctcccctactggactgaagcctgaacatttcaacccagtaaataaaatgttggggaaaaaaataactaaataaaaaagtgcacaccaatggggaacaagataagcttccagaaacttctgccattctagccctgcaggagacagtgaacctgctcacacaccaagcacattgccaccacaaccagcatctgagaaagccatcatacaaagactttctataaccaagaaactcatacagagtcttcacctctgaaagcgcccagagccaaattaggttacaaaaactgtaatcattaaagtcacaactttaagagacaaaaaaaaaaagaaatttttaaaaatcacagatgaattaaaaataaatccaaaaataattaaaagaaatagtttacccaaatgagaaggaaccagaaaaataattttggcaatatgacaaaacaagatactgtagtacccccaaaagatcatactaggtcttccacaatggatccaaaccaagatgaaatctttaaaacaccagataaagaattcaaagggttgattattaagttacttcaggagatacaagagaaaggagaaaactaacatgaaaaaaaatttaaaaataacaattcaggatatgaataaaaacttttctatagagatagatattttcaaaaaaaaaaaaaaaaaccagaacttctggaaatgaaagacacatttaaggaattatgaaatgcagcagaaacttttaacagtagactagaccaagtagaagaaagaatttcagagcttcaagacaaaattttgaattaattcaatcaaacaaaaataaaacaaaaataagtttaaaaaaatgaacaaagtctccaagaaatatgggattacataatcccatgaccaaacttaaaaatcactggtgtttctgaagaagaagaaaaaccaaaaagtctagaaaacctatctaagggaataattaaggaaaacttcactggccttgctagagatttaaacattcaagtacaagaagttcaaagaactcctgggagatccattgcaaaaaggacatcaccaaggcatttgtcatcaagctatttaaagtcaaagtgaagtaaagaatgataagaacgtgaaaaaaaaaagcatcaggtaacctatacaggaaaaccagaagggattcaggctttatctttagcctccttaaacagaataactatcatcagccaagaatcttgtaatccagcaaaactaagttgcttacatgaaggagaaataaagtctttttcagacaagcaaaggctgtgggaacttgccactaccacaccagccctataaaaaaaatgctaaaagggggcaaaatcttgaaaccaaaggtcaatatgcaccagaatggaaactcttgaaaggcttaaactcacaggtcctataaaataatagcacatggagaaaataaagcatctaggtagcaatcaacatgatgattggaacagtacctcacatctcaacagtaatgttaaatgtaagtggtctaaatgctctacttaaaatatacagaatgaaattaaggcagaaatcaagaagttctttgaaacaaatgaaaacaaagatacaacataccagaatctctgggacacggctaagtcagtgttaagagggaaatttatagcactaaatacccacatcaaaaagttggaaagatctctaattaacaacctaatgtcacaactaaaaaaacttagaggaccaagagcaaaccaaccccaaagcagaagacaagaaataaccaaaatcagagctgaactgaaggagattgggacacacacacaaaaaaaaaacattcaaaagatcaatgaaattaggagctggatttttgaaaaaaaaataagataagctgctaactagggtaataaagagtaaaagagaagattcaaataaatgcaattacaaacaacaaagggaggttaccactgaccccaaagaaatacaagtaaccagcagggactactataaacacctctatgcacagaaattacaaaacctagaagagatggataaatttctggacacagacaccctcccaagactgaaccaggaggaaattgattcactcaacagaccaataacaagctccaaaattgagtttgttaataatagcctactgatatggtttggctgtgtccccacccagatctcatcttgaattgtatctcccataattcccattgttgtgggagggacctggtgggagataattgaatcatggcagcagtatcccccatactgctctcgtggggagcagtctcatgagatctgatggttttataaggagaaaccccttttgcttggttctcattatttctttgcctgccaccatccatgtaagacgtgacttgctcctttttgccttccaccatgattgtgaagcttccccggccatgtggaactgtaagtccaattatctctgtcttttgtaaattgtccagtcttgggtatgtctttatcagcaatgtgaaaactgactaatacacctaccaaccagaaaagtccaggtccagaaggattcatggctgaattctaccagatatgcaaagaagaaatgtatcattccagctgaaactatcccaaagaattgaggaggagggatttctctccaactcattttttgaggtcagcatcatcctgatatcaaaacctggcagggacacaacaacaaaaaaagaaaactttgggacaatagccttgatggtcattgatgcaaaaatctcaaaaaaatacttgcaaatcaaatccagcaacacaacaaaaaaaaaagaaaactttgggacaatagccttgatggtcattgatgcaaaaatctcaaaaaaatacgtgcaaatcaaatccagcaacacatcaaaaagctattccaccacaatcaagtaggctttatccctgggatgcaaggtaggtccgacatatgcaaatcaataaatgtgattcatcataaacagaactaaagatagaaaccacatgatcatctcagttcaacatcctttcatgttaaaagctctcaacatactaggtaatgaaggaatatagctcaaaataataaaagtcatctatgacaaacccacagccaacatcatactgaatgggcaaaagctggaagcattccccttgaaaactggcacaagtatgctcacccaccactcctatttaacagagtattggaagccctggcaaagagcaatcaggcaaaagaaagaaatgaagagcattcaaacaagaagagagaaagtcaaacaattcctgtttgcagatgacatgattttatatctagaaaaccctatagttatagacaaaaagctcctgcagctgataaacaccttcagcaatgttttaggatacaagaatcaatgtacaaaaattactagcatttctatacaccaacaatagccaaaccaacagccaaatcaaaaacacaatcccattcacaattgccacaaaaagaataaaatacctagtaatacagcttaaaaggaaggtgaaagatctctacaatgaaattacaaaacactgcttaaagaaaacagagatgacacaaacaaatggaaaaatatccacgttcatggataggaagaatcaatatcattaaaattgccatattgcctgaagcaatttagagattcattactgtcaaactaccaatgacatgtttcacagaactagaaaaaaactatttaaaattgatatggaaccaaaaaagagcccaaataaccaaggcaattttaatcaaaaaagaacaaaactggaagcatcatgttacccaacttcaaactatactacagggctacagtaaccaaaatagcatgggactggtacaaaaacagacacatagaccaattgaacagaatagagagcccagaaataaggccacacacctacaaccatctgatctttggactccttattcaataaatggtgctggcataactggctagctaaatgcagaagattgaagctggatcccttctttacaccacatacgaaaatctactcaagatggaggaaagacttaaatgtaaaacccaaaactataaaaaccctggaagtcaagctgggcagtatcattctggacatagaaaccggcaaagatttcatgatggagacaccaaaagcaatcacaacaaaggcaaaaagtgataaatgggatataattaaacttaagagcttctgcacagcaaaagaaacaattaacagtgtaaacagacagcctacagaatgggagaaaatattttcaaactatgcatctgacaaaggactaatatccagcatctaagaagaacttaagcaaattacaaaagcaaacaaccccattaaaatgtggttaaaggatatgaatagacacttttcaaaagaagacatatatgtggccaaagagcatatgaaaaaaagttcaatatcagtggttattagagaaatgcaaatcaaaaccacaatgagaggctgggcctggtggctcatgcctgtagtctcaacagtttgggaggctgaggtgggcagatcacttgagcccaatagtttgagaccagcctaggaaacatgacaaaacctcttctctacaaaaactacaaaatttagctgggagcagtggtgcatgcctgtagtcctagctactcaggaggctgagatggaaggatcacttgagcccagtaggcagagattgcaataaaccaagattgtgccactgcaccccagcctgggcgtcagcaagaccctgtctcaaaaaaaccagccaaccaaccaaccaaacaaacaaacaaacaaaaaaatccacaaggagatattatctcataccagtcagaatggctattaataaaaagtaaaaaaaaaaataacagatgctgcaaggttgcagagaaaagggaatgcttatacactgttggtgggagtgtaaattaaactattgtggaaagcagtgtggcatctccttaaagagctgaaaacacatctaacatctgactcagcaatcccattactaggtatatatccaaaggaatagaaatcattctaccataaaaacacatgcacgtgtgtattcattgcagcacttacaatagcaaagacatggaatcaacctaaatgcccatcaatggcagattgaataaagaaaatatggtacatatacaccatggaataccacacagccataaaaaagaatgagatcatgtcctttgcaggaacatggatggagctggaggccatcatccttagcaaacgaatgcaggaacagaaaaccaaatactgcatgttctcatttacaagtgggagctaaatgatgagaacacgtggacacagaggaaaacagacactggggtctacttgagggtggtgggtgggaggagggagaggatcagaagaaataactatttagtaccaggcttagtacctgggtgatgaagtaatctgtacaacaaacccccatgacatgagtttacttatataacaaatcagcacatatacacctgagcttaaaataaaagttaaacaaaaaaattaaaaatcacaaaccaaatatcagctctcttcaagagactcatctaatgcaaggattcttacaaactcgaggtaaaggggtggaaaaagatattccatgccaatataagaaaaagcagcaggagtagttattctcatgttagatagaacagacactttaaagcaacaacagtaaaaaaaaaaaaaaaaaaaagtcattatataaagataaaagaatcaatccccagcaagaagatattacaatccttaatatacattacttactccttactatggagcttccagattcataaaaaattactaccagacctaagaaaagagaaagacatcatcacaataattgtgggggactcaacactccgctgacagcactagacagataatcaaggcagaaagtgagcaagaaaatgttgtacttaaactgcattctagaacaaatataactaacagaatttacaggacattttactcaagagcttcagaatatacattattttcctcagcacatggaacattctccaaaacagaccatatgatagtccacaaaacaagtctcaataaatttttaaaaattgaaattatatcaagtaccttcttagaccacagtggaataaaaccaataattaacaccaaaaggaacactcaaaactatacaaatgcttaaaaattaatctgctcctggatgatttgggggtaaaaaatgaaatcaagatgaaaatttaaaaattctttaaagtgaatgataatagttacacaagttatcaaaacctctgggatacaggaaaagcggtgctaagatgaaagtttatagcactaaatgcctacatcaaaaagtctgaaatgaaacaaattggcaacctaacatcacacctcaaggaaccagagaagcaagaacaaaccaaacccaaagctaccagaataaaagaaattataaagatcagagcagaactaaatgaaattagaacaaagaaaaataatacaatagatcaacaaaacaaaaagttggttctttgaaaaaataaaattggtagactattagctagattaaccaagaaaagaagaatcaaacaagctcaattagaaatgaaaatggatggccaggtgcggtggttcacgcctgtaatcccagcactttgggagtctgaggcgggtggatcacttgaggtcaagagtttgagaccagcctagccaacatgatgaaaccctgtctctactaaaaatacaaaaattagctgggggtggtggtgccgcctgtaatcccagctacttgggagactgaagcaggagaatcatctgaacctgggaggcagaggttgcatttctgtcaaaaaaaaaaaaaaaaagagagaaagagagaaagaaagaaagaaagagaaagagagaaagaaaaagagaaagaaaaaaagaaagaggaaggaaagaaggaaggaaggaaggaaaatggaggcattacagctgataccacaggaatacaaaagattatttaagactactatgaacacctctgtgcacataaactagaaaatctatagggaattaataaattcctggaaacataccacctccccagcttgaatcagaatgaaacagaaattctgaacagaccaacaacaagcagtgagattgaatcagtaatttaacaaagttgtcctcctaaaaaaagccaagggccatacaaattcacagccaaattctaccagacattcaaagaattggcgccaattttgctgaaactattctaaaagactgagaaagaaggaatccttcctaactcattctatgaagccagtatcaccttgataccaaagccaggaaagggcatacaaaacaaaacaaacaaaaaacaaaaaaacacaaaatgacagaccaatattcctgattaacatagatgcagaaatcttcaacaaaatactagcaaactaaacccaacagcacatcaaaaaggtaattaactatgattaagtgggtattatcccagggatgcagggatggttcaacatatgcaagtcaataaatgtgattcaccatgtaaacagaattaaaaacaaaaaccatatgattatctcaatagatgcaaaaagcattggataaaatacagcatccttttataaaaccctcaacaaattagatatagaaggaacatatctcaaaataataaaagctacatatggaaaaccacagccaacatcatacagaataggaagaagtcaaaagcattccccctaagaactggaataagacaaggatgcccacttttaccacttctattcaatatagtactggaagtcatagccaggccaatcagtcaagagaaagaaaggaattccaaatcagaaaagaggaagtcaaactatttatatttgccgacgatatgattgtgtaactagaaaaacctaaagatccctccaaaagactcctagatttgagaaatgaattcagtaaagtctcaggttacaaaatccatgtacacaaatcagtagctctgctgcatgccaacaacgaccaagctgagaatcaaataaaaaactcagtcccttatataatagctgaaaaaaaaaaaaactaggaatacatttaaccggggaggtgaaagagctctacaaggaggactacaaaacaccactgaaaggaatcacagatgatacaaacaaatggaaatacgtgtcatgctcatggattggaagaatcagtatcacacaaatgatcatattgctcaaaggaagcttcatattcactgaaattcctatcaaaataccaaattatttttcacaaaattagaaaaaaaatccaaaaattcatatggaaccaaaaaagagcccaaatagccaaagcaattctaagcaaaatgaataaagctggaggcatcgcattacctgacttcaaattgtactacaatgctgtagtaaccagaacaagatgttactggtataaaagtagatacgtagaccaatagaacacaacagaggatccagaaatacagccaaatacttacaaccaaatgatctttgacaaagtatagaaaggcatggaatattatttttttcaaggtagtaatgtcttttttttactttttttaaattatactttaagttctagggtacatgtgcacaacatgcaggtttgttccataggtatacatgtgcccaagttggtttgctgcacccatcaactcgtcatttacattaggtgtttctcctaatgctatccttcccccagcctcccaccccccgacaggccccggtgtgtgatattccccgccccatgtccatatgttctcattgttcaactcccacccctgagtgagaacatgtggtgtttggtgttctgcccttgtgatagtttgcttagaatgatggttttcaacttcatccatgttcctgcaaaggacatgaactcatcctttttatggctgcagagtattccatggtgtatatgaaggcacagaatattataacactgggtttgcggtgtgtaaattgctcatacattaagtagaaagacccaggtgaaccaataaaaaataacaacaacttttcaagtcatagtataataacatataaatagaaacaacaaaaagttaaaaagcagggagacaaagttaaagtgtagagtttttattagttttctctttgctagcttgtttatgcaatcagtgttaagttgtcaacagtttaaaatcatggattataagatattatttgcaagtctcatggtaacctcaaataaaaaatagaaaaaaaatgggattacatcaagctaaaaagattctgcagaagaaaggaaataatcaactaagtgcagagataacccacagaatgggagaaaatatttgcaaactacccctctgacaaggaattaataaccagaatatataaggagctcaaacaactctgtaggaaaaaagctaatagtctgattttaaaatgggcaaaaaatctgagtagacatttctcaacataagacatattttgactggaaaacaggtttatgtgctcaacaagcacataaaggtgctcgacatccttgatcttcagagaaatgcaaatcgaaactacagtgaggtattatctcacgccagttgaaatggcttatatccaaaagacagggaataacaaatgctgacaaggatgtgtagaaaagcactgttggtgggaatgtaaattagtacagccactatggagaacagtttagaagttcctcaaaatactaaaaatgcagctaccatatgatacagcaatcccactaccaagtgtatagccagaagaaaggaaatttgtatatggaagagatatctgcactcccatatattgcagcactattcacagtagccaagatttggaagcaatttaagtgtctatcagtggatgaatggataaagaaaatatggtagatatacacaatggagtagtattcaaccacaccaaagagagagatcctgttgtttacaacatgaatggaactgggggtaattatgttaagtgaaataagccagacacagaaagacaaacaacatgttctcacttattcgtgggaactaaaatttaaaacagttgaactcgtggacatagagagatactagaggctgagaagggtagtgaagggaaagtgggatagttaatgagtataaaaaatagaaaaaatgaataagactagtatttcctagcacaacatgactacagtcaacaataatttattgtatattttagaataacttaaataatataattggactttttgtaacacaaaggaagggtaattgcttgatgtgatagatatcacatttaccctgattattatacattgtatgcctgtatcaatatatgtcatgtaccccataaatatatacacatactatttacccacaacaattaaaaattaaagaaagaaaaatattcacagacaagtgaacctgcacagttcaaacccttgctgttcaaggatcaactgcataaacatttctcattcctaataaacaggagttttaatttaaaaacctaaaagtaaattaatagaattcaagccttgaatgtatgtaattgaggggctggcacataacattaggaattatactagaatactatttttttattattattatactttaagttttagggtacatgtgcacaatgtgcaggttagttacatatgtatacatgtgccatgctggtgcgctgcacccattaactcgtcatttagcattaggtatatctcccacagctatccttcccccctccccccaccccacaacggtccccagagtgtgatgttccccttcctgtgtccatgtgttctcattgttcaattccacctatgagtgagaatatgcagtgtttggttttttgttcttgtgatagtttactgagaatgatgctttccaatttcatccatgtccctacaaaggacatgaactcatcattttttatgactgcatagtataccatgttgtatatgtgccacattttcttaatccagtctatcattgttggacatttgggttggttccaagtctttgctattgtgaatagtgccacaataaacatacatgtgcatgtgtctttatagcagcatgatttatagtcctttgggtacatacccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgctgtttcctgactttttaatgattgtcattctaactgttgtgaaatggtatctcattgtggttttgatttccatttctctgatagccagtgatggtgagcattttttcctgtgttttttggctgcataaatgtcttcttttgagaagtgtctgttcatgtccttcacccactttttgatggggttgtttttttcttgtaaatttgtttgagttcattgtagattctggatattagccctttgtcagatgggtaggttgcgaaaattttctcccattttgtaggttggctgttcactctgatggtagtttcttttgctgtgcagaagctctttacagggatgccctctctcaccactcctattcaacatagtgttggaagttatggccagggcaattaggcaggagaaggaaataaaggttattcatttcggaaaagaggaagtcaaattatccctgtttgcagatgacatgactgtatatctagaaaaccccattgtctcagcccaaaatctccttaagctgataagcaacttcagcaaagtctcaggatacaaaatcaatgtacaaaaatcacaagcattcttatacaccaataacagacaaacagacagccaaatcatgagtgaacacccattcacaattgcttcaaagagaataaaatacctaggaatccaacttacaagggacgtgaaggacctcttcaaggagaactacaaatcactgctcaaggaaataaaagaggacataaacaaatggaagaacattccatgctcatgggtaggaagaatcaatatcgtgaaaatggccgtactgcccaaggtaatttatagattcaatgccatccccatcaggctaccaatgactttcttcacaaaattggaaaaaactactttaaagttcatatggaaccaaaaaagagcctgcatcaccaagtcaatcctaagccaaaagaacaaagctggaggcatcaagctaccggacttctaactatactacaaagctacagtaaccaaaacagcatggtactggtaccaaaacagagatatagatcaatggaacacaacagagccctcagaaataacgccacatatctacaactatctgatctttgacaaacctgagaaaaacaagcaatggggaaaggattccgtatttaataaatggtgctgggaaaactggctagccatatgtagaaagctgaaactggatcccttccttacaccttatacaaaaattaattcaagatggattaaagacttaaacattagacctaaaaccatgaaaaccctaaaagaaaacctaggcattaccattcaggacataggcatgggcaaggacttcgtgtgtaaaacaccaaaagcaatggcaacaaaagccaaaattgacaaatgggatctaattaaattagaatactattaagtgcaacattggtccccctaagcccttacaaaaaaaatctgctacaggattatcttcagccaacaaaaagatacatggagaggccatggttaaaggacaggtgctatttaattcatttaattgtaaaactaaagttaagcaatggtgataaatatgattgtaaaatagaatgtgaagttaaaatccacgacaatacaaatacaatagtgtaattttaaaaattgaaatataggaggcaaagaggaggttaaagtacccaataaaagagttaataattctataactatatttggtggttaattggtggtgaatttagagcaaagagaagtagaaggaagaggaattatactaatttcacctttcataaagggaaatcaattgatactatacatagaggataacttaaaaagtaatgaattaagaatacatcttcaaggtgaccattagaaaaatattaaaataccccaaaactttaaaattacaaagaagagtatgtatataagattataagatctttaattatatatataagattatatatatatacacatttttgtatatataaaaaaagtaagtacagaaagcatattttttaattaaactttaagttctagggtacatgtgcacaacatgcaggtttgatacataggtatacatgtgccatgttggtttgctgcacccatcgactcattatttacattaggtatttctcctaatgctatccctcccgcagccccccactccctgacaggaccccgtgtgtgatgttcctcaccctgtatccaagtgatctcattgttcagttcccacctatgagtgagaacatgcagtgtttggttttttgtccttgtgatagtttgctgagaatgatggtttccagcttcatccatgtccctgcaaaggacatgaactcatcctttttatgactgcatagtattccatgctgtatatgtgccacattttcttaattcagcctatcatcgatggacatttggattgtttccaagtatttgctattgtgaatagtgccacaataaacatacgtgtgcatatgtcttcatagtagcatgatttataatcctttgggtatatacccagtaatgggattgctgggtcaaatggtatttctagttctagattcttgagggatcaccacactgtcttccacaatggttgaactaatttacactcccacaaacagtgtaaaagcgtgcctatttctccacatcctctccagcatctgttgtttcctgactttttaatgactgccattctaactggcatgagatggtatctcattgtggtattgatttgcatttctctcatgacaagtgataataagcattttctcatgtgtctgttggctgcatagaagtcttctttttttatatagtaatttttaaattcagacaatatatctaaaggaaatgtcacctgcctccttccctaatcccaaactgctcatcttcagtaccactgttaatgatttagtctttgttcttctagttttgtttctttttttctttttattttattattattatactttaagttttagggtacgtgtgcacaacgtgcgggtttgttgcatatgtgtacatgtgaaacgttggtgtgctgcacccactaactcatcatttagcattaggtatatctcctaatgctatccctctcccctcccccgaccccacaacaggccccagggtgtgatgtttcccttcctgtgtccatgtgttctcattgttcaattcccacctatgagtgagaacatgagtgtttgatttttgtccttgcaatagtttgctgagaatgatggtttccagcttcatccatgtccctacaaaggacatgaactcatcatttttatggttgcatagtattccatggtgtatatgtgccacattttcttaatccactctatcactgatgggcattggggttggttccaagtctttgctattatgaatagtgccgcaataaacatacatgtgcatgtgtctttatagcagcattatttataatcctttgggtatatacccagtaatgggatggctgggtcaaatggtatttctagtactagatccctgaggaatcgccacactgtcttccacaatggttgaactagtttacagtcccaccaacagtgtaaaagtgttcctacttctccacatcctctccagcatctgttgtttcctgactttttaatgattgccattctaactggtgtgagatggtatctcattgtggttttgatttgcattgctctgatggccagtggtgatgagcatttttgtatgtgtcttttgtctgcataaatgtcttcttttgagaagtgtctgttcatatcctttgcccactttttgatggagttgtttgttgttttcttgtaaatttgtttgagttcattgtagattctggatattagccctttgtcagatgagtaggttgcaaaaattttctcccattctgtacattgcctgttcactctgatggcggtttcttttgctgtgcagaaggtctttagtttaattagatcccatttgtcaattttggcttctgttgccattgcttttggtgttttagacatgaagtccttgcccatgcctatgtcctgaatggtattgcctaggttttcttttagggtttttatggttttaggtctaacatttaagtctttaatccatcttgaattaatgtttgtataaggtgtaaggaagggatctagtttcagctttctacatatggctagccagttttcccagcaccatttattaaatagggaatcgtttccccatttcttgtttttgtcaggtttgtcaaagatcagatagttgtagatatgtggcattatttctgagggctctattctgttccattgatctatatctctgttttggtaccagtaccatgctgttttggttactgtagccttgtagtgtagtttgaagtcaggtagcttgatgcctccagctttgttctcttggcttaggattgacttggattgacttgtggcctcttttttcattccatatgaactttaaagtagttttttccaattctgtgaagaaagtcatttggtaacttgatggggatggcattgaatctataaattaccttgggcagtatggccattttcacgatattgattcttcctacccatgagcatggaatgttcttccatttctttgtatcctcttttattttcttgagcagtcatttgtagttcttcttgaagagatccttacatcccttgtaagttggattcctaggtattttattctctttgaagcaattgtgaatgggagttcactcatgatttggctctctttttgtctgttattggtgtataagaatgcttgtgatttttgcacattgattttgtatcctgagactttgctgaagttgcttatcagcttaaggagattttgggttgagacgatggggttttctagatatacagtcatgtcatctgcaaacagggacaatttgacttcctcttttccgaattgaataccctttatttccttctcctgcctaattgccctggccagaacttccaacactatgttgaataggagtggtgagagagggcatccctgtcttgtaccagttttcacagggaatgcttccagtttttgcccattcagtatgatattggctgtgggtttgtcatagatagctcttattattttgagatatgtcccatcagtacctaattattgagagtttttaacatggtgtgttgttgaattttgtcaaaggccttttctgcatctattgagataatcatgtggtttttgtcgttggttctgtttatatgctgggttatgtttattgacttgcatatgttgaaccagccttgcgtcccagggatgaagtccacttgaccatggtggataagggttttgatgtgctgctggattcggtttgccagtattttattgaggatttttgtgtcgatgttcatcagggatattggtctaaaattctctttttttgttgtgtctctgtcaggctttggtatcaggatgatgctggcctcataaaatgagttagggaggatcccctctttttctatttattggaatagtttcagaaggaatggtaacagctcctccttgtacttctggtagaattcagctgtgaatccatctggtcctagactttttttggttggtaagctattaattattacctcaatttcaaagcctgttattggtctattcagagattcaacttcttcctggtttagtcttgggagggtgtatgtgtcgaggaatttatccatttcttctagattttgtagtttatttgcttagaggtgtttatggtattctctgatggtagtttgtacttctgtgggatcggcggtgatatcccctttatcattatttattgcatctatttgattcttctctcttttcttctttattattcttactagcagtctatcaattttgttgaccttttcaaaaaaccaactcctggattcattgattttttgaagggttttttgtgtgtctatctccttcagttctgctctgatgttagttatttcttccattctgttagcttttgaatgtgtttgctcttgcttctctagttcttttaattgtgatgttagggtgtcagttttagatatttcctgctttctcttgtgggcatttagtgctatacatttccctctacacactgctttaaatgtgtcccggagattctggtacgttgtgtctttgttctcattggtttcaaagaacatctttatttctgccttcattttgttatgtacccagtagtcattcaggagcaggttgttcagtttccatgaagttgagcggttttgagtgagtttcttaatcctgcgttctagtttgattgcactgtggtctgagagacagtttgttacaatttctgttcttttacatttgctgaggagtgctttacttccaactatgtggtcaattttggaataggtgtggtgtggtgctgagaagaatgtatattctgttgatttggggtggagagttctgtagatgtctattaggtctgcttggtgtagagctgagttgaattcctggatatccttgttaactttctgtctcgttgatcttctaatgttgacagtggggtgttaaagtctctcattattattgtgtgggagtctaagtctctttgtaggtctctaaggacttgctttatgaatctgggtacccctgtattgggggcatatatatttaggatagttagctcttcttgttgaattgatccctttaccattatgtaatggtcttctttgtctctttagatctttcttggtttaaagtctgttttatcagagactaggattgcaacccctgccttttttttgttttccatttgcttggtagatcttcctccatccgtttattttgagcctatgtctgtctctgcatgtgagatgggtttcctgaatacagcacactgatgggtcttgactctttatccaatttgccagtctgtgtcttttatttggagcatttagcccatttacatttaaggttaatattgttatgtgtgaatttgatcctgtcattgtgatgttagctggttattttgcttgttagttgatgcagtttctccctagcctcaatggtctttacaatttggcatgtttttgcagtggctggtaccagttattcctttccatgttcagtgcttccttcaggagctcttttagggcaggcctggtggtgacaaaatgtctcagcatttacttgtctgtaaaggatcttatttctccttcacttatgaagcttagtttggctggatatgaagttctgggttgaaaattctttcctttaagaatgttgaatattggcctccactctcttctggcttgtagagtttgtgctgagagatcagctgttagtatgatgggcttccctttgtgggtaacccgacctttgtctctggctgcccttaacattttttccttcatttcaactttggtgaatctgacaattatgtgtcttggagttgctcttctcgaggagtatctttgtggtgttctctgtatttcttgaatttgaatattggcctgtcttgctagattggggaagttctcctggataatattctgcagagtgttttccaacttggttccattctccccgtcactttcaggtacaccaatctgatgtagatttggtattttcacatagtcccatatttcttggaggctttgttcgtttctttttattctttttttcgttaaacttctcttctcacttcatttcattcatttgatcttcaatcactgataccctttcttccagttgatcgaatcagctactgaggcttgtgcattcatcacgttgttctcatgccatggttttcagctccatcaggtcctttaaggacttctctccattggttattctagtagccattcatctaatcttttttcaaggtttttaacttctttgccatgggtttgaacttcctcctttaggtctgagtagtttgatcatctgaagccttcttctctcaactcgtcaaaatcattctctgtccagctttgttccattgctggtgaggagctacgttcctttggaggaggagaggcgctctggtttttagaatttccagtttttctgctctgttttttccccatctttgtggttttatcaacctttggtctttgatgatggtgacgtacagatggagttttggtgtggatgtcctttctgtttgttagttttccttctaacagtcaggaccctcagctgcaggtctgttggagtttgcctgagttccactccagaccctgtttgcctgggtatcagcaacagaggctgcagaacagcggatattggtgaacagcaaatgtggctgcctgattgttcctctggaagttttgtctcagaggagtacccggccgtgtcaggtgtcagtctgcccctaatggggggtgcctcccagttaggctactcaggggttagggacccacttgaggaggcagtctgtgtgttctcaaatctcaagctgcgtgctgggagaacgactactctccagaagtcttcttttgagaagtgtctgttcatatcctttgcccactttttgatggggttgtttgttttgttcttgtaaatttgtttaagttctttgtagattctggatataagccctttgtcagataggtagattgcaaaaattttctcccatttatatggtgcctgttcactctgatggtagtttctcttgctgtgcagaagctctttagtttaattagatcccatttgtctattttggcttttgttgccattgcttttggtgttttagacatgaagtccttgcccatgtcctgaatggtattgcctaggttttcttctagggcttttatggttttaggtctaacatttaagtctttaatctatcttgaatgaatttttgtataaggtgtaagtaagggatccagtttcagctttttacagatggctagccagttttcccagcaccatttattaaatagggaatcctttccccatttcttatttttgtcaggtttgtcaaagatcagatgattgtagatgtgtagtgttatttctgagggctctattctgttccattggtctatatctctgttttggtaccagtaccatgctgttttgtttactgtagccttgtagtatagtttgaagtcaggtagcatgatgcctccagctttgttcttctggcttaggattgacttggcaatgcaggatcttttttcgttccgtatgaactttaaagtatttttttccaattctgtgaagaaagtcattggtagcttgatggggatggcattgaatctataaattaccttgggcagtatggccattttcacgatattgattcttcctatccatgagtatggaatgttcttccatttgattgtgtcttctttatttcattgagcagtggtttgtagttctccttgaagaggtccttcacatcccttgtaagctggattcctaggtattttattctccttgtagcaattgcaaatgggaattcactcatgatttggctctctgtttgtctgttattgctgtataggaatgattgtgagttttgtacattgattttgtatccagagactttgctgaagttgcttatcagataaggagattttgggctgagacaatggggttttctaaatatacaatcatgtcatctgcaaacagggacaatttgactcttcttttcctaattgaataccctttatttctttctcttgcctgattgccctggccagaacttccaacattatgttaaataggagtggtgagagagggtatccttgtcttgtgctggttttcaaagggaatgcttccaatttttgctcattgagtatgatattgggtgtgggtttgtcataagtagctcttattattttgagatgcgttccatcaatatctagtttattgagagttcttagcatgaagggctgttgagttttgtcaaaggccttttctgcatctattgagataatcatgtggtttttgtcattcgttctgtttatgtgatggattatgtttatttatttgcgtatgttgaaccagcattgcatcccagggaggaagccagcctgatcgtgttggataagctttttgatgtggtgctggattcggtttgccagtattttattgaggatttttgcatccatgttcgtcagggatattggtctaaaattctctttttttgttgtgtctctgccaggctttggtatcagcatgatgttggcctcataaaatgagtttgggaggatcccctctttttctattgattggaatagtttcagagggaatggtaacagctcctgtttgtacctctggtagaatttgtctgtgaatccgtctggtcctggactttttttcgttggtaggctattaattatcacatcagtttcagagcctgttattggtctattcagagattcaactttttcctggtttagtctttggagggtgtgtgtgtccaggattttatccatttcttctagattttctagtttatttgcatagaggtgtttatagtattctccaaaggtagtttgtgtttctatgggatcggtggtgatatcccttttatcattttttgttgcatctatttgattcttctctcttttcttctgtattagtcttggtagtggtctatcaattttgttgatcttttcaaaaaaccagctcctggattcattaattttttgaagggttttttgtgtctttatctctttcagatctgctctgatcttagttatttcctgccttctgctagcttttgaatttgtttcctcttgcttctctagctcttttaattgtgatgttagggtgtcaattttagatctttcctgctttctcttgtggacatttagtgctatacatttccctctacacactgctttaaatgtgtcccagagattctggtacattgttctttgttctcattggtttcaaagaacatctttatttctgccttcaattcgttatttacccagtagtcattcagtggcaagttgttcagtttccaaatagttgagcagttttgagtgagtttcttaatcctgagttctaatttgattgcactgtggtctgagagacagtttgttgtgatttctgttcttttactttactgaggagtgctttacttccaattatgtggtcaattttagaataagtgcaatgtggtgctgagaaaaatgtatattctgttgatttggggtggagagttctgtaggtgtctattaggtctgtttgttgcagagctgagttcaagtcctggatatccttgttaaccttctgtctcattgatctgcctaatattgacagtggggtgttaaagtctcccattattattgtgtgggagcctaagtctctttgtatatctctaaggacttgcttcatgaatctgggtgctcttgtagtgggtgcatatatatttaggatagttacatcttcttgttgaattgaaccctttgccattatgtaatggtcttctttgtctcttttgatctttgttggtttaaagtctcttttgtcagaggctagaattgcaaccctgctttttttttttttttttttttgctctccatgtgctttgtagatcttcctctatccctttatttttagcttatgtgtgtctttgcatgtgagatggggctcttgaatacagcacactgatgggtcttgactctttatccaatttgccagtctgtgtcttaattggcacatttagcccatttacatttaaggttaatattgttatgtgtgaatttgatcctgtcattatgatgttagctggttattttgcccgttaactgatgcagtttcttcctagcatctatgatctttacaatttggcatgtttttgcagtggctggtaccaattgtttctttccatgtttagtacttccttcaggagctcttgtaaggcaggcttggtggtgacaaaatctctcagcatttgcttgtctgtaaaggattttatttctccttcagttatgaagcttagtttggctggatatgaaattctgggttgaaaattctttaagaatgttgaatattggctcccactctcttctggcttgtagggtttctgccaagagatccgctgttagtctgatgggctttcttttgtgggtaactcgacctttctctctggctgcccttaacattttttccttcatttcaactttggtgaatctgacaattatgttccttggggttgctcttctcaaggagtatctttgtagtgttctctatatttcctgaatttgaatgttggcctgccttgctaagttggggaagttctcctggataatatcctgcagagtgttttccaacttggttccattctccctatgactttcaggtacaccaatcaaactagatttagtcttttcatatagtcccatatttcttggaggctttgttcatttctttttactcgtttttctctaccttgctttctcactttatttcattaatttgatattccatcactgataccctttcttccacttgatcgaatcagctattgaatcttgtgcatgcatcacgaatttctcgtgccatggttttcagctccatgaggtcatttaaggtcttctctattctgtttattctatttagcatttcttctaaccttttttcaaggtttttagcttccttgtgatgggttctaacctgctcctttagctcggagaagtttgttattattgaccttctgaagcctacttctgtcaactcgttaaagtcattctccatccagctttgttctgttactggcgaggagctgcaatccttgggaggagaagaggcactctgatttttcgaattttcagcttttctgctctggtttctcttcatctatgtggtcttatctacctttggtctttgatgttggtgacctacagatggggttttggtgtagatgttcttattgttgatgttgatgctattcctttctgtttgttagttttccttctaacagtcaggttcctcagctggtggtctgttggagtttgctggaggcccactcgagaccctgtttgcctgggtatcaccagtggaggctgcagaacagcaaatattgctgcctaatccttcctctggaagcttcgccccacaggggcacccacttatctgaggtatctgtcagcctctactgggaggtgtctgccagttaggctgaacaggtgtcagcgacacacttaggaggcagcctgtctgttctcagagttcaaacgccgtgctgggagaaacactgctctcttcagagctatcagacagggacatttaagtctgcagaagttgtctgctgccttttgttcagctaagccctgcccacagaggagaagtctaaaggcagtaggccttgctaagctgtggtgggctccctcattttgagcttcccggccactctgtttacctactgaagcctcagcaatggcggatgcccctccccaagccaggctgccacctcacagctcaatctcagattgctgtgctagcagtgagcaaggctctgtgggcatgggacctgctgaaccaggcacaggagagagtctccttgtctgcccattgctaagactttgggaaaagtacagtatttgggtgggagtatcccatttttccaggtacagtctgtcacagcttccctttgctaggaaagggaaatccccaaccccttgcacttcccgggtgaggcaatgccctgccctgcttcagctcaccctccatgggctgcacccactgtccaaccactcccagtgagatgaaccaagtacctcaataggaaatgcagaaatcacccatcttctgtatcaatcacgctggaagctgcagaccagagctgttcctatttggccatcttggaacctggaccagcatatttttaaatgaaaagaagatataacctactataaaaagtggtataactggccagagcccattcaagggactggtcagtcttcaaattctccagtctgagcctttcaggagtgcctcaatcccagctttctacctttgaaaacagcaagaattttgtctctgcaacagtttttcctagagccaatcacgtgtcatgcctggaacagggatcatacccaaattgcccttggcctgaataatcacaaaatccacatctgtaagaagaatgggagccaatagcaaaacctcataaactccagaagcacaatcacaggtactgactgggctcccaagcatgaccacattatcatttgcatgagtcagaaagatggtgtctggaagctaaccctggtgatcctgagaattgatcatgcaactacttttgtgaagtggtccctcctagagaacaaaattgttgtaggtagtggagcatcgctttttatgtgtgtgtgaaaatgaatagtggataagcaagttaatttaaaggccaattaatttcattgtcctttggattggcattccaacaatgttttgctagtagcaggttcatgtgacttcaaatgaagagtgtttctgcatacattaatgtttgaaaacccaaccagtatgccatgggacagcaagatgccttttgattagctgatgtcatagcttggtgccactggagactgggtcccaggttcaatttgtctatgggagctctctggcctggatgagctatgatagcaacatgttctttactgatgcttcagagtgcagatttcaactctgaaagaagttgctgcctgtcatgaatatatcatttgtcttggagaataacattgttgtagccactggccaagactgctgctgaaggctctgtaactatgatggtgatggatacttgatcttagtctccaaactagatattccaaaatagagcatgcagcataaaatgtcagccatggaacacttccacacgcatacaaaagagccacaaccacagacagcaatatagctacagagaagctgcttcataacatcatcactcaaatacctatttatgaagtggaaaagcaatattttaaaatctttttttcttttttaaaaatcttttattttaaaaaaatattgtgggtgcattgtggttgtatatatttatggggcacatgagatgttttgattacatgcaatgtgaaataaccatataatggacaatgggatatgcatcccctcaagcatttatcctttgagttacaaacagtccaattacattctttaagttgttttaaaagatacaattattattgactgtagtcaccctattgttctgtcaaatagtaggtctgattctttctttctaattttttctacccattaaccatccgcaacacctccctaaccccccactacccttctcaccctctggtaattttcgtattagtccattctcacactgctataaagaactacctgagactgggtaatttatagataaaataaatttaattgactcacagttccacatggctggggaggcctcagaaaacttatactcatggtggacagtgaaggggaagcgaggcatgtcttctcatggccagagaaggaggaagagagagcaaagggggcagtgctgcatgtttttaaacaaccagatcttgtgagaactctatcatgaggcagcactagggggattgtgccaaaccattagaaaccaccaccatgattcagtcacctcccaccaggccccacctcctgggagattacacttcaacatgagatttgggtggtgacacagagccaaaccatataagcattctactctctctgtccatgagtttaattgattttatttttagatcgcacaaataagtgagaatatttaatgtttgtctttttgtgcctggcttatttcacttaataatctccagttccatctatcttgttacaaatgacaggcttttattctttgatatgattgaatagtactccattgcatatatgtagcatgttttgtttatttattcatgtatggatggatgcttaggttttttccaaatataggatagtagatgtcttttcaatatacagattttttttcttttgaatatgtacccaatagtaggattgctggatcatatagtaagtagctcagtttttagtttggaggaacctccaaactgtttgcagttttgctatttcatattcccaccaacagtgcatgaaacttccctcttctccatatccttgccagcatttgttattgcctgtcttttggatataagccattttaacttaagcgagatgatatctcattagttttgatttgcatttctctgatgatcattgatgttgagcaccttttcataagcctgttttccatttgtacgtgatgttttagaaaagtctattcaaatattttgcccatcttttgatcagattattagatttttttcatatagagttgttttgagctttttatatattttggttagtaattccttatcagaggggtagtttgaaaatattttctcccattctgtggtttgtttcttcactttgttgattgtatcctttgctgtgctgagttttttaacttgatgtgatctcatttgttcatgtttgctttgggggtgcttgtggggtgttgcataagaagcctttgcccagaccaatgtcctagagatataccccaatcttgtagtagtttcatagtttgaggtcttatatttaagtctttaatccgttttgatttgattttcgtatatggtgagatgtagaggtctattttcattgttttgcacagggatatccagtttccccagtgccatttattgaagatgctgtcttttctgcagcatatgttcttggcacctttgtcaaaaatgagctcaccgtaggtgtgtggatttgtttctggattctctattctgtcccattggtcaatatgtctgtttttatgccagtaccatgctattttggtaactatacctctgtagtataatttgtacctctgtagtataatttgaagtctggtaatgtgattcctccagtttggttctttttgcttaggatatctttgactattctgagtcttttgtggttatacatatataatataatatatataatatatatattattactatataatataatatatatattattactatataatataatatatagtaataatatatataatatatataggtgttcccatattgggtacatatgtattttaaaattgttatatcctcttgctgaattgaccccttcattattttatagtgatcttcttttctcttcttatagtttttatcttgaaatctattttttctgatataaatatagtgactcctcctttttttggtttcaattggcatagaatatctttttctatgcttttatttttagtcaacatgtgtctttataggtgaagtgttttcttgtaggcagcagatcaatggatctttttttaatccattcagtcattctgtgtcttttgattgaagagtttaatccatttactttcaaagtaattcttggtaagtaaggacttactcctggcattttgttatttgttttctggttgttttgtgtcttctcttccttctttcattcctgtcttcctcaagtgaacatgatatttttgggtgatatgatttcgtttcctgctttttattttttgtgtattcattgtatgctttttggtttgagattaccatgaggcatgcgaatactatcttataacccgctatttaacctgataacaacactatttgcataaaccaacagtgaaaaataaaactaataaaaactcaccttaagtttgtcctcctgctttttaactttttgttgtttctatttatgtcttattgtactatgtcttgaaaagttgtagttattattttttattgtttcatcatttagtctttctacttaggataagagtagtttacacaccacagttacagtgttataatattttatgcttttctgtgtatttactattaccagtaagttttgtaccttcaggtggttatatattgctcattaatgtccttttctttctgattgaaacacttcctttagcatttcttgtaggatggatctggtattgatgaactccctcagcttttgtttgtctaggaaagtctttattagttccgcatgtttcaaggatattttcaccagatatactattctagggtaaaaggtttttccttcagcactttaaatatgtcatactactttctcctatcctgtaaagtttccactgaaaagtctgctgcccagcatttgaagttccattgtatgttatttgtttcttttctcttgctacttttagagtcctttctttatccttgacttttgggagtttgattattaaatgccttgaggcagtattcttggagttaaatcttattggtgttctataatcttctttacttgaatattaatatctttctctaggtttgggaagctctctgttattattcctttgaataaaacttctactcctatctccttccctaccccccctttaaggacatttcttaggtttgcccttttgaggctattttccagatattgtagcatgcttcattcttttttattctcttttcttttgtctcttctgattatgtattttaaatagcctgtcttcaggctcactaattctttcttctgcttgatcaattctatgtaaacactcttatgcattcttcagtatgccagttgcatttttcagctccagattttctgcttgattcttttgattatttcaatctcttgttaaatttatctgatagaattctgaattccttccctatgttatctcgaatttttttttttagtttcctcaacacagctattttgagttctctatatgaaaggtcacatatctctctttctccaggattggtctctggtgccttatttaattcatttggtgaagtcatgttttcctggatagtgttgatgctagtagatgttctttggtgtgtgggcattgaagagttaggtatttatcttagtcttcatggttgggtcttatttgtatccatacttcttgaaaggctttccagatatttgaaaggacttgggtattgtgatctaagctgtatctgctttgggggcaccccaagcccagtagtgctatagttcttgcagactcatagaagtactgctttaatagtcttggacaaatctgggagaattatctgggttacatgacagagactcttattctttacttactttctcccaaacatacagagtctctctctctctctattctaagccaccttaagctgggggtgaagtgacacccttgtggccaccactactattattgtgatgagtcagacctaaatttagtgtagcactgggtctcacccaaggcctgctataattactccctggctaatgcctatgttcactcaaggtcctggggctctatgatctgcaagtagcaaagccagccaggcttgtgtccttctcttcaagggtggcaaggccccctaggtcctgggtaggtccagaagtgctgtctgggagccagggctggcactcaaaacacaagacagagtccttcctactcttccctccttttttaaaagcagaggagctccaccccatagccgccaccaccccaggccatgagaagtactgtcatgctaccactaacattccaataaggtccaaggtcacttaagtcagcttattgtgaatgctgcctggcctgggactcagccttcacggcagtgagttaccctctggcccaggacaggtctagaaatgccatctaagagtcatgtcctggaatcagggaccccaagagcctgcttggtgctctcctcctctgtggctgtgctgatatctaaggtacaagacaaactcccctttacatttccttctgcttttctcaagcagaaggagttttgccccatagccaccacagctgataatgtgctgagtctcacctgaaactggcaagtctcaggggttcatccaaggcccttaacattgcacctggatattgctgctggttattcagggcctaggggctctacagttaggaggtgatcaatgctgccagaactgggttctttccttcaaagcactgggttcctttctggcccaggtgatgttaagaaattttttctgagagatacggcctggaataggggcctcaagactctgaccagtgccctatcctgatgtgactgaattggtatcctagatgcaagacaaagtcctctccactcttttctctcctgtccttaatcagaaagaaggggtctctattggagccatgagctgtgcagcctggggttatgggagaggtgataccagcagtcccttggctgacccagctggtgtctcaatatgttgtttgcccccgactctgccccacccagtccactatctctgggcctagttcagcactaggactcacctaagagttgtagtccttatgccctacactgtctttcaaatttatttggagacacagagagctgtagcccttggtggtgatgtttccacatactcaagttcagactgctgggattggcagttcccctctggctagggatggttgaaattctctctctgtggatggacatcagctgagtttggtttagtttacctttctgctctaacaggacagcactgatttcagtgcctcacaattgctgttttctccctccctccctccctgagcacccagatactctacacaccacatcaccactaccaaaaggaggggtggcatcagtgattcagaactgttttttctatctccttagtgcctcttctaatgatatgaagttaaaaccaggtgttatgagtgctcacctgattcttggttcttatgaaggtgggtttttttttctgtgtagatatttgttagcttggtgtccttgctggggtcaaggggagatgattggtggagttttctattctgccatcttgctatgcctcctatctttgcccgttattgaattgagtagtttattttgttattgttgagttttaggagttctttatatattccagataataatagtcccttaccagatatatgattagcaaatattttcttccattctatgtgtggcctttttactctgttgatagtgtcatttgaggtacacagtttttaaatgtttatgaagtccagttgtctattttttcatttcttgtttgtgcctttgatatcatattttagaaattgttaccaaatgtaatgtcattaacttttgccctttgtagcttctaagagataatcaagttttacctgcaccatcaagttttacctgcacaatttagtgaagaaactattctttcttaactcaatgggctcagtatccttgtcaaaattgatttgaccatatgtgagagtgtttgtttatgggatctagattctactccaatagtctatatgtcactccttataacagtaccaaaatgtcttattacagctgtgtagtaagttttgaaatcagaaattgtaaatcttccaactttattcttctctttcaaaattattttggctattagatttggccatgagattccagatgaagttaaggatgtgttgttctatatctgcaaaaaaaaaaaaatggattttcatagaggttgcattgaatccatagatcactttggtttatattgacatcttaacaatattaagtcctctaatccatgaacatgggatatgttttcctttgtttatatgttctttaattttttcagtaatgttttatagatatcattatacaagtgtttcacttccttggttaaattaattcttaagtattttattctttttcatgctattgtaaatgaaattttttataatttcctttgccgattgtttatataaagaaatgcaactgacttttatgtgttgactttatattctactgctttactaaatgtatttattagctctaacagttttttgtggaatctttgtttttatatatggcttttattatattgagataatttctttctatttctaatttgttgagtgtttttattataaaagggtggtgagtttcatcaaatgctttttctgctcaattgagatgatcaggtgggtttttcccctctttttttgagtctctatctgagtctgcttggtatatttattttattaatttgtaaccttaatatattgcaatgattaattttcacatgttaaatcatccttatattccagaaatatattccacttggttatagtctataattccattaatatgctactgaattctatttaatagtattctattgagtattttgcatcactgttcatgaggaatattaatatagtcaatatagtttatagttgtagtgtctttctctagcttggtaacagggtaatgctggccttatagattgagttagaagtattggtcctcttcaatttttgaaaaagtttacaaggactgatattattcttctttaaagatttggcagaatacacgagtgaagccaacaggttcagggctttttttctttctttttttttaatcagaagatttttttttgttactgattaaatctttttactagttataagtctattcacggtttgtatttctttgtgacttggtcatggcaagttttgtgtttcaggaattattttttcatctagattatgcaatttgttggcatacaaatgttcataatactatcttaaaattctttttatttccgtagaatcagcaataatgtccccattttcacttctgattttagtaatttgactcttctctctctgtttcttcttacatgtaactaaagttttatcaattttgttgattttctgaagacccaacttttgatttcattgattttctctgtggtttttctattctctaatttttaatctctgctctaatgtttatgttttctgttacttgctttgggttctttttttctttttctgctttcttgagttgtaaagttaggttgttgccttgagatttttcttattttttattataagtatttatagctacaaatttccctctttgcactgctttcactgtatcttatatgtttttggtatgttgtatttttgttttcatttatctctaattattttctaattttcatcctgatttctgccttgatccattggttaagagagtgttgtttaatttccacaagtttgttaatttctcaattgtacttctgttattgatttctaacttcattccactgtgctcatagaagacactttgtatggcatctatctttttaagtctatcaagacttcaattatggtcttacatatggcctatcctggaggatgtctcatgtgcacttgaaaagaatgcgtatacttttgttgatgtatagagtgttatatatcactgttagatctagttggtttattgtattaagtcctcttttctcttacttctgtctggttggtctatctatttttcagtgtggaatattgaattgtacaactattatagaactgtatatttctattttctctcattttttgcttcatatattttgatggtctctcattagaggcttaaatatttataattgttgtatcttcttaatatgttcagctttttaggaaatataatgtccttcttagtctcttttaactttataaatttaaagaccattttgtctgatattgatatggctaccccactctgttttggataccatttgcatggaatctctttctccatcctttcactttcaatttatttgtgactctgtatcaaaagtgagtctgttataaaccatgtatggttagactatgtgtttttatcctttcagtcaatctctatcttttgagtagaggctttaattcacttacatttaaagtaattgctgataaagagggatttctgttattttatgatttctcttctataggccttatagcttttttgtactccatttttttattactgtttgtgtgtggtcttgtgtgtgtttagctgactgttaaatgggatgtttagattcctttctcatttcctattggtatattttatagctaattttatggttaccatttggcttacatttaatatcctaaagttataacactaagatttgaattgataccagcttaacttcaatagcatacagaaattctgatactttacagcttctttctcacttctttcagttgtttatgttctaaaattacatctttataccatatgtaccccacaacatgaactaataattcctttaaatatatttatctcttaaattatgtagaacccaaaaggtgtggttacaaaccattgttccaataacactagcttgtacaattgcccttgtatttgtctttattgagatctttattccttcatatggctttgagttactacctaatatccttttatttcaccctgcaggactcctttgcacatttcttacagggcggatctggtggtaacaatctcccttagctttgtttatctggtaatattttaatttattccttacttttgaaggacacttttgccagatataggactcttggttgaaattttttttcctcttagcattttaaatatattgattcctgccttctactttccatccaaagttttcataatcagcatcaaggatatgctgattatcttattaaggatgccttgtatatgatgagtcacttctctattgctgctttcaaggttctctctttgtcttcgactcttgtttttttttttttttttttttttttttaaacaggttctcactttgtcacccagaatagaatgtagtggcctgattgatcatggcttctagcagccttaacatcctggactcaaatagatcctcttgcctcagcttcctgattagctgggactgtaggcatttgccaccacacttggctaatttttttgcttttcctttttttttttttttgtagagaccaggtcttcctatgttgcccaggatggtctcaaactccggaactcaagcagtcttcctgccttggcctcccaaagtgctggagttataggcatgagccatctttgacttttgaaagctttgtaacaatgtctcaatgtgagtctttttgagtttatcttccttggaattcattgagcttcttggttgtttatattcatgtgtttcatcaaatttgagaagttttcagtcattatttattcaaatattttctctgcccctttctgtctctcttccttttttttctgaaatttccacaatattgactttttacttaatggggatgcatatgtcacttagcctctgttcaccattttgaatttttttctttctgtttttcagacttgataatattcactttttaatctacaagtttgctaattcttctgtctgctcaaatctgcctttgaattcttctagtgaatgtttcatttcggttattatacttttaagctccagagtttctttctggtttctttttaggttttctatctctttactgatatttatattttgttcatacatcctttacttgactttctccccatctttctttagttctttaagcatcattaagacagttgttttaaagtatttatctagtaggtctaccctcaggactttttcagggataatttctgttgctatttttttctttcaatgggccatccttccctgtctctttgtgtacattatgattttttttgtttaaaagggaactttttaatttaataatgtaataactctggaaatcatatttgctccattttctagggtttattttgttgctgttattgctttaggttttatttattaatttgctttatagttgtaatctgtctctgtgccaaggactggtctggggtgtaatcttaaggtcttcttaagccttttctgagcttttctctggatatgtgtggtcattttctaattttccctgtatatgcagttgtcttcttaatgtctaattctttaatgtctggctctcgaaagaagaaaaagagaaaaatgaaggagttaatggagtggcagtggagctttaaatcccttggaagtcacttcagacagagggtgtagggcttgcgggaatgagggtaagtgcaacaacaatggctgcccagttctttgtttgcacttctgtgatcagaagcagtcatcaatgatcaggacacaaatccctgattttttaaggatagaggggggttttgttggtccaccctgtctcctgaaagctgtatgcaaactgttccaggaacatgtgcacagctgcctggcaggggattgggagtggggcataggtagctactactgagctaagagctaaaattgaccaaaattagctgcaatttaccatctaagccttcccctgaaagttgtatgtcttcaataaactccagagttccacagtagttctttcaaattctgtcagtgcaattgttatctagagtgttctggtgcttcctattccatctcagaatcctcctgtttggcttttttttttttaatggtttctatccctttgttgaacatctcttttttcaggtattgttttcctgattttgtttagttttttctttcttctttgttcttcttaggtcactgaaattctaaagatgattattttgaattctttgtcagacatttcttaaaggtctctttctttggggttggccactggaggtttattttgttcctgtggtggtgtcgtggttctttgattttttctttgatttttttttcatgttccttgaagtctgcagtcacttcctccagtccttactcactggcttcagaaaagcctttcaccaggcaattcactagagattctggcttgtaggttttctgctgagaaatccactttagtctgatgggcttccttttgtaggtgacctatcctttctctccagctgcctttaaaatagtttcattcattttgatgttggggaatctgatggttatgtgtcttggggatggtcttcttgtggtcttctttgctgggtttctctgcatttactgaatgtgaatgttagcctctctagctaggttgggtaagttcttatagatgatgatatggcttggctctgtgtccccacctaaatctcatgtcgaattgtaattcccagtgttggaggaggggcctgatcggcagtgattgaataatgggggtggacttccctcttgctgttcttgtgatagagttctcctgagatacgcttgtttaaaagtgggtagtggctaggcgcagtggctcatgtttgtaaatccagcactttgggaggtcgaggcaggtggatcacttgaggtcaggagttcaagaccaacctggccaacatggtgaaacccgtctctactaaaaatacaaaaaaaattagccaggcatgatggcaggcacctgtaatcccagctacttgggaggctgaggcaagagaatcacttgaacccaggaggcagaggttgcggtgagctgacattacaccactgcactccaccccgggcaacagagggagactccgtctcaaaaaaagtgtatagcacctcccccattcctcctatgtgaagatgtgactgcttccccttcactttccaccatgattgtaagtttcctgaggcctcctcagaagcagaagcctgtacagcccgaagaaccatgagttaactaaacaccttttcttgataaaatacccagcctcaggtgtgtctctatagcagtgtgagaatggactaatacagatgatatcataaatgtgttttctatgttgcttccattctctccatcagtttcagaaatgccaatgagtcatagattcagtctctttgcataatttcatatttctcagaggttttgttcattcattttcatgcttttttctttattattttctgactctattatttcagaaagccagacttcaagctctgaaattctttcctcagcttagtctattctgttgttaatacttgtgattgcattatgaaattcttgtagagtgttttttagctctatcagctcagttacattctttcctgcactggctgttttgtctgtccgctcctgtattattttattgtgattcttagcttttttaggttgggtttcaacattcttctgaatcttgatgatcttcattcctatccatattctgaattctatttctgtcatttcagccatctcagcccagttaagaactcttgctggagaactaatgtggtaatttggaggaaagaagacactggctttttgagtggtcggagttcttgcagtagttctttctcatctttatgggctgatgttcttgcagtctttgaagttgttgtcctttggatgagtatttttttcttttattctatttgatgaccttgggggtttgattgtggtataatatgggcccagctaactactttcttcattatggcaagatttttggggaccaaggctcagcttaggacacctggactgcaagctttaactcttgaggactcctttcaggccttgcctttgatctccagctccttgagtttaggaatctactgcactagaggggccagagtgtcctggccactggtcacagcattccaatgggtaatgccaaccatggagacaaagcacttcgtagggtggtggcagcagattctgttcttatttgcacatgctagcagcagcagcagtgcagcagtgtagactctcattggctgcagcagggtgctggtaggtaccagagtgccagcctttgagcaggcattcacagcagtagtagtggcagtatgtctggggcgtggggggcagtgtggaccaggggcccctgtaggcaactgtgcatgcattcatgctagtggtggtgttatcatgggagcaccggtgggtgctgtgtgtgccctctgtgcatattcatgctggtagtggtggccgcccagtgccaaggccagggccactattttctgtgcctaattttgcaccagtggcagtgttgctgcacaggtggggcacaggcagggcagggccagtgggctccttgactgccaatgcttcaacaacaatggtggtaccgctgggagaagtgggacaaggtgcactccactggcagtagtgtcatgacagggtgctcatgcatatttacgctggcagggaagggaaggctatgtctacctgcacacacatgtgctggcaaagcaatgtggaggtggctacgggtgagtgcctgtgggcaaagcagcatggaggctgctgttgggggaggactcagtgtggtgcaggcaggggcactctgctggagcactctgccagtcaggcacagtccaccagcacaggagctatgataaggacccccaggaggtacctaggggctgcactacagacaggcttagccaggctgggggcctgggagaggccagaagactgaggggtgcttaggtcagactggctctgtctcatgggcaagaccaccctatagagttcaggcctcacagtttccctagggttaaagctcttatgggagcaagttgagcctagggtgacgggcatcactggtctgctccattacaggtgctcccacaccaaaccctctgggcgctagctggagttctttccttaatgcttctctcttctctaagcagctttccctgccaattcagatgtccattgtggctaaggggtctcctcctgctgggattccagaggcccatggcgatagcaggttccttcttgactgctcaactcaccccttttgcaggagtcattggggtcagggaacaagtcgtggtgtgtggtagcccaatgcaggtttcccagctttcttctcctttagcccagcccctgtgtcttccctccatctgctctcaatgccttccctctgaagatctgataggagtgtgccagtctccccagtatcctggtctcttggtgggagatgttcccctggctgcatctagtcagccatcttagagcaggaattcaatctatgcttctatttctgttggaaaaaaattaattagactaattgcagaaggatactgaaagaaaatattaattttttgtctaaatggaagtgagactctaaggaagttaaaattttaaaaattaaagctatttttaaaagaataagtaaattggaggtagaaactacaatacccagagatcactgctagaacatgacgttgcttaatatatccaagagtaaaacttgttcttaaccttcttaaccaaataattttatctcagtatattaggaacctacagcaagtaggtaacaatgtatcaggtagaaaatctagggaagaattaatgaatccagtaagaaaacaacagggaccctttgaggcatggaagtttgagatgggagcatagaaaaggaagcaaggcactcagttggattggctcacacctaggagggatgctccaatgcaggagaaacggtaagtgagagattcctagcagtccacattccaaccacaaatgcctgcagtcctagctataagaaagccctttggccctcttgggccctgagcctagtataaggagcttcctggagtccacaagactgcattgtttcagggagggaattcgtgctgggacctctgggacccaagctgctacaatatgatgccattttgagagcagagtaaacaccaaactacatcccgccctggtgcccaatgactcctgcatctccaacatccctccacatccacccagaaggctgtagtgttgctatgccagctgacccagtggtataactgcatttctggcacctgagccatgcagcaccctacatcccagggagcaggtgatctagcacatcagagaggctgtatactcacatgccccacccaggggagcagggatcagcctgcctgccctactatggacaccactagtgcctgtatatcacacccagaggcctagggattgggccatttggctcactactggcacccatgcatgccacccagtggcctgcagactggtcctactggcctgatgacaccaccagtctctgtgcactccactcaggcaccagaggacccacctgctattgacactgccagtgccaatgcatgcatcctacccagggactcaaggagcaggccacctcacctgccagcacctgtgtgctccacccaagggcccaaagaccagcctactcagggcccatactaccaccactgacacctgcatgtgccccccagggaaccaagaactggcctactgccatcactgctgatgctcacataccccaccaagaggcctgaggaccatcccacttggcacctccatccccagcaaatccttaccacagcctccaaaaacaactgcagcctatgccactaaggaacttgcagacatctccaatactgattacagccaaagtaatcacatggagactacgctatggtgcccatccagaaccaaagccaaagccatgtacccaacttacattatagatacatcaacaggaaaaaatatttctctatggaagctactttataaaattgggaaaagtgacagttataccagctgtggaaatatcaatgtaaggacatgtgaacacaaaaaatcaagaaaacatgatacctccaaaggaacacaataattctccaataacagaccccaaaggaaaaaaaagatctatgaaatgcctgaaaaggaatttaaaataacgatcttaaggaaatctagcaagatacaagagtatacagataaatacaaagaaataagaaaaacaattcctgagctgaatgagaaattcaacaaagagatagatatcataaaaaagaaccaaacaaatcctagagctgaggaattcagtgaatggaataaaaaaatacaattgagtactttaacagtagactaggccaagcagaagaaagaatttctgaacttgaagccaggtcttttgaaataacccaatcagacaaaggtggtatgggggtgttgtggagggaggaaaagagggagggagaaagaagaaagaatgagaaggaattaggaaagcctaggagttgtggaaaacaagcaaacaaataatcaaattttagaagttgcagaaagagaaaagaaggaaaaaggcatagaaaaatactgcatattctaacttataagtgggagctaaataatttgtacacatggacatagagtgcagaataatagacattgaagactcagaagggtgggagggtgggagggtgggagggggagtgaaagaggagaaattacttaccaggtacagagtacttattcagatgtgattccactaaaagcccagacttcatcactatgcaatatattcatgtaacaacaaaattgcacttgtaccctttaaatttataccaaaaaaagaaaacttaatgaaacaataactgaaaagttcctaagtcttggaacagatataaacatacagatatggaaagttcaataatccccaaatagatttaattttaaaatgtcctctccaaggcacattatagtcagaatccaaaaagcctggatctcagtgtgcattacatgtgcctcttaaaccctactaaatatgtcttcaaaatttccactccttctgaaatattttacctgaccctgtagtcaaatgtttaagcatacagacagtaagtgagcaactctggattagaattctgattattacgtatgtgatatgagaaaattttcttactgattttttctgagctttagtttcttcatcttcaaaatcaggataagagaaaaaaacacctacattgcaggattgttgtgaaggttaaatgaggtaatgtgtacaaagtgcccagcatttaagtgtttgataaatgttaactcccattttttaacatgccagcccatttaaatggtgaaaactaattttcatctttgcactatctgcaagggaatccaggaaatgtacaattataccttttcaaactctataatacagtaaggctatattgtagtggataccaagtactagttcttcatgttcaacatggccaataaacatgatttttctctgtggcactctatcttcatttgtatgaccaaagaaacacattttaaaatgtattctatgtattgctgaactacgagatgatgtttcaaatataatttgttagcattaagaaaaataagacatactttaatgcattgccaagtttttaagttctatcaaaacagagccaaactcacaaggtctaaataaacagtactcttatcttggacgtgagtagttttatactctggaacaagaccgacaatcgtaattaacttttgttctgagtttactgtatgccagcacatattctagcatttgacatgtattatcacaaaaactccattaggtaggtaataatattccaaatttacagaagaggcaactaatgcatgaagatttcagtaatctatacagctagtaagtggcagaactgagatttgattccaggcagtctagcctggccccagaaccaatgttcttatgtacccttcttaactgcacagtaagatgcttctgttcttctagggtttttatggttttaggctttaggtttgagtctttaatccatctggagttaatttttgtataaggtgtaaggaaggggtccagtttcagttttctgtatacggctagccggttttcccagcaccattgattaaatagggaattctttccccattgcttgtttttgtcagctttgtcaaagatcagatggttgtagatgtgtggtattatttctgaggcctctgttgtgttccactggtctatatatctgttttggtgccagtatcatgctgttttggttactatagccttgtggtatagtttgaagtcaggcagcttgatgcctccagctttgttcttttggcttaggattgtcttggctatatgggctcttttttggttccatatgaaacttaaagtagctttttttctaattctgtgaagaaagtagcttgatgggaatagcattgaatctataaatagctttgggcagtatggccattttcacgatattgattcttcctatccatgagcatggaatgtttttccatttgtttgtgtcctcttttatttctttgagcagtagtttgtagttctcattgaagtggtccttcacgtcccttgtaagttggattcctaggtattttattctctttgaagcaattgtgaatgggagttcactcatgatttggctgtctgtttgtctattattggtgtataggattgcttgtgatttttgcacattgattttgtatcctgagactttgccgaagttgcttatcagctgaaggagattttgggctgagaccatagggttttctaaatatacaatcatgtcatctgcaagcagagacaatttggctttctcttttcctatttgaataccctttatttctttctctttcctgattgccctggccagaacttccattcaggacataggcatggacaaagatttcgtgactacaacaccaaaagcaattgcaacaaaagccaacattgacaaatgtgatctaattaaactaaagagcttctgcacagcaaaagaaactattgtcagagtgaacaggcaacatacagagtaggagaaaatttttgcaatctatccacctgacaaagggctaatatctagaatctacaaggaacttagacaaatttacaagaataaaacagccccatcaaaaagtgggcaaagctgtgaacagacacttctcaaaagaagtggccaaaaaacatatgaaaaaagctcatcatcactggtcattagagaaatgcaaatcaaaaccacaatgagataccatctcaggccagttagaatggcaatcattaaaaagtcaggaaacaacagatgctggagagaatgtggagaaatagaaaacttttacactgttggtgggagtgtaaattagttcaaccattgtggaaacagtgtggcgattcctcaaggatctagaaccagaaataccatttgacccagcaatcccattatggggtatatacccaaaggattataaatctttctactataaagacacatgcacacatatgtttattgaagcactatttacaatagcaaagacttggaaccaacccaaatacccatcaatgatagactggataaagaaatgtggcacatatacagcatggaatactatgcagacataaaaaagaatgagttcatgtcctttgcagggaaatggatgaagctggaaaccatcattctcagcaaactaacacaggaacagaaaaccaaacaccacatgttctcattcataagtgggagttaaacaatgaaaacacatggtcacagggaggggaacatcacacaccgaggcctgtcggggggtggggggaaaggggagggagagtattaggacaaatacctaatgcatgtgggggttaaaacctagaagacaggtttataggtacagcaaaccaccatggtgcatgtatacctatgtaacaaacctgcacattctgcacatgtatcccagaacttaaagtaaaattttttttaaaatgcttctattctatctttttaaactccaagcacttaaagtactttcattgtatatttaagttatgcaacaaaaagtttaatactataatgacagaatacatggtagagatatagaaccaattttaatctatgttacacagccaaaatataaaaaaatgaatcttatacttaataaatatcttttgaaatttttggctaactactaaaattatgactaagtcttaaaagaacaaggacttaactatattcatgtggtttagaaaataaaggaattgttgctcatcttcatttgttaatctacacgcttgtattcctttgtattaagagttaatcattatatgtatgctgccttcctcctcttggcacagaccatgtaaatggacactgcacaagtccaacttctcagagttgcagttctggaaaacgtctttctagtgccgatgtttcaaaagtaaatcgctggggtcctggaagaccaccatttcgaaaggcccagtcagcagcctgcatggagatttctttaccagttacaacagaaggtatgttaaacatattaaatttttttgttacagttaaaatttggtttacaatggtaatgggaacagagatatgggatggagatcacatatgaaagatgttaaaaaactactaatcagtgaatacctgagagcctgatggggctgtggccataactccaactccattcctcactccacctccttcctcacctctaaaaccagaatgcctctgcttataggtaactaccccctcctctgtacaaagggagacctatgcctaaatctgttccctacccttcccataataattaagagtttatttcaatcccaatggtaagctttttggtgtctctatctgtagatatttaatgtattgcaaccttaatttcctcaattgtcaaatgaatgtgaccaagaacaaaggcaagatattaaattctaaagtttgcaattttcatcttcatatatttttaaaaggaaggtctatttgcttatttatggaatgagtgtggggcggtggggtaggggagtaaattacaagagccagagaccagaaatttttacagaggcaaaaaaagggaattttgtaactttgctgcaactgtcttattgataaggaactttagagaaagagataggaaaaaaataattttaggaagatttgctatagtaattctatgctgtgaagtaagtctctatttactactcctgaaaacttttgacagtgatctatattggtcttcaaatttaaaaaaattatatttaagtttttggttttttaaatattatgctatactaaatctgatcccttagatatgcagataatgatgttatttctctaacaggtgtctgtgagtatcaactttgtatggtgatgaaccatgaatggaaaagatttggagccatataatatctagcatgttataaaagaagcaatatgtaatgattataaaagaagtagcccccttttaatttttattttttaaagagttaggatctcattctgttgctgaggttggattacagtggcataatcatagtgcactgcagcctctaactcctgaacttaagtgatgctcctgcctcagcctcccaagcagctggaggtacaggtgcacaccaccacatccagcttatttttcagtttttgtagagacagtgtctcactaagttgcccagggtagtcttgaactcctggcctcaagcactggggttacagacaggcattagccaccacaaccagccagaagtagcactctcaatcactgtaatgagaggtgggaattttgaattttagatacttctacctctaatttgtcctggattctgggaaaattactaaactctaagtttgtctccaaatctgtaaaacatataacctccaagctccctctcatctctaaattttatgacaaacaattatttttataaatttgctaagagataaaaaggagaaattaggaatactatattttgtttcctagaaaaaagtctgaggagcctgtatttatcctctttctataaaaacaattatgagttacatgtgtacctatcaagagggaaaagagagtgaaggctgtagaaagaaaaatctgaagaacttgtactctggagagattataagagcaggacaaccttgataacatttcactgagctgtatgagtttatgcttattggagcgtgcacatgtacaagtgttgatgagaggagaacctgaaaccatcctgtttttttttttaagtgagctgaagcactctcagaaagattaccactatcaacaggatggcatatagtctgtactctttgtttagccctaggcaaagttaggactgcatttgaattaaaggtaacagcctgaaaccagttcagggagataaaatttgcattttggccttggtagaaatgttaatttttagaattgtaattaccccagatatagaatatgtttgccgcagaagatttgtgatcctgataagccctttcatgccaatcgccacagtattgtcattggaactgacaagaaactgttagggattcttccaacaattcagaggtaggagggaagcacaatttaagtgatgtcagaaattcttgtaaccattactatttagactaaatcttttctctaggtaaaagaatttcaacaaacttgtgagttaacgtagagaaagaaaaatggtgagctggagctcaggagcctccaattctagtcctaggtctgcctaagcttatgaattatacttctagacttcagtttctccatcttcaaaataagctggtgaactggataagctccctctcaggtcaattaacaaacaatgaaattttacttcctcctcataattttgatttatatatattaaatctgatgttattgtggaaatatactaacaatttgtgtggtttttttttatttatttccatagaaaaccgagaaaattcctataatcgttctagaagctctagtatctccagtattgacaaagattctaaagaagcaattacagcactatacttcatggactcctttgcacggaaaaatgactctaccatctctccttgtctgttcgttggaaccagtctgggaatggtgttaatcatctccttaaacctaccattagcagatgaacaaaggtttacagagccagtcatggtattgccaagtggtaagagtttgtattcattcattccttcactgttactttttcaaatttagatataaggtattataaacataaatttgtattgatttggagcaaaggttataagtattctgcacaatgggaactattaagaattttatacatcatataccatcccaacatctgtcatgttgtaactttcctttggggtaaaagagtacaaccatttcttcggtagtaaactgtgtaagtgccaacctgaacaatgacatgggaaataagttcctgaaaagcactgaggaaaaccttaatgcaaaacttaaatttatttttaacaaattgaagcattacccaaagttccatgccagatcagagcatgagtgtttttacatcatccttgaagaactcagaataattaagctagaagctatctgacctaaggtggatttctaaagacttttataaccttcccatcttgtttcaaaagcatgccacacaatttctttccttttcatgctagtgcctagagaatttgaccaatgttgtaagtattgttgccaagcatatgttgtattctcttcctccttgaattatcttttttttttgaagaagagataagtatgattcctcctgttattcctaatttgttcttatcactaattttattgtttccctgtttcctatataagaaattttcagatagtttttaagtcaaaaaatttcattactctgcaggataagggttttattttaaaaggatatatattatatagaaggttacacttgtgttttctttaactagtgtgctaagttcatatgacaagattgtaggtagaatagtcagttctctactaatgtggcaaattcagatttgtgttttaaaagttaatcgtgatgacaattttattttaacatatagttcacaatgaaaaatatattttactatattcctaattataaagaaatatacacaattcttttgactggtgagttagttggagtcaaatcagtgataccataatgaattattaattattaattcaattcattatttaactcaataaaagattatatatattggacatctaatatgtaccgggcattcctcacaagtttaaaggtacagtcagcttccactgtcacacaagtttaaagctgtaagtgaaagacaatttcgtaattagaaatattctaacaattgtggttttctgtatcacaagcatagaaataagcaatccctggactaataaagcagatctctcaatattatagggaaattctttgtcattcttagcacatatacttagaccaaaaaatgatgacaaaatacaaaataagtatagatttaacttttgacactattttgtaaatatttgaaaactttttctttatctatttaataagatttaatgggaagctatcttctccaagtctctatgtcactattctttcaagactctagttaataatatgtgtcaacatcagttcattggctaggcacagtggctcatgcctataattcctgcactttggaaggctgagggaggaagactacttgaggccaggaatccaaggccagcctgggcaacatagtgagaccccatcactaccaaaaaatttttttaaatatatatatttttaaaaattgctgggtgcagtggctcacacctataatcccagcactttgggaggccaaggtaggagtattgcttgagcccaggagttcaagaccagtctgggcagcataatgagaccccatctctacaaataatttttaaaaattagccaggcatggtgtgtgtgtgcctgagccagaaggatgagcatgcagtaagccataatctcaccactgcactccagcctgggtgacagagtgagactccatctcaatgaaaaataataaaaaaattaattaaatcaaatgtgccacacttatacaagatgttaataataaaggaaatgacagaaggggtatgtgggaactctttatactatctgttaaattttctttaaatctgaaactgctgttaaaaatacactctattaatttgttgaataaagatgtatataaaggagaaagccatgagtctgggttcccatgtttgttctgtaattaaccattacaagaaagaaagtctacttgggagccataatttatggcagtaaaaagaaaggagggaaaagataagggtgacagaaatcttgtttaaatttaaagtagaaaattttgtgcttcctctttcagagcctacttattgactaactgtcccggtcttcactctccttgccatatttattttctttcctatacccatgagtctctgcccaagcttatgggaactattatgggtactgtttatgttattatggttgctgccatagcttatgggaaccattaaagaaggtttggatttaggggcatttagcacttgtccattgtcagtgctgaagtgagtgacatgctctctgaccttgaatgcatcttttttcctgtgagaacgttgttaaataaacttttgttagtcggcctaggaaaattcatgagtcaaatagtttccttagacttgaaaacagtctactttgaaatttatccactcattcaacaaacatttaccaagcccataccaccgaaataagcactggggatacagtggtccctgttttcggagacttgtagggaaaaacaaaattaaacacaaaattacaataaagaaagtataataatggaaattacactaagagaaataaagaataccatggcagcatggcagggggatttggggaagagctccctaacaaagatgacatctgaagtggaagttggacaagtttgggaggaagtgtacagtactggcgtttaagagtaattcagaggctgggcgcagtggctcacaattgtaatctcagcattttcgaagaccaaagtgagaggaatgctagagcccaggagttcaagaccagcctgggcaacactgggagaccctgtctctagaaaaaaaatttttttgaaagactaaagtcagtacagtgtgagtaaaaatctagaagtaagagaggacatggcatagctggagactgtagatagaatgatactaaatgaggatggaaaaataggcagggaatgattatacagtgccttataaatcgtgaagaaggaaaagactacctagtagattattttttcagtacaaaacttgtgatgcaaaacattgggttttttttcaagatctagttattaaattttaaattttataattgtaaaaatcaaaatataaaggaaaaaaatgaaaattctgccactagcaaactttgtcccttctctgtccccgtccccatcctcatttcctcccctaggaattttactctccactagcaacttggtgagaaatttgttaaaactcattttaagttttatttatttctacttaactctttatgctgccaactataaattattctataatgatcagttctgccatacaaagtacctagcatgctttgtaacatatataatatatatgtgtatatataaaatatatatctctcataatcaaactcaagatttaaattcatgattaaagtcaagattctccagaataaattcattctccttaccccagtggtagatgctttttcattgctataaatgaatacctgagattgggcaacttataaagagaagaggtttaattggctaatagctcttcaggctgtacaggaatcatggtgctgacatttgcttagcttctggtgaggcctcaggaagcttccagtcatggtggaaggcaaagagggaacaggcacattacatggcaagaggaaaagcaagagagagaggagggaggtaccacataattttaaataaccagatcttatgtgaactagcacagagagaactcactaatcaccaaggagatggcgctaagccattcattagggatccatcctcatgatctaatacgtcccattaggccctacctccaacattggagattacatttcaacatgagatttggagggaacaaacatccaaaccatatcaacttccaaactagttatttttaacactctttcatttctgttagtagtagaatattaacagaaatgtaattaatagccatcatactacctaaatagcctccataacttcaatttttttcttctgatcccttttactcactgccttcatactggtcatataccagtattattttcatcattgaattttcacttttggacctaccctgtctactctagagttgtcccagccttactccctaagtcaaacttattttccagcattcaattccattaaagtccatttctccattgaagaactagtaaattaatttatataaatatgaaaataggttaatgtgctttcttatggatataatataaaactggttaataggctttgtctggaaattatttaattgaaattagaatgatattatttttaatgctaagtctaaaccttgatgaaaaactttattaaagtattatttagttaaggtcttttgatataagatgggtatatttcaaatatacttatgaaattcacacattttatctcttctaaactgcaataagaactaatacaataataacattgtaaaatcaaacataatcattatatttgactgaacaagaataataaaggcctcatacacaatagtcaacatatatactccccatttataggtttcaatatttagcaccttttggagttaccagtatctcttattctatttcatatgttcaagtgtacccattgtttagctccaccttataagtgagaacatgtagtttttgactttctcagtcattttatttaggataacagcctccagctgcattcacattgctgcaaagggcaataatttcattatttatttatttattttattatactttaagttctagggtacatgtgcaccatgtgcaggtttgatacataggtatacatgtgccatgttggtttgttgcacccatcaactcatcatttacattaggtatttcttctaatgctatccctcccccaggtccccaccccccgacaggtcccagtgtgtgatgttccctgcgctgtgtccaagtgatctcattgttcaattcccacctatgagtgagaacatgcagtgtttggttttctgtccttgtgtgatagtttgctgagaatgatggtttccagcttcatcaatgtccctgcaaaggacatgaactcatccttttttatggctgcgtagtattacatggtatatttgtgccaaattttcttaatccagtctgtcaccgatggacatttgggttggttccaagtctttgctattgtgaatagtgctgcaataaacatacgtgtgcatgcatctttatagtagcatgatttataatcctttgtgtatatacccagtaatgggattgctgggtcaaatggtaattctagttccagatccttgaggaattgccacactgtcttccataatggttgaactaatttacactcccaccaacagtgtaaaagcattcctatttttccgcatcctctccagcatctgttgtttcctgactttttaatgattgccattctaacgggtgtgagatggtatctcattgtggttttgatttgaatttctctcatgaccagtgatgatgagcattttttcatgtgtctgttgcctgcatagatgtcttcttttgagaagtgtctgttcaaatcctttgcccactttttgatggggttgcttggttttttagtgtaaatttgtttgagttctttgtagattctggatattagccctttgtcagatgggtagattgcaaaaattttctcccattctgtaggttgcctgttcactctgatggcagttgctttgccggacagaaggtctttagtttaattagatcccatttgtctattttggcttttgttgccattgcttttggtgttttagtcatgaagtccttgcccatgcctatgtcctgaatggtattgcctaggttttcttctagggtttttatggttttaggtttaacatttaagtctttaatccatcttgaattaatttttgtttaaggtgtaaggaaaggattcagtttcagctttctacatatggctagccagttttcccagaaccatttattaaatatggaatcctttccccatttcttgtttttgtcaggtttgtcaaagatcagatggtgtagatgtgtgatgttatttctgaagcctctgttctgttccattggtctatatctctgttttggtaccagtaccatgctgttttcgttactgtagccttaatatagtttgaagtcaggtagcttgatgcctccagctttgttctttttgcttaggattgtcttggcgatgcaggctcttttttggttccatatgaactttaaagtagttttttccaattctgtgaagaaagtcattggtagcttgatggggatggcattgaatctataaattaccttgggcagtatggccattttcacaatattgattcttcctatccatgagcatggaatattcttctatttgtttgtgtcctcttttatttccttgagcagtgatttgtagttctccttgaagaggtccttcacatcccttgtaagttggattcctaggtattctctttgtagcaattgtgaatgggagttcactcatgatttggctctctgtttgtctgttattgctgtataggaatgtctgtgatttttgcacgttgattttgtgtcctgagactttgctgaagttgcttatcagcttaaggagattttgggctgagacgatggggttttctaaatatacaatcatgtcatttgaaaacagagacaatttaacttccttttttcctaattgaataccccctatttctttctcttgccggattgccctggccagaacttccaacactatattgaataggagtggtgagagagggcatccttgtcttgtgccagaaagggaatgcttccagtttttgcccagtcagcatgatattggctgtgggtttgtcataaataggtcgtattattttgagatatgttccatcaatacctagtttattgagagttattagcctgaagagctgttgaattttgttgaaggccttttctgcatctattgagataaccatgtgttttttgtcattggttctgtttatgtgatgggtacgtttattgatttctgtatgttgaaccagccttgcatcccagggaagaagccaacttgatcgtggtggataagcttttcgatgtgctgctggattcgtttgtcagtattttattgaggattttcacatcgatgttcatcacagatattgctctaaaattctcttttttgttgtgtctctgccaggctttggtataaggatgatgtgggcctcataaaatgaatttgggaggattccctctttttctattgattggaatactttgagaaggaatggcaccagcttctctttgtgcctctggtagaatacagctatgaatccatctgatcctggactttttttggttggtaggctattaattattgcctcaatctcagagcctgttattggtctattcagagattcaacttcttcttggtttagtcttgggagggtgtatgtgtccaggaatttatccatttcttctagattttctagtttatttgcgtagaggtgtttatagtattctctgctggtagtttgtatttctgtgggatgagtggtgatatcccttttatcatttttattgcgtctacttgattcttctctcttctttattactcttgctagttgtctatcaattttgttgatcttttcaaaaaaccagcttctggattcattgattttttgaaaggttttttgtgtctctgtctctttcagttctgctctgatcttagttatttcttgccttctgttagcttttgaatttgtttgctcttgcatctctagttcttttaattgtgatgttagggtgtcgattttagatctttcctgctttctcttgtgggcatttagtgctatacatttccctctacacactgctttaaacatgtcccagagatcctggtacattgtgtctttgttctcattggtttcaaagaacgtctttatttctgccttcattttgttatttacccagtagtcattcaggagcaagttgttcagtttccatgtagttgtgtggttttgagtgagtttcttaatcctgagttcaaatttgaattgcactgtggtctgagagacagtttgttgtgatttctgttcttttacatttactgaggagtgctttacttccaattatgtggtcaattttggaacaagtttgatgtggtgctgagaagaatgtatattctgttgatttgggatggaatgttctgtagatgtctattacgtctgcttgttgcagagctgagttcaagtcctggatatccttgttaaccttctgtctcgtggatctgtctaatgttgacagtggggtgttaaagtctcccattattattgtgtgggagtctaagtctctttgtatgtctctaaggacttgctttatgaatctgggtgctcccatattgggttcatatatatttaggaaagttagctcttcttgttgagttgatccctttaccattatgtaatggccttctttgtctcttttgacctttgttagtataaagtctgttttatcagagactaggattgcaatccctgctctttttttgctttctatttgcttggtagatcttcctccatccctttactttgagcctatgtgcgtctttgcatgtgagatgggtctcctgaatacagtacactgatgggtcttgactcttcatccaatttgccagtctgtgtcttttaattggggcatttagctcatttacatttaaggttaatattgttatgtgtgaatttgatcctgtcattatgatgttagctggttattttgcccattcattgattcagtttcttcatagcatcaatggtctttacaatttggcatgtttttgcaatggctggtaccggttgtttctttccatgtttagtgattccttcagaagctcttgtatggcaagcctggtggtgacaaaatctctcagtatttgcttatctgtaaaggattttatttctccttcactaatgaagcttagtttggatatgaaattctgggttgaaaatttttttctttaagaatgttgaatattggcccccactctcttctggcttgtagagtttctgccaagagatctgctgttagtctgatgggcttccatttgtgggtaactcaacctttctctctggctgcccttaacattttttccttcatttcaaccttggtgaatctgacaattatgtgtctcggggttgctcttctcgaggagtatctttttggtcttctcgtatttcctgaatttgaatgttggcctgccttgctaagttggggaagttctcctggataataccctgaagagtgttttccaacttggttccattctccccatcactttcaggtacaccaatcagacgtaaatttggtattttcacatagtcccatatttcttggaggctttattcatttctttttacttttctttctctaccttgttttctcactttatttcattaatttgatcttgcatcactgatagataccctttcttccccttgattgaatctactattgaagcttgtgcatgtgtcatgaagttcttgtgccatggttttagctccatcaggtcatttaaggtcttctctacactgtttattctagttagccatttgtctaatcttttttcaagctttttaccttccttgcaatgggtttgagcatcctcctttagcttggagaagtttcttattactgaccttctgaagcctacttctgtcaacttgtcaaagtcattctctgtccagctttgctctgttgctggcaaggagctgtgatcctttggaagagaagaggggctctgattttagaattttcagcttttctgctctggtttctccccatctttgtggttttatctacctttggtttttgatgttggtgacctagagatggagttttggtgtagatgacctttttgttgatgttgatgctattcctgtctgttagttttccttctaacaatcaggtccctcagctgcaggtctgttggagtttgctggaggcccactccagaccctgtttgccttggtatcaccagcagaagctgcagaacagcaaatattgcagaacagcaaatattgctgcctgatccttcctctggaagcttcgtcccagaggggcagccacctatatgaggtgcctggctgcccctactgggaggtgtcttccagttagtctacatggggttcagggacccacttgaggaggcagtctgtctgttctcagagctcaaacaccatgctgggagaaccactgctctcttcagagctatcagacagggacgtttaagtctgcagaagttgtctgctgcctttttttcagctatgccctgcccacagaggtggagtctagagatagtaggccttgttgagctgtggtgggctccatccagtttgtttcctggccactttgtttacctactcaagcctcaacaatggcagacacccctccccagccaggctgccaccttgcagatcaatctcagactgctgtgctagcagtaagcaaggctccatgggcatgggacctgccaagccaggcatgggagagaatcacattgtttgccagttgctatgaccttgggaaaagtgcagtatttgggcaggagtgccctgtttttccaggtagtcagtcatagcttcccttggctaggaaagggaaatccccccaccccttgcgcttcccaggtaaggtgacaatgccccaccctgcttcagctcactctccgtgggctgcacccactatccaaccagtcccaatgagatgaaccagttacctcagttggaatgcagaaatcacccatcttctgcatcgattacactgggagctgcagaccagagctgttcctattcggccatcttggaacacgcccgcagtctttacattcttttatatagcaattgaaaggaatccttggcatttagaccttccattccccagctccaccattcttttccagccttatagtctttgacctttcactacatatcctgggccctagacaaaccaaactccttgtcattcacttaataagcccagtgtgtagtcaagtataaagcaatgatttcattttattatgactgagtagtatttcatggcatatatatatatatatatatatatatatatatatatatcacatttttaatccaattgcccattgatagacacttaggtttatcccatgactttgctattgtaagtagtgctgcaataaacatacacgtgcttgtgtctttttgatatgattatttcttttcttttgtataaatagcaggtagtgggatcacttgatcaaaagatagttttatttttagttatttgagacatctccatattgctttccatagaagttgtactaaactaattcccaccaatactgtataagcgttcccttttctctgcatctttgccaaagtctatttttttattttttattaatagccattctgactggtataagatggtatcttattatggttttaattttcatttctctcatgactaatgatgttgaacatttttttttttcgtttcttggccatttgtatgtgttgttttgaaaagtgcctgttcatgtattttgctcactttttaatggggttatttgtgttttcctttttgaattgcttgagttccttgcagattctgggtattagccctttgtcagatgcattgttggcaaatatttttcccattcctcaagttgtttattcactctgttgtttatttctttttctgtgcataagcttttcagtttaattaagtcctatttgtctatttttagttttgccgcatttgcttttgaggtcttagtcacgaattcttcacctaagccaatgtccacacaagagtttttgctaggtttccttctagcatttttatagtttcaggtcttacatttaaatctgtaattcaccttgagttactttttgtatatgttgagagatatgggtccagttttattctcctgcatatggttatacaatttttgcagaaccatttattaagtaagatgttcttttctcagtggatgcttttgttgactttctcaaagatcagttagttgtaggtatatagttttatttctgggtcttctattctcttccatttatctatctatgtttatacgagtactctgctgttttggttattatagccttgtagtataatttgaagtcaggcaatgtgatacctgcagcttcattctttttgcttaggatttctttggctattcagactgttttggttccatatgaattttagaattattttttctacttctgtgaagaatgctgttggcaaattgataggaattgtgttgaatctgtagattgttttgggcagtatggtcattttaatgatattgattcttccaatctatgagtatgggatgttttttcatttgtttgtgtcatctcaatttctttcactagtgttttttaaattttccgtgtagcaatctttcacctccttgattaatgtattcctaggtatttttaatagctgttataaatgggattgatttcttcttttggttctcagcttgatcattattagtgtataaaagtggtactgatttttatacattgatttttatatactgaaactttgctgaggtcatttatcaaatctaggagtcttttgaaggagtctttagggttttctagttataaggtcatataatcagtgaacagcaataatttgacttcctttcttccaatttgaatgcctttttttttttctcttgcctgattgctctggttaggacttgcataggagtggtgaaagtatacatccttatcttgttccagtttttagagggaatgctttcaacatttccctgttcagtatgatgttggctatgagtttgtcatatatgacttttattattttgaagcatattctttgtatgtctagtttgttgagggttttttttttttttttttttgagacagtgtctcactctgtcgcccaggctggagtgcagtggcacgatctcagctcactgcaagctccacctcctgggttcaggccattctcctgcctcagcctcctgagtagctgggactacaggcgcccgccaccacgcctggctaattttttgcattttttagtagagacagggtttcacatgttagccaggatggtcttgatctcctgacctcatgatccacccgtctcagcctcccaaagtgctgggattacaggctgttgagggttttaaaggatttttagatttttaaaattcactgaagaaaaatgaaattcccttcaggtattattatcaaaaataaaacttcatttacccttttgtcattttttagtggcatgaattcagacttttgccagaatagggccccttcttatatagacagatgaaaaaaaatctattatcattctttgtgaaaattcaatgaactagatatatagttcttttcttaatagagcagaaatagtaagtaaccctttagatgtgtgactggcaaacattgaaagactgtcaattatacacatccttacttgggcatgtagttttgaggtatttgcaattttacatcttttttcaggctaaaccaaacggaaaacaaaacaaaactcttctatttcacataagaaaagtctgaaacagaagaaataatcttggactgtggaaatataaattcaaaatgatgaaaattttttcaaacaaataagaaattaaaaattatgacttttaattaaggctgagttttccaaaagcatagtcttacagatgagtatgatacatatgttaaattgtttctgctaaacctttagtcattaataaaatattcttgcatttttttctggtcaggttccattttgtttacaaataggtttttgagggtggtatgcctcaattataggagcagatttattatgataaatactgagatcagaaagcatgtgcaactgcatcatagagtgattacatctaggcattattgccagccaagtttgataaatatgcccaataagtataattgttctctgtgtcagcccttgttgaaggaatactcacagcaatggtgataccgctatcatagctaccattaaattactcattgtgagtggttgtcccgctttcctcaggttttcttccaccagctgtgacagcttcttgatctgtccccaggtgggtggctgtgttcgacaggtgttgcttgtgacagttggggtcctcctcagcgtcagtctcgacatggctgcaaccgaggggtcctcgggatcctcccagaatctcttcctcggcatctggcttatgaaaaagtttcaggtgtcttgatggtatccaaattggctgttgattttggcctggagaaacacaagcataacgtctactccaagttattattttacctatttcccaactttttgttatcagatctccccaccaaatcagttgttctgcttctctttgcagctggtttctgtagatgctgttcagctgctgataacatctggcctttgggcaggctcaaaaaatttagttaataatgccagattcagttgtatctgcagtgttccatattctctatttccccctttctgcttttgcaactgctcttttaaggaaagattcattctttccactatggcttgtccttgagaattgtatgggataccagcaatgtgtttaatattccacatggagaaaaatgtagctagagcttggctagtatagcctggggcattatctgttttagtagaggctggaatgcccatcaccacaaaacactgcaaaaggtgatgtttaacacaggcagagactcttctgattggcatgtagcccaaagtgaaaaaaggtgtccacacatacatgtgcatatgctagtctcccaaatgagagaatatgtgtgacatccgtttgccaaagagagttaggttccaatcctcgaggattaactcctcctgtaaaagatgaagaatgtaccatttggtaagttgggcatcactggataatatttttagcttctttccaggtaatgctgtatctgcatttgagaccagaggcattaacatgggttaaattgtgaaagtgtctagcattagatattgcattagcaactaggtgatcagccatttgattcccttcagtcaaaggtcctggaagaggtatatgagccctaatgtgagtgatgtaaaaagggtgcattctacttctaactgctgtttgcaattgggtaaataaagtcatcggttgttcatctgtatgaaattgtaactgagcattttcaattaactgtgtggaatgaaccacatatgaagaatcagaaatcacattaataggcatagcaaaagcagtcaatacctcaattacagctacaagctccgctttttgagctgaagtatagggtgtctggaaaactttacttttcgatccagaataagaagctttaccattactagacccatctgtgaaacaatgaaaatacttagcaggctgcaggttgtttactgcaggaattgtaaatgcaaaccgttcacattcttgctcagctaaggggatagtaaagaaacggtcttttaaatctatgactattaaaggccaatttttaggaattatagcaggagaaggcaatcctggctgtaatgctcccataggttgtataactgaactgatgactgttaaatcagttaacattctccatttacctgattttttcttaattacgaaaactgcagaattccaaggcgaaaatgttggagctatgtgcccattttctaattgttcagtaactaattcctctaacgcctccagtttctctttacttagcggccattgttctatccaaattggcttatctgttaatcattttaaaggtataggttctggacgcttaacaatggccgccatcaagaatgatatcctaatatttggtgggaacatcgtctttccacttgaagcggtactttcaaagcttgcaaatttttttctagtcccataccagggacataccccatttcatgcattatatgttgactttaagggctatataattgttctggaattagaacttgtgctccccattgctgtaataaatctcttccccataaatttataggtacagaaattataattggttgaatagtcccaggttgtccatcgggcccttcacaatgcaaaatataactactttgatatacatcaggggctttaccaactccaactatgttaaattgagcaggttgaattggccacgcagacagccagtgctgtagagaaatgattgaaatgtccactcctgtatctaccaaacctttaaatttctttccctgaatagttatttcacaggtaggacgtttatcagtaatttgatttacccaataagcagctttgccttgtttatttgtgcttccaaatcctcctgttcgtttaattttactttttccgattcccacatacggcacaatcaggagctgtgccatgtgctctcctggctctgccttccagggaacagaagtagatataacaatttgaatttccccattgtaatctgagtcagtgactcctgtatgtatttgtacccgttttaaacttaaactagacctttctaaaagtaatcctattgtccccgctggcaaggatccacagactcctgttgggaccttttgtgggggttccccaggcagaaggctcacagcttttgtgcagcataaatctactgcggcactaccggctgtggtgggggacagatattgtacaggggtgagggaatggcctgagctggaaatgccccagtttagaacagcgcccaggatgggcccctcatggcttttcccaaaatcgggttcccatctttatcaaacctagagtgacactgcttagcccaatgttttccttttttacattttagacatatttcaggctcagcagttttcttttttcccttatctggcggcctgacttgctgattttttctacattcttttttagtatgaccatgcttcccacagttaaaacaagccccaggaaatgagtatttcctttatccactctcagtcctgccattgcctgtgccaacaaagtagctttatgcagattacctccaataccatcacaggccttgatataatcaactaaatgtgctttcctgaatttaaaaggaaaaggctcaaatgtagctataatatttccctgctgatctgggggctgtattctaacagggaactgccaagcctctaaatcaccctctcttctagcttgctgaattcctacctgaatagaactaagagtggtcgctcgaggcactgctcgaacagacactggggcaactacttttcacccagtgtcctccggaaaagaaagatctggagggtcaggccactctttttcttcaaaataataatgagggggtgcagaagggtagggatgaacctctccctccttttccactttagttttagctggcaaataagcctggtctgtaacctcttctgtacttcattatactctccttcctcctcctcatcagtgtgaaaaagttccaaggtggaatgaaccagaccccacacttgtcccattgttaccctgatgcttctgagctccccttcttactcaccatggggattgctttaagagtactcgggtgtcctccagctagttccatgttctccaaccattgctccagtgacccttcaacctggattcaagcccccatgatggatgccacttgctgagaccagctcggttggggagaccctaactcagtggcactagaggaattaaagacacacacacagaaatatagaggtgtgaagaaggaaatcagggatctcatagccttcagagctgagagccctgaacagagatttacccacgtatttatcaacagcaagccagtcattagcattgtttctatattaaattaactaaaagtatcccttatgggaaatgaagggatgggctgaattaaaggaataagttgggctagttaacagcagcaggagcatgtccttaaggcacagattgctcatgctattgtttgtggcttaagaatacctttaagcagttttcggccctgggagggccaggtgttccttgccctcattctggtaaacccacaaccttccagcgtgggcgttacggccatcatgaacatgtcacagtgctgcagagattttgtttatggctagttttggggccagtttatggccagattttggggggcctgtttccaacacctatcacttttgtctgcatcaaaatcacttgaagcattcattacaacacagattactgggccctgcccccaaagtttctgattcagtaggtctgagggagggtctgagaatttgcatttttagcaagttcccagatgtgctgagtctacaaaaatgaaaccttacttgtcccttttgtctactgatgcacagggttctgctcccagaaggccctctgctcttaaagtcttaaaattcttaataattttatcttttgatgtatgctttgtaagtaaagaccaatgagacaatggagcatgcaccaggggcttgaagcctctgctcatgagcagtctgcctcccacctacctctcacccaggcgatgacttagtttgttgggagagaggcattccactttcactttccactgcttttggggcctggagtatacatagaggtggtcggggtcaggcacatgcctggtgacattttggggcatggaagcagccatccttatcctgagttggtagtacttggtgactctagcatgtgatcggccaaccagaggccatgtctcagattgagagtcttaaccagtcctgttccaggtagctagcacttcctagcaaacagttttaaagactttctgggagtcacccctcttctatggtttgaggtggcaggatggggtcttattgctgtaaagaggagaaacttagcagccatcagactcaaatgtacttaagtaactgaagtcatgtggtgagaccctcagatgcctgtgaaagtctgcagtcatcttgcaagcattctcaagctgcaagagatatccccatacctaagaatgtgctccctcaggtctggtctggacttgaatgaccctgtcttccaccttccaaccttcctgagactgactggtttgtctcttctggccaactccctgtgaataatcatttcatagctctggagactagctattgtgtttttgctacagttcaaaatagaggttaaatgttcttatatagaatattatgaataataaaaaaagttaactttcctttacatagaacataaatagcaaatataaaaacactaaagagatagaccacagaagaaagaaaaaagctttataatttgcaaccttcaatggtacctcttctcccaattttttttttatatgttttgctcatttatatgaaatccaagagcaggcagtattaacatatgacagaataaatgagagcaatggttgccccctgagaggctgcctggctgcatgtgttcagtatgcgggttcacaggcagtatatgcattgctctgttcatttttcaaataacaaatcagtttttagctgtgtgtctcccttcaaatctccactgtttcttctgaattctgtagggcaccacgattgctttcctaacctctaggagcatcccctacctactattgcaactagcacttgtggaagtcagtgtggcgattcctcagggatctagtactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagtctggattaagaaaatgtggcacatatacaccatggaatactatacagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaaggaattagatttacagtgacaaagagaatggtggaggacaatgagcacataagagatttcaaataaaaccttgaagacaaaaagtggtcagaaaagtgctagttctcccaatttttgaacaaaaagtcccccataatttgtaggcctagtgcattttcattttgtgctaggcccacaaattgtgtagctgatcttgagtatataagataaaatagaagtttaaaaatccataattaagactgaactggagtagtcaggaagttaataaatgtttattgagcacatgacatgtccagatattataataagcactgaagataaagtaatgacgaagtcatacgaagtttctgtcctcaaagagcttacattctagataggaattgagaagttccgtggaagttgagagacaattaaagtttaaacaatgtatgtaagggaaaaggaaagcaaatatctcaggctccttaagactccaactttaatataattcttcagcctcactggaaccttaatctattgatcctaccattttcattgtcattcacccccttcatgttccccctttctaactttaatttcacagtcaagctctataatgcttttctttcatgcattgtcaactctcttgcctcctttttgctttgtttgctttgtcatacttattcagcttaatctcaaacctgattaaattcaactctacctatcctatttctagacccatgtagctgaatatggctagagaaaaatacataaccacactaaagtgtctcattttaccataaatcatcactaacttcaagtgggctcttatgctgctaggtaatcatactatattttcctagtccttgcccctgcactcctggacaacaattgcatattttcttgtttatccttttggttgtgtgtgtatgtgtgtgtgttttgttttgttttggtatagatgaggtctcactctgtcacccaggctgtagtgcaatggtgcaatcatagctcactgtcgccctgaactactagactcaaacgatcctcccatctcagccacctgagtagctgggactacaggcatgccatcatgcctggctaacaattacgtattttctctagtctctttaaatctccaaaacttgcttttctgtcttcaatctcagcaatcaccatgtgtcctcttttattgagaaaattgaaacaatcagataaaaacttcaacagctatcatcacatctaccaacctatctgcttgtatcttcatggcctgcatattctctcctgttacagttactaaactaagcttctaactaggtgattcatttaacagaatcattctatctcctggcctatcctaaagggaatcaaggttggaagcagggagagcagtgaagaggttaatacaatagtctggatgaaaaatggatagaggcttgtgtgaactgtgtggtagttattcactatattccacttatactctagactctgtttgtacactagactccacttatatactagactttacctgctttcacctacttaagaaagtcaatccagcaatttttcctttgtttcctttataataaatgtttttctttctactgaatcattatataaatatattgttatatcttccattaaaaaagagaaacaatgggttctaggctgtattagtcatgggcaatatagtagtgaataaaacagacaaaagtctttgccttcataaaacttactttctatggtagagatagataatatgtgtgataaataagtaattatatgggatattagacactaataagtactaaggaaaaaattagagcagaaaaggagataggaattcttggtcatttctcaggaaacatcttatttgacatatcagcaacgtattacacaggctaccattcctaccttaaaacacttcaaattctagagtgctattttcacctgattttcttcctaccttctagctattccttctcaatctctttagcttgttcctcctccatttcagtggacttaaaccagaatgccccaagactgattctttgaaacttttctctttatattgaagcactagatgaattcagccagcttcatgcctttaaatgtctgatggatcatacatttatatttatagtctggacctctccacaaattcctaacatatatccagctatttgatatccatttggatgtttagtaagtatcccaaacttaacatgttcaaacctgagctcctggtattcctctcattcctctcacacttttctacatctattaatgacaattccattcttccagtttctcaggtcaaaaacactggaatcacccttgacccccatatttctttcataccctaaatccaatttgttaacaaatcctgctggcacaacctttacaatacactcagattctgacattgctcaccatctgtactattaccacacagttcaaccaagcctctatccatttttcacgcacactaatacactaacctcttcactgctctccctgcttccagccttggttccctttaggatacacccaggaggtagggtgattctgttacatgaaagttagattacatcacttccattctcaaaatccttccatctcacgccaagtaaaagtctaggtctttaccatgtcctgaaagaaccaacatgatgtggctctactttatctctctgatcttacctcctatgaatcttcttggcattctagaaagtcaagacctataaagaatctgagattttattctacttgtaagctaataaagttaggttgccagtttcgatgctgatagaagacatgaaactcctggctcagggacaaaggataatttattattcacaacagtcatagaatatcagtattttgtgctggtttcctgaaccctaattcccacaggatgatgaaaagaagccttcccttctttattagtttgctcaggctgccataatgaaataccacagactcagtggcttaaacagcagaaatttattttctcacagttctggagactgaaactctaagttcaaggtgccagcagggcagatgtctagtgaggtctcttcctttgggttgcagatggctgccttcttgctgtgtgctcacatggcctttcctttgtgtacacatagggagggggagagagagagagagcatgtactctggtatctctttttaaaaggacactaattctatcagattagagccatacccttatgatctcatttaatcttaattatttccttaaaggctccctcttcaaatagatccatagtgggggttggggctttaacatatgattttttttacaagaggttggcaggggatgcaaacattcagtctataacactatttaaaatttatctaccttttttcaagaattcctatcttcttttctgctttttttccttagtactcattactatctaatatcccatatgattacttatttatcagacatattatctatctctaccctagaaagtaagttttatgaaggcagggacttttgtctgttttattcaccactatattgactatgactaaaatagagcctagagcacatagaatgtacttgatactgtatgtattgattgaatgaaggttgtagtcggcaaggctggtgatttgggaaagctggagtaaagtacactcctagccagtgagttcttctttaagaggaaagtcctaattaattaagatcttattattgaagcccataagtttaagcatactttgtaagtgtatttctgaagtagtagctgcttatgatttagatttacttgagttttttccagttggaaaagattaaagaaagaattctaaacgattaataatacattgtttggaaaacttaaaccctgtataaacctaatgaacagaatataatcaaagcatttatgactaaaaattaagaaacaaagcagctgttttggcaagggcagcttattgagaaattcattttgatgctgaagattgtatgcaatgagtataagtaaaatggctttcaaaatgtggatttcttgtctttttaacctactgtcagccatctctaaatcaaggatgaaaagatatacttagaaaagtctttctatggcaggtagttaggaaaatgtggttttactgaacagcaggatcaatcctaggttaattttaattaaatcattcttcagagctgttggcatttttccttcatgggagattgggagagatgttcttttatcccttaacccttaaactgcagcacctaaacctctactcccctagcctctgccgttacccttatatacatttatagatttcttagttttgaagtggatttaaaaacacaactaagatattagatcatcccaatatactcttttcaatttgataaattttaaggactttgtaagtactttctaaatgaatatacttttatctgtcacccttcccttttcaagtctctgtcacatgtacacccttgagacattatcagtctaagctaacatactttctctgcatgatgtaaaaggacaaaggaaagaaagggctaatagggtactgcttagggaagattctggaaatatccaaagatcaatagagcccaaactacctcctaagctttatagtatattgtcctccaagactggtgaaaatcacctataggcaataatctggcatacattgtcaaccttggagaatccaggtgagtaaaacccctttctgtgtaaagatgcaaaagcctacctaagagctgaaggtaattgttttgtctttttcatacaattaaaattgccaccgtgaattccagatattgaaatttcttcttgtttgattttgaagaaaaatcaagcattttctagcaaattagtctatgaaataagaaaatcaaataagattgtgtgattatttttcagttgaagttatttcaataaataaaatatgtacatttttaaaattttcttttttataaaaggactttaagggggactatatagtataatgaaagaatcgtggggtaggaatcagaaaaatctgagttctaatctaggctgtgacctaacttgctgtgtgacctggcccaactttcataatctttctgggtctgttttttcttcttttttaatataatgagagggtttgaccagttgacgtcttaagttccttttagacctaacattctatgattccaacttattataacagatgagctcacaaatctacaaattcatatacattagggcaatattatgactctataggtataaattatcacaatgtaaaactttaattccctatagatgctttagaatgaatttgacatgtcagtgatgtccaattgtttttataggtacattcctctcattgaaaggagctgtgctaacattctcctgtatggaccgaatgggtggattaatgcaaccgccatatgaagtttggagggatccaaacaacatagatgaaaatgaaaaatcttggagaaggaaagtggtaatgaactcatcttctgcatcccaagaaataggagatcatcagtatacaataatctgctcagaaaaacaagccaaagtcttctcactgccttctcagacttgcctttatgttcataacatcacggagacatcttttatactgcaagcaaatgtggtggtcatgtgtagcagtgcctgcttggcatgcttttgtgctaacggacatatcatgataatgaggtacttgccttcttataaattatctggtaatcacaacaataccagcaaggtacaatcctaaaaaatatatgtgttatgtgcagatgttatcaagaagcaaactgagattattgtttcattatgtttctggatgttttattgttcaacgatttgatgagagtttgggggttttgtgttttgttttggtttttcttttctgctaaaaatgcttggcattgtgagtgaaatatatttttaattgttttgaaggaatctaagaaaagaatgatttttcaatcattcaacaaatatttattgagcatatctcccagatgctacactaagcactggaaataaaagatgaataagctaaatagaaaagaagttaacttttacttttcctgtgtttgatacttcacccaagaaatttacatacagagtttcatttgatccttagaacttctctaggacataggaaaataaactattatttgcatcctccattttacatgtgttaataaagttacacagtttgcctgaggttgcaagtctaggaaaagtgaggccagtctgataattaaaagttatcagatacttttaaaataaaatattggtcaagagatttcattctactgttagtgaaatgaaataaaatttacgagacacaaaaataattacctaatgattttatgaattcagcaaatagctcataaacgtatactatatagaagtcactgtcatttttttaatatctcacttatttccaaaaatcattgagatgagcactgtgctaggcctgtgaaggatataaaaattagtagaacatggtcctaacccttaagaaactcactgtctaacttgggagataagatagatacacagacattataacaaaaagaaaatataaattccaacagaggaaatatgggattgaattttctagccacaaactaagttcccagagttcaaagtcacagcatagttgaacatgtattataaatgaagagttgttgggaggacagtaacatggagaggtagtttgaagcaaattgttgacgaccttgaatgtcaggctgagtttgacatttatcaattaataggaaatggggttttaagcaggtaattaaccttctctagccatgtgttaggacatacacagggagggagaagttgagataggcttttgaactgaagtggtgtctgtattgaaggcaacgaggaaacaggtgtaagggaaacttattgaatgcaaagctgattggttatgaacagtaatggaagttgttaaatctcgaggttagaagagagtttaaaggttaaaaatttttttgaacttagataacggttatgttattagcatataggaaagtcagaaggatttgaaaaagccaataaagagaaatttaataataaattgagaataaatatttgaaattttaggtgttataagccatccagcagaggtttagcaataaatttaagatttgcactcttagaaaaatatatgtggaaggtccagctttggaagtcatctatgtaaatgcatcagtaaaagttatgtcaggaaatgagataataaaaaagatagcataaaaagaaacaagaaattgactgagctgaggatagaaacttgggggtattctacgtttatgtagtgaaagaaagaataagatgcagcaaaggagattgagaagttattagaaagataggaaaggaccagaattgtataacttcattaaataaaaagagaagaatattaaaacaaaagaggttgtcaagaggtagtaaaatatagcagagaggtcaaagaatttgggtacaagaaaaaaacagtagatctcacaactggtgggatattaatgatctttgagaaagcaaatcttagcagcatggtggaaacaaaagctaattttcaaggagacaagaatagaggcagtggtatagatcagggtttagcaaattaatatccaaaacaaaatcgacctccattcccctatctgattttgtacagcctgcaagcattaagaatggtttttacatatttaatggttgaaaaaactcaaagagaagaatatttcatgatatgtgaaaattatactaattttaaatgtcaatgcccataaataaaggttttggaacacagccacacccatgtttctgtatattgactatggctgcttttgcactacagggcagagttgaatagttgcaacagagactatatagcctagagagcctaaaatatttactatcataaatatttatgggcccttttcccctggtattgattattctttcaggaaattttgtggttaaaagagagatgagacaggaaagtcgcttaagagtgaaactaggttttgagagtgtttttttttttagatagggaaaatatgagcagatttgtaggtcaagggaaagtagtaaaggagaaaattttgaataaaaataatcattttatggtctgttcattctctcatgtatttctgattcttttctatctagttccccctttctcaaactgtttttagaaatttctgataaggtcatttcaatcttgtttgaaaatgatttaactcccatacatgcctcagatttgggggggaaaaaaggtctatttgtgtatgtgtgtaaatgtgtgtatctctcacacacatacattgagtcattgataaatggtatctgtcttcctctgtcctttataaaagctgcttgacatgataatggttactttgatattgtgtcatagtagaaattcttcatgtgttcctgaggatcctcaaaaataactgaaaaggaaataattttgatatgattttaataatacatatacataaagtgtagctaggaaacaatggtatgtactctgctctatggtttaaagaaatgaatcctacaaattagcatgcacctggcctcattcattttcccatactgagtatattcccaggatctttccagaccctatcagaaggtaactctcctgagcccagtcttctcaagtcctgggtttctgatagatatcaggtagctagccagtggttacttagatcctaagtacccagactcagaaaagcaagtttgagagtagagaggagaaatagaagaggcttatctttgtatgaattctcaaacttggctgtaagagacactttttgtgagatccacctttagttacccgacactatttctttattaaagtgtcctgcatagaagaaagtctttttttcttctgttataagagcaattgtttcctagcagttagcaactgacttgctctttctcttttcctacctgaagtgactacacctctttaattttcttttcttggcttacttgttattatacaatatagacaatgtagcacatcagaaaagtcagttggaacctcttcctcaactccaccctttaatttgactgaatctgtcatggaaatctgtttaactgggattggtttggactcatatcttaaggagcttagttaccagaagtgctataacagatcatcttttaatatctttttaagatattaggtaattctttcatcaatgaagcttttgaatccagtgtgtaatttacgtttacagcacatctcaattcagacgagccacgtatcaactgctcaatagctacatgtggttactggctaccatattggacagcacagtgcttagtccaatagcacagatttcaggtcccattttacatagtaaatttccaggtctcaaagtatagttacaaaccactttgataaaggaaatcagtatttttttcaaggtgctggttttatgatctaggacaatgtaaaatcattgtgcacacttagaatcagtataatggtttcaaaatttaattacaagtttaccttttcccttttggcattaaaggactgattaaaaggcaatgagactggttttcttcagtggtttgtaaaactggctcgaaaaacagtatccaaaaggacattctgatgaatattttagcaaaattatctgctacattaggataagcatatagccatggggtaagacaattcagatggtattcatttggatgtgcaaattctgatctattatttataacttattctcattcccttacagtcttggccatatttacttattagtcatgcctccagtgcagttgccctaagttatgggtaattttcatttcctgtgtatagagtgagtaaaggaatggggagcaaaaccacttcatttccaggcacagtgaactggacccacaacacatctctgtcagttttgccttaaagaaagacaatagaccaagtatgcagtcagacactttctagctgtggtgtttctgacatagccaaaggctgtcattgtaggaacatgtgaagtgctacaaaaagtgcccctgaaattgctggccactgcatttaatccatcaagaacatttgctaagcatctatgtgaattaaaagaactgtgcctgtgatttttatgattttatatgaaagtctagtttattggatcttaagacccatgtccaggaacaggagtcagcataaggatgctgacctctcctggctgtgcctgtgactccagagtcctgtcttactgtgacttaaagtttgatggagagaaaactgtaggatccatttctgccaggaaaccagggtcttcctgtttctaacactgagaatgggcacccagtggtctgagaacactttctgggctaacaaggtcctcacacagggctgagaaagaaagtgttccccctcctgggaagcacatgtagaagttaagagcctgaatctcttctaaaccaataattgacctctaggcacccaccatactactgctaccttcagggcagaagacactactctttgtaacccagccaccaccaaaaagggaacaaaaggaaggaaggaaggttaagccattggataatactgaatctgtttccctagtgacttagtcttagagcaagcataacatccaggttaatttttgtaagatttctccttttattatcaccctcatcatagttcccaattatctcttaaagtttaagtggtttattgacattagtatttctgataatagtttacaaactactataaacaaatttgtaaacattactatttctgatgaaaataaagttgtttctccctccaaaaaaaaaaaaaaaaaaaaaacaaaagaaaaagaaaaaaagaaagtctagtttattaccactgagccttgaagataagaagaaacaaccaggccgagtatggtggctcaagcctggccaacatggcaaaaccctgtctctactaaaaatacaaaaattagccaggtgtggtggctcacacctgtagttccagctactcaggaggctgaggcgtgagaatcacttgaacctggaaggcaagattgcagtgagctaactccactgcactccagcttgggtgacagagcaagactctgtctcaaaaaaatataaaaataaaaaaataaaaagaaacaaccataaaataatagaataaaaattactgtttttatgtaaatatctgcttctaacaacctgcatatgatatatggatttacttttttccattcagcctacctagtcttcgcccaatgttggatgttaattatttgccactgacagacatgaggatagcacgaacattttgttttaccaatgaaggacaggcattatacctcgtctctcctactgaaattcagcggttaacatacagccaagaaatgtgtgataatctacaggtaggtcaggagttacatttatgaaaaagacattggacatggttgagagaatgagaaagatgtctaaaaacaaaaatattattaggtcagacaataattatgcccttccaataacatgttttgaatatatattcttcattttgagcctaccaacttctagtatggttctaggtattgcacagaaataataagaaagagggagacaatggaaagatcattcatattaatagctaatctttttgtttattttattgtttttgcctatggagaatcttataaaagattataaactctcccctcagggtggaaaatatgtatgtaaacacaaaaatttctataccattcaaggagttcaagaactcttgaagaaaccttgtgattaagggacacacaaaataaacatatatcctgtgggttagaattgagcatttgtcttttattgtagcagtaagcatagcctagaaacaggatagatataaatgtctaaccttctgtaagaatggtcacaacattttttaaaagcatcttggacatttaactatttaacccccctcattttacaaataagaaaactaaaacatatttattataatacaggggttaagagcataagctctgaactattcgagttgtattttggctcctccatttctgtgactttgggcattttacttaacctatctgtacactctactttggagcattgttgtcagaatttagtaagaattcatataaaagactgagctcagtgcctggaatatagtatgtttttttaaataaataataataaatattactatcatcaccattgtcattctacagataattattgagtttttttctatatgcctaatacttggctagactctaggaacatgctaataaataagatacaagtccctgcctgctagtgtggagagacagaagtaaacacaatcacactactctgtggaaagtgctatatatggctgtgccagtactggggagacatataagaaggacacctgggttgatggagcagaagggaggtggtttaacccgttgactctctaacatgctttttaaaaattttgtgaccaccctcacttaaggttaaacttttacagctatcctgtttctagtctatgcctactgctacaatcagagacaaatgcccaattctaacccactggatatatatttattttgtgtgtcccttaatcaaaagaagttagagaaggattatgggcacaactgacttccaaatggtaaacaggagttatccagttgactgaatggttgggcatgaaaaaggtaagatactttagacagaagtagtggcatgcaaaagcctcacggctaaggaaactgccaaaaaagtgcagaattgggagtggaggtgttgtgctggagaattagtcgagtagatcttgcagccccttgtaagctacctaaggaatctattatagcatttatcccaagggcagtggtcattaaaaagttttagcagatttgtttattaaaataaatattctggttatagtatggcagttggttttcaggaagcataaggatggagaaaagttagcagattcaatagccataaagtgtaatcaactggatttagggttattagataataggagtggaaaggaaggaattagtcatttctcggtttctggcttggggaaccaaatagatgatgttgccatttccaaagagaagggcttcaggaggaagagcacaggtctcagtagaggtaaagggagatgatgcaattaaaatcatactggaagttcataggaaaccaatattaggtcacagatctcctgactcagtctaagttcctttctccacactgatggttcttcaactttggtctgctttagaaaaagctggggagcaaggtctggtaaaaatgtagataacgagagtacatctatgtagagtctgatttcatatatgtggaatgcagcctggatatctgcatttctaacaagcatttctctagtcattgtaaagctcaccaaatattgaaaacaaatgtacttcaccctatacagtagctgcctattttgactcgtttaaattatctttaatcattttatagttttgtactcctacaaaaatagatccaaccttccacataccaccaaagctgtcctatttcatagggcagtctatgcttggttcagggaagggtaccaggataaaaaagaagctatagtgactgaaaaaggatcagaagtctagtggtaattattgagcacagatggaaattaatcctagggtagctatattagcttcccatgctttgatggaaggaagaagagaagaggataaaggaaaattttagaatgtttgttactatagaaggggaggaacaaaagaaatgccagagggagaactgtgagcacagcaaaaatcaccatgaaaatatatgaaaagcagactgttttttcatgatgtgtcctactatatcacagtgttacctttttgtatattaattgattttttagttgttctaatgcttttttctgtgaatttgatgcaggacatgctaggagatttgtttactcccatagagacaccagaagctcaaaacagaggctttctcaagggactgtttggtggaagcggacaaacatttgacagagaagagctctgtgagtaaattcctgattatagaaatgtattgcaaaatagaagacgtttctgtgtatgtgtatttgtgtgtgtaacttaatgtaatatgtgatctcaaattctagactacgtattttttgcatctatcttaaagtttgaatatttgtttccttctgtaccataaaaatcatttccatttaccaacatggaaagtggtcacttcatattaggaaattgtttaacaaaagtgatacatataattcatacaaataatgagcaagctaataaatatctcatttgcaagtagatcatacctgcatggcaatgtgaaggtattcaaaaaagtctggaaaaaagatttttgaatctgcttgactttaatcactgctggaaaacagattccttattcagaatgtaagatttataaatcctacagaataaattactttaaaaatctaccagtgagactttgataaacaaaatcaaaaagtattattgtttatcaaagtctcactggtagatttttatttatttatttatttatttatttatttatttattatttatttatttatttgagacagagtcttgctctgttgcccaggctggagtgcagtggcctgatctaggctcactgaaacctctgcctcccgggttcaagcgattctcctgcctcagcctcccaagtagctgggattataggcgcccaccatgcctggctaatttttgcatttttagtagagacgaggttttgctatgttggctaggttggtcttggactcctgacctcaggtgatctgcccacctcaccctcccaaagtgctggaattacaggcatgagccaccacacccagcctcactggtagatttttaaataataggaagatactagggaaaattttcagagagaaggtatgaatatattttccagaatatcctaccatcatttggtcctatagatcaaaattctctttctctggaacttttatgcaaaaacatctaggttccttcatacaatagaatattatttggccatgaaaaggaatgacgtactgatacatggtacaacatggataaaccttgaaaacatcttgctaagtgaaagaagccagacaaaaaaaaggccacatattgtatgattccatttatataaaaggtctagaatgggcaaattcagaaagactgaaagtagattaatgattgccaggggctgaggcacagaaggaacagggagagactgccaatgagcatggagtttctttttggagttatgtgtatgttctgcaatcagatagtggtgatggtcgtacaactttgtgaatacactaaaaacaagtgaattttgcactttaaatggataaatgttatgtgaattatatctcaataaggctattattttaaaaaaattagattccatccactcttattttaaaaaaaatctagaatccattccaatattacatccttgggaattctaactaaatttctgccaaaatagctgtttttttttccttaaaaataaaaataaaaataaaaaaagaatctcacttggctgcccaggctttagagtaaagtggcacaatcatagcccactgcaaccttcacctccctggttcaagagattctcgtgcctcagcctcccgagtagctgggactacaggcacatgtcaccactcccggctaattttgtacttttggtagagacagggtttcaccatgttggccaggctggtctggaactcctgacctcaggtgatctgcccacttcagcctcccaaagtgttgggattacaggcgtgagccaccgtgcccagccacaaatttttaacatatgtaacttatatgggtaaatgttatgtttgttttataaatcaattttttaacacacataaccatcattcatatattcatataccccatttttcagtatttacagagagagagagagacagaaagagagagaaagagaacctgtggcctacaaaggcttatacatgaaggtgaaccaagaaggctgaaataaaaactcaggcagaaatttaagcaaatgatcaggcctaagcttggaacaaacattaatatgggttaaatatgaagtcacatatttgaatattccaattcagcatcaagaaatgcaattatgccatattgtatggaacacacacacatacaaaaggcctatgataacaatatatctcacagtctctttcttagcatttttcttaagtgctaacatctccaaatacatatatgactggaccaaataagactctcttttaatgagaattatgacagtagaatgtaatactagtactttgtcttggtgacaagcttgactgtttgaattactgacaaaatgttttaaattgctattgcatatattctcagttggggaagcttcggcaggaaaagcatcccgcagccttgcgcaacacattcctggaccaggtagtatagaagggatgaaaggcgctgctggaggggtgatgggagagctgacccgtgcacggattgcacttgatgaaagaggacagaggctaggagagctggaagagaaaactgcaggcatgatgaccagtgcagaagcattttccaaacatgcacatgaggtaaactgcctaagtaaatacagacatcttcatacaggagtaactttaaacatttaggatctgcacaagaaagcttaaacagagatccacataagtaatcctgtatgagaatcatggtaacctagatctcttctaagtattataattctcccagtgcttgggagataaaaggttttttaaaaaaatactttaatgtatcgatacttctttaccttaggggataattaaagaaattatccattggttctgatacatctgggatccacatcctccattttgtctcagtcatgaaaaatcattttctatcagctgagtctttacagcttgtttatttttaaaatctttctcatatgcactttatttcacaaaataaaagaagccactcagtttgattataagttttgagatagatttgcatgattagctcaaaatggccttgctttgaatagcacttttaaagtattttagcgtcttatggtggctattttttctttgcagttaatgctgaaatacaaggataagaaatggtaccaattctgacttctaaagaagctgtgactgctttgagaaaccatattcagggaaaccaaatttattcccagcatcactactcaactgctagaagccagtttcttctacaaaatgttccatttacagtcaatctgaaattttcataaaagagatgtatcagagacactgtgcaacccaaaggctggagccctggttaaaatcccaaaatacggctgaatttgccttttcccatgtggaatggagctatcatcttggcatgtcattcgataaggatttatatttagtaactacggggagtcctcttgatttgaaaattcctgtacaaacaaaagcattaatgcacttaatgaaaaaaaatctttgcatgataaattaacatcttaaggggaaaagaaaaaaaagcatgttgtgatagaagaaaaaaagattcatggtaaactatttctatcaattgggccacactcaacaatttaaaaaatctgcatttgaagatgtcagtgcatttcaaatatatttgccatacccaactgaaacggaaaacaaaacaaaacaagaacccagagttttctcctcatctgtaactttcattgtactagaaccttattgaattcttatggcaagagtctgattaatgttctctctccatgttttacatcattcacagttgtgtcaaaatcaaatattgccagtatagtaaattattcccaacacaatcagtttcatttctatcaccttcagaatgggttgctgtttttagcacaaaccatgcagggttgggtcacctcaaagcattttcttcagcctggcttgtactctataggggagttggtagtaggtgtggggaatctataggaacaatagagttagctatgagaactgacttcacaaaaagggaaatttcacacaccccaatttcagcttctaaagtgatatattttaaaagcttcatttgtatccttgtctgccagttacacagtatattactgttcaaacccagtagggtctgcaatcgaaaggtgctcttgcagcctgacattcacaaaccaaactggtcattctctttagtgtgattcagtaaaatctcagttaatgttttgggaaagggattctgatttatgacatttctgatttacaagggctttccttagaaaatacctttcggtttgatacttaccactggaaattggttcgatacttaccactggaaatctttataaaatatagtgatctgtttgctatcttggtctcagtcatcattatagacaatagaaatacataaagagtttaatgatacaaaatcaatgcttttgtccctaggtcaaataatataagccactagattatgtcaatagatgccaaacacttgtcccttattaaagactcttttaaagctggaataaagaatatccttaacatgatacaaggtatctataactcaccagaaaagcaccagagtcaaaaccaaatagagacacctactaccatttaacatgattctggaagtcaaaagttataggaatgtatatatacacattccaggacccatcctgtaatatgttgtttcgtcaagaaaagttttaattatggttttggcttattgaatttttgtttatcaaggtctcattggatttacatttgtgtttcttaagacttcacaattttcctggatttcaggttattttattagccaaaaaatcgtatttttatttcctttttagtctaattttttgctagaagttgtactttctagcaaatgtttctagtggtacaatgttctcagtaattttgaggagaacaaagatgagtgaaagagttagataatgtacactaggatagcatttctcagagtccttgaatcctcttgttaagaaagcctctctgaatctcccagactcctgtgaacagccttacggtaacagaatctggcttggaaacacagacattacatgactgtataatttatagaattataaaattatatggtaaaaatattaaagaaacttaagagtaggatctagaaaatactagtggccaaattgcaatgtattctttgtaccatctgtttcaaagacttagttttctgattttcagaacaaatactttatcgtttctgtattttaaaaaaaactaaaagagtaaaatattagtttattttagaaataatgaaattcagtccaaagtagcagtacatttgatgagtatttctgaagccttcaataagatttaacttgttttaacttgatctacatcgagatttctcaaaagcagcactattagctgaaagtctttgttgtggggaactgtcctgtgtattgtaggatgttagcaacatccctggcctctgtctactagatgccagtaagaacctcctagtaatgacaatcaaaatgtctccagtcattgccaaaatttctcccagttcacagccactattctacatcatacaaagaggtagattgtgtgaatatgtaatatatgttgttgtataaaactgtacaataagtatacaatgtcttagcaagataaattattatacccaaaattacatgtgtggttcatatgcaataagatacaattttgaagaaagcttataggaatcagtgaaaaataacaactacagaatattttaaggcacacagagaaaatatcaaaaaggacattatagcatttcactgtagaagtgcttaaaaccttggcctcagtgaatagatcaaaagtttataattagcacaccaattggaagtaaacaggtgcttctcaaatgcttgaaaagaaaaggctctttgaagtagttaaaacgtgtctttcaaaattgcttttataagcccttccttaacgtaagggtaacttcatctcacaaactcctggttagtggaatccaaattaatgaggttttactgtatcaaaattatttttataattcaaagagatgatagcaataagaagaatctaatgtggatgtgatttttctctttgaacaattctgttctgttgcactgaccttagcacgcacgcacacacacacacaccatcgccaccactaccatcatcatcttatcctcatctttggaaaataagtactgttgatccatgtaatcctttgcatagtctcatctttactatctttcttctatttcggaacataagaaaaatactcctaataacttggacaatgatacagaaagtgactctgagccttagttaccatcaaaattacattctatctgctaaagcgacatcagaagataaggcttgcaaaccacagtcccaacaagttgaccttgtctccctatgatttccttggaagataaggcctttttagtgttacagtagaaaatgggccttttcatttattcatctgtgagaagctagaggtatttgtttccctgataataacgtgagcaatagtccctaccttgaaatcatccattagtcttggagtttggagggaggaatgattgattcctcatttgttttaatcacctacaaaagcagtactactgactttgcttcttacacttcactgagccccagactttagggccccaatcattgtcaagatcattgtctaactggaactctgaaaggacagtgacagaactgaatgagatgttttccagtgattcagtcacaaagacaattttctcagatcttttgaaagtgattctcaaataaataaatcaaaatccaactcctttccctcaaagtttctagggatctgaaggaaaaggtttactgttggagtccctttttatgtgacccatgtaccagttttaaaggcatcatctatactttatctacatgaagggatcaccatgactttgagagaaaaaagaatcagattaggcctaacattggttgaagaagattaaaatagattcttatattcaagcagaagggaaaaatgaagccaatctagaaaagtaagctaaaaatcctctccttggcttaggatcattgggtcaaactgggagtatatctgtgtgattacaacctgctgctatgagaaaaaagaattgtaacttgaccatgttggctcacacagggcaatgcaaaagaagtcaaaacattcatatcaggtcttggtatctgtgtcaggagaaacgtggtggctttcacagcttcttcacctctgtcctctgtcatgcaactccatttttggctaggtactatttcacatgcacactgtcctgggtgccagaaatacttgtggtgtacttggtttgagcagtacctctagtatgcaccattccagggaacatggttgtcaacataacaagtttagtgtgtgtatttgcagacaacatagccctgaaagcatgaaatgtagaataggtaaggtctgtcttagaaaaggaggaggaagtaccaatttggtgcaagaagatcgtggtgaggaaggacatgggagccacagtgaagtgaaagaggctttaaggaatcagatgcacagatggatgctttgatttacacatttatctagaggagtgattctcaaccttgactgtacataagaatcacctcaggaaatttttaaattcccaattatattaaaatcatttggagtgggaaccagacaccaatatttgcgaaagcctccaaggcggttctaatgtccagccaaagttgattatcactgctttatggccaactaaggaaaccttgtttgtctgccttggctggtgctccagccccagttctgagtggtcagggaaggcaagatgtaagatatagtaatggtatttattctgtatgtctcacagaacaaaagcatttgagaatttctgaccaggcagtgctccatcaactcttaataatcatctttgtgatattctcctatgtgacttgtccatcaattattccaattcaaaggtctaggttttttttcaattgtcttacacatgtgacatcacaagataccagaagtagcacagtaaattcaagagcatataaagctaagtggaaaactaattcttcatatttagacagtggaaattctcaaaacaatcatttgctaaattaggtccaaatttattattcattcttcttctggaggagacatgggtaccaggtacctgttctgctgtaggtatatttcactggacttggtcttagcaaaaaggaagaacaaatcttcctttttgattgttatctcaatcaaaagctcccagggccacttggatttattttcttagtctttggacatgtgtttaaaggaaaagaatacctgtaacttcctatatgacatccagtgccctgaaagggtgcttacaccttcaaaaaaggagagtccagcctatcaaaggcagtaacacataatgagaagaaactcagagttattgcctttcatactgctttccctctgctgttggcccacccttcttgactgcaaagccagaaaataaactagatggtggttttggacaattgtacacaggaacagaatctctaataacctataatttttagtacttaattatgtgatgttttattctaggaaataagaaacagatgacatcattgatgtatctttctttcatcttcagaatttttgcatcttttcagaaaatgacaaattactatttttctgttgcactcagcaattgtgactatacttaacaaaattcttgtagtctgtagagatatcaataaaattgtatatgtttgtacata

SEQ ID NO: 2423 - DNA, 325489 bp, Homo sapiens
gtcagagctttgggggaatttattgagagcaggttttgcgtaccaaaagggtgttgggcttgcatctgtcattggcaggtgtcactgctggtggtctctttactgccatcagttggtcggccagactgcaacaaccacgatagccacaagcagcagtaaaatcaccatgatcatccctggaaaaaagcagcagaaaatactacttttaatgattcctaccagaaaagcatcacacattctgagtgtctgcagagactcagagggatgtagttccctctgagccttcagtttgtacgaagtggagagaggtggtcggtggcctggggcgccgctgctgctacacagctctggctttgcaggatgctgagtgcagaaggcaggggcctgggtgtggccaggcccccccaggcagcactcaagccaggagggggtgaggcccctaactctagcatctgtgtacaccttggaccacaagggagggcgcaagctgctgacgacagccaccctcactacccaatcagattatgcattgatgacgcattgataaagcaaagggcttaggagagcattctagaacccatttctccattctccacatggcttcactttgtgttcttgagtccaagatccttaagtcacccatttgtaaaaatattcaccgatagaggtgcttgttttgatatatactttttctgctagtatttgctagtttcatttcctgacgtttttggctggagagcacaggccctcctagccagcccatgctgggtgccactctgccttccagccccgccctgcctcctctgggtcgtgtgtctgcactgaccattgcctgttccttcacctgatgctgatgaagtgggccccacagaatgcagccctcacttagtgcaatgagctcactgtctcccatgttcgcttgcccagtatttaacgagtgtttaccacgtgccaggtaccagcggcgacaaggtatagcataacagagaaggggcgccctactacaaagtaagcactcaagaaaggtttgctcactgaagagtccttgagctgccaaggccccacgagagaggtgggtagcagaggaggagaggtccatgaaaatgcttcagaaagtaacagggagagccacgtgtgcagggtcacatggttgcacagccatcaggactgctgaacgccacggtagtctgtggcatatgttcgtgagcaaagaaaatgctaaatttcaattagacatttgtgaacataagagtccaatttgctttccggtccaagttcacgggcttcccgaatcccctccacagatcctcagggttcaatgtggatcaggccataccaatcttaagctcaacccatgtgggcactgcaccatggttttgaatattgaagagacttaaaaatgtatggcaagtggctgggtgcagtggctcacacctgtaatcccagcactttgggaggccaaggcgggcggatcatctgaggtcaggagttcgagaccagcctgaccaacatggtgaaaccccatctctattaaaaatatatttaaaaaaataggccgggcacggtgcctcatgcctgtaatcccagcactttgggaggccgaggcgggcagatcatctgaggtcaggagttcgagaccagcctggctaacatggtgaaaccccgtctctactaaaaatatatttaaaaaattggccgggcgcagtggctcacgcctgtaatcccagcactttgggaggccgaggcgggcggaccatgaggtcaggagatcgagaccatcctggctaacatggtgaaaccccatctctactaaaagtacaaaaaattagcctggcgtggtggcaggcgcctgtagtcccacctacttgggaggctgaggcaggagaatggcgtgaacccgggaggcggagcttgcagtgagccgagattgcgccactgcactccaaactgggcaacagagcaagactctgtctcaaaaaaaaaaaaaatattagccaggtgtggtggtgggtgcctgtaatcccagctacttgggaggctaaggcaagagaatcgtttgaacacgggaggcggaggttgcagtgagctgagatcacaccactgcaatacagcctgtgcaacaacagtgaaactctgtctcaaaaaaaaaaaaaaaagaaaacgaaaataaaaaaaaaaactagggcaagcttctttgtcatctacctgtgactgtggttgcatttttctgatatgggctctttctctgatgatccaatcttttgagaaacgcttctcttggggccccaaggtttctcccccgtcttcctgtagatgaaaacctcatcctagtctacctcaaggctctgccaactttggttcatgggccaaatctagctgtgctctgtttttgtgcaacccatgagctaacaatggtttttatatttgtagagggttgtcaaaaaggtaaaaggaggagatgtgacaccgtctgtggtctgcacagcctaaaccgtttacgacctggcctcttccagaggcttgctagctcctgctctccatcatcatgatgatgacccacctgcagcatcagttcgcccacttaggcgctggccttcaatgcgctcttcatttctttcatctagggatttcctttcttccttgtaaattcagccctgcattaacatttgtgggtgggtggagttacactattttacctcacatttcaagatgcttgcagcaagaaggcaggggtaggggtgtgtgtgtgtgtgtgtgtgtgtgtgtgtgtgtgtgaatatcttagtccatctgcagtgagaaggtagggatacgggtgtgtgtgtgtatgcgtatgtgtgtgtatgtgagaatatcttagtccatcttcttgccagaagcagaagaacaaatcttttcactgatttctgctccagaaacatcttcaggttgaccaaaagctcccctgggcaggagcttcactagttcttggttattctggtgcctgtgtggtgatcagctgaagacttggtcctggctgggtgaaggtttatgttgcgcaacatgaggagaagataacgagaatgaggaggcaggcacaggctgggatggggcgaaggggcaatccctggcactccagggcctgggctcaccctaagatgacagggaggggctggcagctgaggagatgagggagaggatgagaggtgttttaggaagaggtactgctcctgaagctccagtgggatcacagttgggaggacacttgggcccagaagctccatgcatcaaggcaggctccacactgaggctctgatggcctggagcagaggccagtatgaatgaccgtgaattgtcaaatcagggtgattatgagaagagcggagcaagtgacaagaacaaagaaatcaagaacaacaactgattgggaagaagaaaacacacatctggttttggttcatacacccggagcgtgaggtccaagggaagaggcctcaaggcatgcgcagtcactgccatccctgatttggctccctgcagtgagggactgctttccccggtccctgctccacgatggaactacagcaagcttttcagaatgtaaaggagatcaggtcacctccttgcttaaatcctccagtggctgaaactgagatccaaactttacagtggccaagggggtcttgcacagtctgacccagcaaccctgcagccgcactctgcgcgctgtgtttgagccatcctggctgtctccggtgcccccaacaggctgatgcagaaggtaggggccctgcctcccagcttcgacacgcgctatcctttccatccgggagctccccactcgtggtctagttaatccctcaaactcagtggcattttcccaaagaactctttgtcatcctccagttacctgtgccctctttgcccccctaagtttccatggtaactcttattaaatcttttttttttttgagatggagtctcgcgcccaggctagagtgcggtgacgtgatcttggctcactgcagcctccgcctcctgggttcaagcaattctcctgctttagcctcccaagtagcggggattacaggtgcccaccactatgcccggctaatttttgtatttttagtagagacagggtttcaccatgttggccaggctggtctcgaactcctgacctcaagtgatttgccctcctgggcctcccaaagtgctgggattacaggcgtgagccaccgcgcccggccttgaatcattatttaggtactcagttactgtctgtctctcctggacacatgaacatctacaccagggactgtgggttctcgttcaccgccatatcccccgtacctagaacagagcctggcacaggaaagaggcacacacacacgcgcacgtgtgtgcatgtgtgtgtgtgtgtataaaacaaatgagtaaatgtattgaatttttggaagggataagaagagtcaagagaggcatagaaggagtggtcagcagagagggagaagctgagaaaatgtggcaagaaggccaatgagtaagaaaattcaaaaagtggccaatgccaacccacaatactacagagacaagatagaagaatgctcttccacagaagagctgcagagacctttcatagtacagttttagcgcatggtgggtgggtctagtggaactattattaatacagtggtggctaagctgctaatttttctaccacagatgctgtgaattagacaaactgtgccccaggaaaggcatgacagggcacacattatctataaaaaatgaaaatgggccaggcgctgtggctcacgcctgtaatcccagcactttgggaggccaaggcgggcggatcatctgaggtcaggagtttgagaccagcctggccaacacagagaaaccacgtctctactaaaaatacaaaaattaaccgggcatggtggtgcacgcttgtagtcccagctacttgggaggctgaggcaggagaatcacttgaactcgggaggcggaggttgtggtgaactgagattgtgccactgcactccagcctgggcaacagagcaagactccatctcaaaataaataaataaataaataaataaatatataaataaataaataaataaataaataaatgaaaatgaacttgagtgatggacatcttggacagtaagctgataagatgtgataaactgggttcttgtcccaagatgaaaaggaggattttaggagccatgacaaataaggcttttatattttaaaccctttcagagcaaacagggggagactttaaacaggcttaagtaaactggtatatactgagggtcaactgaggaggtcgttttaagatggcaggtgacagcgataagcaaaagccaactgctgtcttttggattctttgggtcaaagagaaggtgtttatctaccttagcacggcaatcctttttctttaagaagtttggctttcttcgaatgtgatcccagctctggcacctttctgaatggagtttctctcctctgaaggatgtttcggaatgagtaagcagggatctttttgaagccagggaaagctgagccacaccgttcatgaaacagtcatgcgtgccaggtttggcactaagtgctatgggtgtattacttggtttaattctgcacagtaagtaaccctcatctctgttttatatctgaggaagctggggttctggaaggtgaactctcctacctaaggccctctggcgggtaagaggaagaactagaattggaatccaggtgggtaggacccctctgcccacacgctcacccttgtctacaccagtggagcttgagtggaggcatcctgattcgagacagtgtgggggtccctcggggagagaggctcagactcactggggttgaaacaccgggatcaagagtttcttctcttttcatcctcttctctttctccctccctccttcccttccttaacgttttatgatggaaaattttaaacatatacaaaagcagaccgaagggcacgcagaacagtgatgagcccatccgtcagctttcgcaaggatccattcatggcctgtctggctttatgcaaaccctcacctgctccctgtctcctgcatattattttgaaacaaattccagacataggtcatctacaaatatttcagtaagtatcactaaaaggcaccattaaaaagacacacacactcccccactacccacataaccacagagggtctgacggttcctaaaggcagaggcagggaagagctggcaactcttctgatgtaggaaggtggctccagtttcaggggcgcagccgacccccctgccggagggacatgggacctcacatcgtactcggtcacgtgtgaaaagcagaacttccttcttctgcctcagaatagttcttaaacctcaggggggtctactcatccattcccccagctaaggaaatgtttgacatttcagaacaaggaaagacagttgaacttctgggaggctgccaacttcttaaacaatgaatgctctctgcccccaaccctagcacagaacacctgctgcggctcctgacttcgggatcgtttctctgcgcttcactcagctcctgccctgggcccgctggcacctggcgaggcagattttcccttccaatactcaagagtccctttcaggggcaggcatgggatgccagggttacaagagtggaaaaaaatgtccatttcctttggtcagtttaccagatgagtattactcaaccacttacaatatttacaagtccagctcatggcaattaaaaaaagatgtaagaaaacaaactccttttcaaactgggagaggatattaaacacagtctctcaggaatggtgttttctgaagactcgtcatctggagtcatggtccatacttttttccagtgaaacactggaaacgagcaaaatacggagcttgtgctgccaacgcccctgccacaagttgggtgtaggtaacagctctcagtgcttactgacatggaggaggaggggaaggaggagaaagaatctggaggctgacttttcgagagagtgtggatctctgtgttggccacttctgccctgtagctgcaggggaacgtggcaagtaggctgatgggaaagcaagaggcagggaggggtgaagggcgctttatccaggagtctttttatctggttttgttgcaaggaaagccgccttagctgcctactactattttggttgtcttgaaccaaaacacatattctggccaggcgtggtgacttatgcctgtaaccccagcactttgggaggccaaggcgagtggatcacctgaggtcaggagattgagaccagcctggccagcatggccaaaccccgtctctactaaaaaatgcaaaaattagccgggcgtgatggcaggtgcctgtaatcccagctacttgggaggctgaggctggagaatcacttgaacccgggaggaggaggttgcggtgagctgagattgcgccactgcactccaacctgggtgacagagcgagattttgtttaaaacaaaaacaaaaacaaaaaaagcatattctttttgtttgcctcgcttttcacaccagaagagttaggccaactggcaacccacacgtagctactaaacttaaagatgaacagaggacacttcttagggacaattcctaaagtttgttttatttttttggcagttgtgcctgtcaataggtgacatttgcttatgtattaaccagtgatcagtctcactgttcaaacagacttttcacggcagactcctgagctgaggtggggaataagcaggagaagagacaaaactggaatatttatcttcaaaagttcatgtaaatgttccctttaatcccacgactgggcaaatacacgaagaaaagagtagacgccgtgcagagaaggtgagcgtatttacattctgatttccagattgagaggctggagaatggtggctatgcttgaggtctctgcccagacctgcccactccaggggctgtgtgtgctctgctgggggacccagagtgtgacactagcagccttcctacagccgctgctcagctgcgccaggggaaaccaggcactgggggtgtggagaggaggacctacctgcctctgatcacacccctcttgaatctatcttaccccacagttctacattttaatttccgccgaataatgctttcattaaaacactgggcaaaagtcatctctggttttctgagtttgttttgttcttagcctggcatccaactcaactctgcaggtttttctttctctgtattgtgggccaggcttcctctgtggctccagggggttgcatctgactcatcaatggagtctctgcccgctcccctctgagtgtagcctcagcccattttccacccgccccagggcagggccgaagccttgaaggctcatcctctgtatttcatgtcctccatgaagactgctcagcccgtacacagccagcttgtcctggaatccgagggtatctgcagcaaggccattgctcttaaatgactcccttccacctttggttctttttttattaataattccttcctcaggccatagaatctccaaaaacagatcaatgcagtctggtgcggtggaaggggtactgattttacagtcaagaagacctgacttctaatctgccactggtatactatgacacgttgggaaagtttaactctggagctcagttctaccatctctgaaacaagactgaaaaatcctgacttcacaggcttgttgtgaggatttcggaagatacagtacatgaaacttctagaacataactggcactcaataaatggtaactctcccaacaataattattactcctcgtaataattacaccctgcctgaaacgggtgcctagtggtcgcaggtgctccgtaaatgtcctgcaacagagccagtctctcagcttaacaacagaaatcaaatgtcactctctccaaaagagaaggaagagtagcaaaaacagaggaacacctgggtggcatttagtgtagaaacagagggagcaattctctccgaggcccggcggtgatgagggcgtccgggaaaggttggaagttcagggtggaatgtctggcagcctctgtgtcagttattagctacaggaagggcagctgtgctgggcggaatgctggcggcggtcagcaggcaggcagaacacagccaagtggacaccaggtgagaggaactgtgaaaggcccagactttttaaaagccagtgaggaagtggaggtcagagcaggggtcacaggacggggtcacaggcaggaggaggagaaggttaaagcaaaccacaaggagcacccgactttataacacattcagctacgcgggagaaaaggtggagaggaacccaggggcccctaggggagcctgtgcgtctggccatgctgcataaataacaataataataatgacgatgaaaataatagtcatagtgtccgggcatggtggctaacgcctgtaatcccagcactttgggaggtcacggcgggtggattgcatgagcccaggagttcaagactagcccgggcaacatggtggaaacctgtctctaatttaaattttaaaaaagaaaaagaataatattaatagtagtagtgtcacaagaacagaagtcaagaataaagcctgggcaacaatgcgagatcccacctctacaaagagtatttttaaattagctggctgtggtgatgtgtggctgtaatcccagctactcgggaggctgtggtgggaggactgctggagcccaggagttcgaggctgcagtgagctgtgattgcaccactgcacctcagcctgggtgacagagtgagaccctgtctcttaaaagaaaagtcaagaaggccgggcgcggtggctcacacctgtaatcccagcaatttgggaggccaaggcgggcggatcccctgaggccgggagtttgagaccagccgggccaacatggtgaaaccctgtctctactaaaaatacaaaaattagccaggcgtggtggtgcacgcctgtaatcccacctactcaggaggctgaggcaggaaaattgcttcaactcgggaggcggaggttgcagtgagccgagatcgtgccactgcactctagcctgggcaacagagtgagactccgtctcagaaaaacaaacaaacaaacaaacaaacaaacaactgtggtcttttggggtggctctttagagtggccaggccagtgtcccccatgtgcctgggtgggtttgtgctgaggcaacactgggaagagagaggcacctggcaccctcctcaccctggaaactcagccctctccccagaaggccaggcccctacctggagagaattcactcccagcctgagctggtgcccagcaccgggctgatgaggcactgctctgcaggaacacagaaacgtggaaagaatcaactggaaagaaggcagcaactgtcggaaaagagaacggtgtgaagagagacatctgggggccagagggagcaagagaatcaggagaaggtggcctggaaggggtgggggttgggatgagagaaaaaaaggactggtctagaagcaggaaattaaaaggaatgaagactgcaggtgacggggcagagagctggacggcagcctagtgaaaggcaggttcctgggatctggggtctaggatccaggcatgagcacctggctgggcgtcaggtggccgtggagcagcagtcacggccacaggactctggtgaggccgccgcttggtcagtggagaccgcatgtgagacctcacggcccggccagggcgagtcaggtcagagtggctggtgaggctgtcccagtgctgaatagcagcactgccctggtaagatttacccaagagacttagactcacccacactagaactgatctcttatctgttgagtgcctactgtgtgtcgggtccaatgggtgcaaagacgtatacctggctcttcctgggtctgcgggtctcatgagaaaggcagaaaaatcaaccctatctctacccacgcccaacacaaacacgaaactctgcagatgatagccgttccttagagggagtgtgtaaaaactctgccgctattgtcgcttcctgcacagaaagtgctgaatagtttgtaggccccatctgtgttcttaaggtgttattcatttcccttccctgaaataagctcagctcagcaactgccacaagtcaagggcagaattcaattgtaaatagataatccttcatatcagccaccaagagcagcaggttaggagttgtcaagccaataatttaatgccaattctctggcacgtcaatatttgctaagaaatatcccttcattgtgctgtgtgttacccctgggaatgtgaatctgtctggagtctggcagaaattcaagtgtctttgaaaagacagtcaggaactctgttacggatatcttgttttgacaattccctcttgactgtcggaagattcctgcaaggttccagtcaggctgtggattcggcattacaaacccctccgtttgtcctatttggatactttacctggcaccaattagggacacctggcagggcgacaccagggtattactaccaaagttctacaaaggcagggcagagaggcatcgctgctaccataaggctttgtcaatacaccaaatgcttatctcatttgttaaaaggaaatcatttgaccaacacgcaaaagactatggggtagatctgaattgagccctgcgttccatacatcgaaacaacatattcctggggtggcccagtagccgtgtctgttcaacttaaccctgcctccatacgcacagctgatgcaacagacctcaagtgaggccaacaaggttctcttctccagggattttggattttgaactgagcacaattggggttcagtcacagtaatggtaacactcgaggggtgggccacaaacttagctcgggaggtcccaggccctgcctttgctcagacttgtctttatacttggttggctcaatcatccctcgggttcctgcaaataactcaacatcactcaaataaattacatgttttttgtttctttgttttttggtgttttttgttttttttgttttgttttgtttttttgttttttttgagacagagtcttgctctgtcgccaggctagagtgcagtggcgagatctcggctcactgcagcctccgcctcccaggttcaagcaattctcctgcctcagcctcccgagtagctgggactacaggtgcgtgccaacatgcccggctaatttttgtatttttagtagacacagggtttcaccatgttggccaggatggtcttgatctccagatcttgtgatccacctgcctcccaaagtggtaggatacaggcatgagccaccacgctcggccacaaattacatgttttttaacctaaacgagccaaagtcatctctgcttatttgcaaccaagatcttttagcagagtgatcagcaaaaatcaccagttgtgtctagttaattggaaaaacataaaagtcatattagcatgcttttgctttactactttagtcttgaaaggatagtcccaagatgttgcctctgaggacaccccgtctgggttgcatctccttactctgaaggggctaaagtcccaacagaaatatctgttgactgcactccagcctgggtgacagagtgagatcctgtctctaaaaaataagcaaaaagggacgggtgcgtgcggtggctcacacctgtaatcccagcactttgggaggctgaggagggtggattacctgaggtcgggagttcgagaccagcctgaccaaaatggagaaaccccatcctctactaaaaatacaaaaaaattagccgggcatggtggcacatgcctgtaatcccagctacttgggaggctgaggcaggagatcgcttgaacctgggaggcggaggttgcagtgagccgagatcgcgccattgcactccagcctgggtaacaagaatgaaactccgtctcatatggaattctaatataagtagtatctaatgactagcttttttcacttaatttgtcttaaatgtctttcacagagacctacctttaatctttttagtggctgcagactattttataccttaatttgttcaaaagataccctgttactagactttgaggttatttcaaaatttttgctatgaaaaggaatgctgcagtaaacatctttgaacataaacctttgtgcacgtgtacacgaatttctgtaggatagattcctacatatggaatcctggggcaaagagtatgtgcattttttattttgatagtctcgctaattgtattttctgacggcatttctctctcccaaaccacatactcttcatatgatgtgactttgacattgctctcatcaagaggtaggacctgggtcccctccccttgaacctgataagccctttgtgactacctcaccaacagaatatggcagaagtgacactctgtgactttcgactctgggtcataaagattacacacccttccaccttgctccttcaggatagtcaccatgtgagtagttcaactgctagaaggctgccatgctgcaaggaagcccaattagtccaaatggagagaccacatggaaggaccctgagatcatgagaagacagagaaaagagatgcccagccagccccactgggttccagcttcaccactatactgactatattacaactgcatgaaaatcttcagccagagccaggcagcagagcccttttcaaattcctaacccacagaattgtgaagtgtagcaaaacaattgttttacattgccaaatttggggtgatcttttaccttttttgagacagggtcttactctgtcgcccaggctggagtgcagtggcatggtcacggctcactgtagcctccaccttctgagctcaagtgatccccccacgtcagcctcctgagaagatgggaccacatgtgcatgccaccatacttggataatttttaaattttgtgtagagatgaggtctccctgtgttcccagggctggtctcaaactcctgggctcaagcaatcctccctcctcgacctcccaaagttctgtgattacaggcatgagccactgcacccagcctgattttttaaacacagcaatagataaccagaatgggtaggttctgccaaactgcaaacaacaattctcagtagtaatataagaacaagaaggcaaatccttttctgggcatttctagtgaactagtaatgcttcatgtggttttaaattttcaagtagaaaaagcatttaaaacaatatgcatatatcatagtaacttcggaaagtaaagaagatgagaaaagaaaggccaggtgcagtggctcacgcctgtaatcccagtactttgggaggctgaggtgggaggatctcttgggcccaggagtttgagaccagcctaggctccatagggagacctcatctctacaaaaaaaataagaataaaattacctaggtgtgatggcacacacctgtggtcccaggtactcaggaggctaaggtgggaggatcacttgagttcaggaggtagaggttacagtgagccatgattgtgccactgcactccagcctgggtgagagaacaagacccagtctgaaaagaaaaaaaaaaaaaaaaaaaagctgtcaccttcccaaattccaaacttttctctttcacggtcacatatcctattattttacaagcaatctttgattaatactatagatgtcctaaagagtcaaagtgaatatgagatgggctccagttccagggcaagaggtttctggggcccagattggggcaggagagctcaccctcttgaaacaaagctaacaagaacactctggatggggcacgctagtcgcttagagccttcccactggggatccctcctttcctgggcacactgtgtatgggcccactgggggcctggctcaggcaggtcccgggcaaatgcacattgcccctgccaccacagtgcttctaacaagagccatgcccggcaccattactggcgctaggcacttgctatccactttgtatacattatatacgttacacattgagcagctcaatacacgtttactcaacaaatgaaacagaaggtcctcactcctgacgtggttgggaaagcagaaataacactgatatcctctgtgtcctgcatctctgttgtggcttttgatttaacacatgttgcctgagcacctgccaggcactgttctaggcactggggctgcaacaatgaaccaaacagacaaaaagctctgccctcaccaaactgacgtcctagtgtgtgtttgttgggggcgctggaggggggcttcagtgtgtgaagacagacaaaaacccagatcagtaactaatgtagtggactagaaggcggtaagtgctagaaagaaaatccagctcctcttcccctattgcttatcatacggggtggctgaaaggcacacaccccctttccctcgagtcctagggataccagggagggagtgctgatatggtccataaaccagacatcctagagtgggatttggaaacattgcgggtaagactagggtgccttcctacacgccatcaggaaactgccatccttaaacgttaataagatgtaggcttagaaataacacattacaaaagttggttggaatgaagggtgacgtaatgacaactggaaacacagaggggtgttattatggagtggagaaaaaggagattggagaggaagaagttggcagtgggtgccagcactttccagaacaggggtgccccagccagcgcaccggagcctgcttggtctgtgaggacatggggtcctttctgaagtgagaagcagtgagccacctcctggacagcagctcttcctcagatggcccttctggactattctatgcccagatgagaagtgtgcttctgaaactgatgacgcttgcctgtattagcggccgttttacttcagcgccgtgctggctgagagctgcaaagtgttggccaccagctggtggctgaaatcaagaggaagccaggtcacggtggtggaagtaggatgaaatagtagacacacgatgtcaccaagagtgtagaagaattcaggtaaatgcatttccagtaaggtgggatcactagtgccgcttctggtgctctgggtggagagccactctgtcatcctggaggctactttggcccccaactcatctccacattcctctggcctccaaggtgacatggactatatataaccaagggccacggtggggagggcagaagaaatatgactgtttaagggcagtgggagaaaagaaaaataaggggctgatgagagagcggccagacgtgggccttttgctttcagccaagtcttttcccaagtaaccacaacatttgtcatagttattcagtgtggctctgaagcctgtcccctttgtcggggcagaaaaaatgggctctcctgtgttcaaaaggtcatctctactttcaagtggtcaacattccgcagtctgaagctccctggcccactagcttccagtactgtgtgtcacttcccacgtatgcggcaaaatgacagagtgtgtgaaagggtgaacgcgtgtgtgagttcagggtttccctctttggaagctgtatggcataagagctgaaacaccatgggctgcgagggcagactgcacgtgttcagaccatggcactgtcatttgagtaagggacccaatcctctatgccgaaaagtgggagaataataaccctccactctcagagccatcatggagacaaaaagagagaaaatgctgagtgccaagcatactacccggcttatggtaccttctcaactgagattagctactagtctcacctgctggaaattgttcttgctaccaacgtggcattcctgatctccaatctttggatagaaagcgctatgacccttccccatgtgtgatggccttcagtgctcaatgctgcccatatcccccgtgttgtgtgacaccacagcacgagtgagacctctgagctgaacgcagcagcctcctgccatcgggcgcaactactctcagtacaaccaaacatggctgccaggcttttcttgaaaaccttctctagctcactctacagactctatcatgaaaacagactttgagatttatgcactcaaaaaatcctccaacagcctgtatacctatatgtataaaaatgcttaaattcaccaggcacagtggctcatgcctgtaatcccagcactttgggagccagaggcaggtggatcatctgaggtcaggagttcaagaccagcatggccaacatggtgaaatcccatctctactaaaaatacgaaagaattagctgggcgtggtggtgggtgcctgtaatctcagctgctcaggaggctgaggcaggagaatcacttgaacccgggaggcggaggttgcagtgagctgagatcgtgccattgcactccagcctggggaacaagagtgaaactctgcctaaaaagaaaaaaaaaaaaaaaaaagcttaaattaagagcatttcaatgaaaggccattcagatttgttctcacggaagggatatgcatcttctacccagaccctcccatatgctctcctctctaggccttggaaccctaatttaaggatattgctgcagtgagatgcttaatggcagaactagggcgcaaccaactcagcacactggtcaactgctaacctttcactaggagcaacacgagagcctcagagttgtgagccctgtgggcaccatgaagattggtggagtaagaacaaaaaaaaaaaaaaagagagagagagagacttcaaagttgctctacactggatcgtggaaaaggagcctcttaccaaaagtggcagcggggcttagagtttgatctaggaaatacacaagagcaaaggggcagtcaggctgcagagctctgaccccgagcacatggtatgcaaacaggagtattcacactctgcagtgcaagagcctgtccttcatcttgggggatgaggccgcagtgatgtccccccgattcagtactatccccaaacaattcaccaccctaaagacgtcctcctgtgaacagcagattatctgaggatccctaaaagtggtccttcacatagggaggctgccattttcggagttggctgttagtgtggcagcaaacagctggcattcctaagtaaaaactcagagccagaactggtgctcttcaaccccgactcagctctgagacacagacctgcaggcaatgtgggcagattcaacaatgtcactactgagcctactgaaaacaagtggacaagatcccaagccatcaattctagaacatggttggcgtaaaagctgttgtgcatggattctatcagcaagaaggatcagtagaagtatttgaggccaggccgggtgcagtggctcacgcctgtaatcccagcactttgggaggctgaggcgggcggatcatgaagtcagcagatcgagaccatcctggctaaaacggtgaaaccccgtctctactaaaaatacaaaaaattagctgggcatggtggcgggcgcctgtagtcccagctactcgggaggctgaggcaggagaatggcgtgaacccgggaggcagagcttgcagtgagccgagattgcgccactgcactccagcctgggcgatagagcaagactccgtctcaaaaaaaaaaaaaaaaagaagtatttgaggcccaaggagtcactgtggcagagtggaaagactgggaaatgattgcatctggagcgtcacttctgaggataaggtgattggggtacacgtccttctcctctccctttcccttaagacgctccagcgtaagggcttaaacagaccctcaagacaccgtcctggaaagaggcagattgatggccacagctgagtgtcagaggttacatattagcatgttcaagcctataccagggacgtgtgtatcacatgccatgcaaagaacacaaaatatctgcccttccaatgtctgctgctagtgcaaataataaaaggtgtttgaggataatattaaaatgatgtcatcaccttctgcttatccactcttctggaaaaaagtaagatagacaacccaaaaggtcagatttggctttgcaatattggctggcttatattaaacatggtctgtcagagatttcagaagtcatttcaaagcaacattaaaaagttgaattatgacacattcctaacgaaatgatccagttttcccaccttggcctcccactccgagcatgccacactctctcacacctctgtgccttggcagggatcgttcacactgctttggggccctctgccagcttctctgcacccagcacaccagcactagctttaggcctcagcttgaaaacacccgctcctcagggacacctcctcccccatgcccagggtaatcctaggattgcttttctatgctgcttctgtatactaaacacatgcggtacagaaattaacatgttatttggttaaactaacaattaattggattcatgatttaccttccccgatggcccataaattctttggggttaaataacaggccgtgtgtttccaatgtctgtgtctcctctcgtgcctagcacagagctcacataatacatatgcaacatatatttatgtttttgttgattggatagcagctcatagcttagactcaaatatcttaatacctggaatatgagcagtcagcagtaggaatttcaaaggactttcttttttcttttctttttgagatggagtctcgctctgtcgccaaggctggagtgcagtggcgcgatctcagctcactgcaagcaccgccgtctcctgggttcacgccattctcctccctcagcctcccaagtagctgggactacaggtgcccgccaccacgcccggctaattttttttttttgtattttttagtagagacagggtctcaccatgttagccaggaatggtctgatctcctgaccttgtgatctgcccacctcggcctcccaaagtgctgggattacaggcgtgagcaaccgtgcccagtctcaaaggactttcttacttgatggtagttaacatgggaatattccagcagctagaacagtacttggcacatagtaagtgctcagtaaatatgtgttaaagaaatgaatgaatgagtgaagaaatgaacgaatgaaagcatacaaattatcaatagaataggtaatcaaggagtagtggttttaaagaactgtaaagcattccagtaaagtaagtccagttggtattgctaaattcaaaatcaatatattctccattagtgatatgaatttaaaattctaggagaatatgttctgtatttactttgcaattaaatgaacagagttgcattgtagtgaaatgatgggattttaccagatgctcatgggttcctatcacagatgattttagactcacaatttcagacaactgggcccattttgtattgaatcaaatcgcctcagttcatgtttcattcattccttgtaactttttgtcaccctctattgggagacattctcaagacattaccaaaaatcacctaacgacagaaatgtttgtgtttacagcatggcaactcacagtgtgacgtgggaccaggagcacagatcactgaagagactgttagaaatgcaacttcaggctggacgtagtggctcatgcctgtaatcccaaaactttgggaggccgaagcgggcggatcacttgaggtcatgagtttgagaccagcctggccaacatggtgaaacttcgtctctactaaaaatacaaaaattagctgggcgtgatggcatgtgcctgtaatcccaattactcaggtggctgaaggatgagaatcgcttgaacccaggaagcggacgttgcagtgagccgagatgcgcctttgcactctagcctgggtgacagagtgagaccctgtctcaaaaaagaaagaaatgcggccgggcgtggtggctcacgcctgtaatcccagcactttgggaggccgaagtgggtggatcacgaagtcaagagatcgagaccatcctggccaacagggtgaaaccccatctgtactaaaaatacaaaaattagatgggcgtggtagcacgcacctgtagtcccagctactcgggaggctgaggcaggagaatcacttgaactggggaggcagaggttgcagtgagccaagattgtgccactgcactccagcctggctatagagcaagactccatctcaaaaaaaaaaaaaaaaaaaagaaagaaagaaattcaacttcaagggtcctacctagaaacctgttttaacaagcctccatgtgactcctctggtgctgaagaaattcttcacaccatacaataaaatatcatctgttaccatgatagaagaaaccgtggctttctctggcgactataagtacggataatgggccagggctccctagctggaaggaaagtcactgtcctgggggcaaagcaggtacccagtgactgtccctgctgatgatgcaccccgagaagtggagcaggctgggatgtgtttgacacaaagccctcttgctgtcctaatccacacccacgccaatatccctcagcctcatttcctcttgacaaagacggttctgttctgagggggtgtgtgggaccaacagcagcagctggggtggccaaatgaccgctcttgcttagaatagagagggattcaaagaatgatctctgccagattgccgggctttgctgtgtcacatcaggctgacacagatggccttggccactaaggacgctgccttcttcctcacagaagcccgaggaaatgccctgagaaggaacaaggaccagataactacccggcagggagtggctggtaggatttcagcttgaaatgtgatctctggatgcccatgagccagtgtggcatttatttccaccgcatcaggggtcccaaccttggataacatttatatttctagagcacctgaagaacaaagattccagattgtaaggtgcaaaataagtcacaagggggtgccttctcactcacacacagctagccacagctgtctgccatcccagagcgtaccccgaagctagcgcgccagcgagctagttttaaagcacagacaacctctccattgctggctttcttcgaacaccgtgggtgaggaaatgagacagagaatgtctaatgattagttccttatggtccttacattcttgaagtatattctttacgcccgctggaacacttctgcattcttgatagcatgattgcaatataagttctttcccttctgagcactgtcttttattgacacactaaaatatcctaggagcaggatgggtcttcccaccttcctcacgcccctctttccccactgccacactctccgcgccattccttgttctctttctaagaacgcaataaacatttcagcacaatcttttcaatccacattatttataatattccgaacatccatcgagcctggctagaatgcgaagcaataaatcaaacttaacaacaacaaagaaggaagggggaaaaccgccctttggcgaggcgaaagcctgagacgtttcattccccgaagggtttagttatgttaggaaaagtgagatggggatgagacccgaggtttagaatgacatagaggcaggaactggaatctataggcataatcataactttgtataaacctcaaacaaacttacctctctggggtgtcatgaggataaatgagatacgtgggaagcactccgagtgcctcgaacgagagcaactggagcccaattctcctttttgggtccaaaaggtcatctttcttggaagggagagggctaagagctcccccaactccctgagcgccagtctttgctaattaacatcccctctgcaggtttaactaagatgggggtgagcctggaagcagggcctcgaggtagggctgctaggtcctggacccagtctccacccccagcagggacccctctccccactgccagcgaggaccacgccaggccacacacagccaggggtgtccctgcagaatgattcagctcctgccgggggtgggaagtagagctcgtcccacatcctttcctcatggcgctacgcaggttaacactgtctgactttgtcttcgcaaagaaagaatctagctccacagtttgctgatgatttcaaaatttatctaaacgaatgtggaggccagtacaggctattggctaattgcagaattggcttgaggcctttctgccttggcgatttcccacgcattcccgtctcacgttggaaatccaagctgtttgggagtgggcgtgtgtttgcgtggcaggcctcaatgcagcggctctgttgctgtctagtctaacatgctctgccgtctgctctcagtggtcccttctgacagtttcctggatataaaggggtgcttcttttccagtcttgttgaatggtactgaatataagattagaataactgaatcacaatccacattttagtcattacagtctcatgttagctctggggaaatgaccataaccggtacttactcatgagaattttctaccaaaaagtcagacaagaaagtcattttcttatgaaaagtgtcaaatgtgccacctactctggctttgccatccctcccctctgcatgttaacctcacttggtcttcttaaggtacagataatgccttcctgcccagatctgttacctgcttgctggcttgggtggaggttagatctcaaccactgttctggaaaggatttgatcatcagcttggctttgttcataacttcctgcagtaaaaaaaagtcttcaaaaaacccaaattcacgagtgatatagacatttgtttaaacaaagtcttcaggccgggcgcggtggctcccagcactttgggaggctgtaatcccagcactttgggaggctgaggcgggcggatcacaaggtcaggagatcgagaccatcctggctaacacggtgagaccctgtctctactaaaaatacaaaaaattaaccgggcgtgttggtgggcacctgtagtcccagctacttgggaggctaaggcaggagaatggtgtgaaccccggaggcagagcttgcagtgagccgagattgcaccactgcactccagcctgggcaacagtgtgagactctgtctcaaaaataataataataataataataataataataataataaacaaagtcttcaaaaatacaacaatttcttttttcttttttttttttttttttgagacggagtctcgctctgtcaccaggctggagtgcagtggcgtgatctcagctcactgcaacctccacctcccaggttcaagcaattctcctgcttcagcctcccaagtagctgggactacaggcatgcaccaccatgcctggctaatttttgtatttttagtagagatggggtttcaccatgttggccaagctggtctcagactcctgacctcaagtaatccgcccgccttggcctcccaaagtgcagggattacaggcatgagccaccgcgcctggcccaacaatttctttatgatgtctctaagtcacagaaaccaacaaaatcatcattacttgactgttcaagttaagggtctctttacaacttccacttcttttgcttctgatgacgcaaccatcctcttgagctccggcctcccagggctgagtggttcacccagacctctggggtcccttccttggtatatttccactttcactccaagcgtccatgggaacttctttcctttgtctattacctcctaggtggagctcttctgccttcctattttcccccatcgcctctaagtaaagggctggcttcactgacgcagggagacatcgctgctctctgtctctcctttagtgccttctccctggtcaatggagttccactattcccacccttacctatttacatacaccagcaacttctctttacttagaggtgtaagtctgctggagagcagactgtctagctactgaacttcccatctgtgtgatcatgagccagccatttaacccatctggacctcacctataagatggggataacaggttgggcgcagtggctcatgcctgtgatcccagcactttgagaggccaaggtgggtggatcatgaggtcaagagtttgagatcagcctgaccaacatggagaaaccccgtctctagtaaaaatacaaaaattagccgggcatggtggctcatgcctgtaatcccagctactcgggaggctgaggcaggagaatcatttgaacccgggaagcagaggatgtagtgagccaagatcgtgccactgcactccagcctggtcaacagagtgagactctgcctcaaaaaaagaaaaaaaagaaaaaaaaaaagggcgggggataacagtagcgtatatataatgtgctgcaataatgtcaatgacacagtaaatgctcaataaacactcacttatcttattattaaggcttttccagtcatgcttcatggtgtgcctacagccccttcaaatgggatctttttagatcagagctctggctgaggtgtgagtcaaggtggctgcggtttctatctaccccctgatcccacccatcaagccatagggccctgggcatgcagggcaagttcagccgatccacaggctggccagcagcccctgagtgattttggtccagtacatgcaactgagctggataaggattattttctctgaagttggactaggaaataaggagtgatgcaggcttaccaagtctgccttggttcctaacgaagggaacatgtttctttaaagtaaccccatctttttttgtggaaatgtgagtgattctgtttcattttttccccaaccaaaagatgtcccaaagaacaaaagtttaattaatatatatcccaggctacagatgtatgtgctttaaacgagggacagattttgactcaaggaatacatttctaattgtaaaattttgggtcatcagcaagatgactgaaaggatctccatcacttccgaaattagaacttttaggccactgttgagatatctaagacatcaacaaaattagttttttgtcagcttttcttgtttttgtttgtttatttgtttgttttttttttttggttgttgtttttgagatggagtctcgctctgttacccaggctggagtgcagtggcacgatctcagctcactgcaacctctacctcctggattcaagccattctcctgcctcagcctcctgagtagctgggattacaggtgcccaccaccacgctcggctaatttttttgtgtttttagtagagacggggtttcactatgttgggcaggctggtctcgaactcctgatctcgtgatccgcccgcctcggcctcccaaagtgctgggattacaggtgtgagccactgcactcagccaccttttctttttttaaagagacgagatcttgctatgttgcccaggctggagtgcagtggctattcacaagtgtgatcattaacacacgacaaccttgaactcttgggctcaaacgatcctcctgcctcagcctctggagtagctgggactacaggtgcataccactgtgcctagccagaatcaccttttaacatccatggctatttcaaatctagagtttacagcgtcagtaggtttaatgcggatgaacatcttcatgacttaaaaatgagtaaggaacacatccttttctggttaacttccttgtcactctggagaatgtccctaccgctatttctcaaatgagaggacctgaagttctctggagcacggggtgtggatggaggtataagagaagggatagctggaaatgatagtgggtgaaggttagtgagggcagggtctcaatgagtgagggcagggtctcaatgagtgaaggcagggtctcaatggctcatgaaggcatctaggctgaatacacagaagccagtcagcctccatctgcttctacccaactctgtaccaggtaccatgttaggttctgggaatacaacaagggtcaagatagacatgatacctgtgcctgaggaattgacaggctaatgggggagtcagacattcaaacaaccacacaataaaatgattacaaatcatagagaagcattaagaaggaaataaacaagatgttatgacaacagttactttaatggggtggtcagatatggctttctgatgaggtgatctgttgagatctaaaagtaaataaagctgggtgaagaccatgccagccaaagccaggcagagtgggaagcacagagcagctagggattcatggaatggaaagaaacccactgtggttagaactggccagtgaggagagaaatcaaggtaaatttggtgagagtgtcagggctaagtcctgcagggccctagaagccatggtaaggagttggattttatcctaagtacaagggaagcaagtgaagggtttaagcagggagcggcaatatctcctttaggttagacagtcatttatgtcacagtgtggagactggaccggagggtatggtgtccaggtccaagtaaagccaacaagacctctttgagagaactatcccagcatctgggtaagagggtgacatgaaatggggtggtggcagtggagacagagggattgaaacatactttagggccggatgcagtggcttacgcctgtaatcccagcactttgggaggccgaggcaggtggatcacctgaggtcgcgagtttgaaaccagcctgaccaacatagagaaaaccccgtctctactaaaaatacaaaattagccgggcacggcagcacatgcctgttaatcccagctactcgggaggctgagacaggagaatcgcttgaacccgggaggcggaggttgcgatgagctgagatcacgccatttcactcctgcctgggcaacaagagtgaaattccatctcagaaaaaaaaaaaaaatagaaacatactttagaatgccacagcttctttttggataagcaagggcggctatagtgagaggagaggaggaaacaaaatttctaccttgaataactgggtcaatggcatgctatttattgagacagaaaactaggggtaggtggcgttctggatatgctgcagagggatttaagctgacatatcaaaaagttcttggatatgcagtataatggagctcagaagagagatcttgggcagtggcagtgatggtgacaggttgagagcccaaagaagagaggagagaggaaagatcacggggaggcggagagcaggggagggagatcgggcagggtgggtgcagggggtaccgtgagtatgggagcttctaagacttgggcccagagctgctaaaggggcactggaagggaggactctggctctgtcactatctgatgaggacagcagcagagtgactacagcaagcatttacagagagtctattgcacatcaagcactgtactcttgatcttccatacccctctctaatccccatcatcacactgtaaactggtgttactattattgtcattattattctgtgtgtgtgttttttgttttttgttttttttttttgagatggggtttcactcttgttgcccaggctggagttcagtggcacaatctcggctcattgcaacctcccgggttcaagcaattttcctgcctcagcctcccaagtatttgggattacaggcacccgccaccacgcctggctaattttgtatttttagtagagacagggtttcaccatgttggccaggctggtctcgaactcctgacctcaggtgatccacccacctcgaattccttacctcaggtgatccacccaccttagcctcccagtgttgggattataggcgtgagccactacagctggccatcatcattattattaatgaacctgacgctcagaagcattaagcaatttacctaaggtttcagagcttttcagtgttgggcctgggatttgaacccagctttgactaagtttatcatcagagttgactaactcgaacatatagtcataacaataaagttaaggttgtacagaagtagaaaaagacctaagataccagtaacacagcttccaaaccatcttctctgctttcacagccaggtgcccagctctagactagactatgatggacttctcactgtcttccctgctacagaacatccccagaagcaacaggtctccctcatgctgccaacaacaaccctcttcttcactgtgacaagcctgaccccatctgttttttggttttcctcttcaagaactgcaggagacaaaattattatttgcagataatgagaacacctaacgtggaaataacaaaataatccacagaaaacccttttgaactaaagaaaaaaggatagcttaaaatacatcaatagattccaactcctttctcataaggcagttaaaatcaatcagaaaatataacagggtgtgatggcttacatctgtaatcccagcacttcggtggatcacttgagcccaggcatttgagaccagcctgggcaacacagtgaaacctcatttctataaaaaatacaaaaatcagccaggcgtggtggtgcacgcctctagtcccagctactgcgaggcaggggtgggagaattgctcgagcctggctggtcaaggcagcagtgagctgagatcatgccactgcactccagcgtaggagacacagtgagtaagatcctatctcaaaaaaaagaaaaaaagaaaatcaatgaaaaaagtgtattaataactgatgaacggccgggcacagtggctcacgcctgtaatcccagatctttgggagaccaaggcgggtggatcacttaaagtcaggagaccagcctgactgacatcgtcaaaccccgttgctattaaaactacaaaattagccgggtgtggtggcgggcgcctgtaatcccagctacttgggaggctgagacaggagaattacttgaacctgggaggctgaggttgcagtgagccaagatcgcaccattgcgctccagctggggaaacaagagcaaaactccatctcaaaaaagaaacaaaattttaaaaactaatgaacagagaacaaaggaatgaacaaaaatggacagaacgactttttgaaaattccacaagtttactgaggaaccgtaaaagaaaatatgaacaaagacagatccataccatatttctggatgggaagactcagagctgtgtgcctgtcagttctctccatgttaatataaacatttaactcaaatagcaacaggatctttcaggaacctgccaaattactgtgaggcaactaggactattctcaatctgcaggcaaggaaactaaggcttagacaggttaagaaagcacaatctgtcgtaaggaaattgatgtggaggcacagtagggcacacctcagtaacaattacaaagatgttggatgcagagttgtgtgtctatgtgtgtgggccacagataagcaggagagtggattgcacagggccctaggtgtgacaaggaatctgggcaatagagaggctctgagaggtttcagcgggaagaagtaatggtggagggggagggttcacagacgcaaatctgcattttccaaagctcctcctgacttcaacgtggagaatggactagagggggcagaactggaacaggaaggcgatgcaggaagtgacaggagtgatccagaagatgacagaggctgaagtcaaggtgaggctgtgggaaggaaaagcagtgttgtggatttcatagacactcaggaggtggaattggtgaaaactggcatcggacgagatgtaggggctgagcagaagcagggatgattcctgggtatttggcctgagaaatggagtggttggtggtcttgctcattgagatagaaaacagaagaaaagcagggctggagaagatcgtgagcctagttctagaaatcttggaattgctgcgagcaagttttgacagcacgatatttggttttcttccactgggattacagagaacttgtcttttgggtagtgagccacaggggaaattttcctgtttgggtggggggctgggtgcagacccacctctactgtgagtatcctaactgtgaagcagacacagtcccttggagtgactataaaaatattaaaaggctgggcacagtggctcacgcctgtaatcccagcactttgggaggccgaggcaggtggattacctgaggttaggagtttgagaccagcctggccaacatggtgaaaccccatctctattaaaaatacaaaaatcagccaggtgtggtggcacacacctgtagtcccagctactcgggaggctgaggcaggagaatcgcttgaacctgggaagtggaggttgcagtgagctgagattgcaccactgcactccagcttgagctacagagtgagactccatctaagagctcaggtatgggtctagcatcgacagctgctggaggcctctccaccagggccctcctggggccttctccccactctcctgttggaggcctcatcagatgccacttctccatttcccccctctatctgagatttccagatggacattttatgtttttgtacatttgataaatttttgtttggtactgatgacatgttttgttttgttttgttttgagatggagtctggctctgtcacccaggctggagtgcagtggcgtgatcttggcttactgcaattttggcttcccgggttcacgccattctcctgcctcagccccccgaggagctgggactacaggcacctgccatcatgcccagctaattttttgtatttttagtagagacagggtttcaccgtgttagccaggctggtctcaaactcctgacctcaagtgattcactcgcctcagcctcccaaagtgctgggattacaggcgtgagccactgcacccggcctgatgacattttcttactataatccctcctctttgccttggtagagtacatttcttcattcattattccttccaacattacattatttgaaagtatggtaagacagggttcaacagaaaggcacgcagttggtgcaactggaagctatcctctttatgaatgaaacgttagtgtctccaggtgtccgttttcttcgcttaaaactgctggcatcatcttataactcagacttagctattcatcacggtggaaagaaaaagtcagccaatggaacataagccttcttccctacgagacactcctctggccaacctatatggccacaaagggcagaattgagattctcctgctcacctggtggccgcatgcataaccagcctaaagaaaatttctgagagaaaatatccaggcaagagctaacttgcaaatctgaatacttgaaatgagacagtcactttatggagatgaatcttttttttttttctttctttaccaaaactgaagaactgcacatgtatgtcctctaacaagtagacatctaaagacaccagcataggttgggtagaaagtcaagaagcaagagagtttacgtatttgctgtagaacctagatagggattccaggggacaagagagcccaggacacctgacaggtattcttgataggaaaaacagagcactcacaattacagatgttgtgaccctggtccaaataatatctttactctgacaaaaagctgtggacaattagaaattacttttcttaaactaaagggttttttcctttctataaatattcaaccttctgtgtttgaaatagaattctcaggcaaggagaggtggctcgcacctgtaattccagcactttaggaggctgaggtgggcggatcacaaggttaggagttcgagaccagcctggtcaacatggtgaaaccccgtctctactaaaactacaaaaattagccgggtgtggtggtgcgcgcctgtaatcccagttactcaggaggctgaggcaggagaatcactgaacctgggaggcagaggttgcagtgagccaagaccatgccattgcactccagcctgggtgacagagcgagactccatctcaaacaaacaaacaaataaaagaaatagaattctcagtgttttcatgtcactggggttaaagtataaactcaagaaaagtaccatgagaacttggaatgtggagctttcgcaatggatagaacgacattcttttcatttaataaggttgaactgtatgcatctttcaaaattaaaagcaatgttttcaataactgcatgtttccaacaaccttggtctctatggattaaattctatttcttttcatttctggaattattttattaatcaaacacaaaattattatagtctactcagaaaagtctgatggaaattgtaacctgaatcatattcgaggattttcttttgaagcagaaagccagcaattacagtactggaaaaggctgttttactgtggtgtatttcctcgggagaggaaatgatttttgagaatactgaagccttttttattctaaagtaggctagcaacacctgtacacaatctttctagacaacaataagacttttctgaggtttcatgtcatgatcgtttaatttaatagctctgagagtttaaacaggacactcatacctcagttaactggcatggtcagtgaactggggattccagttaacttaatttttccatcaactaatagtaacccatttatgcaatgaaatttcctcagcaggatacaggggatctgcacagctcttttcagatatgtacaattgtatggtttgtctctaagttttccttttttaaaaaatcagcatcttgccttgtgtaaatcttcaaattaataaaccaatgatcaactacaagacggctcaccaaaacaaataagcaaaaaaggttaggtttaactctgatcgtcttagctaaagaaaataaactacggagaaaataaaatattttcttctcaattcatacagcattcacttaaggcaatggtctgcaccctggagatacggagataaacaatacatgtttttttggacctcagaagctcacagtttacatatggataaagtaggaaagttcagaagatatgagcaatgacagttgtttaaaaaattttttttctttaaaagtgtataaagctactcttgtttttgaaaagtcaaggcaaatgaaacatactttttgaaataatcagggaaaaaaataagtttaaagtttcctctagatcttttaatcagcagaataataaggactgactttatatctagacttcgacttagcagaattagaaaacttcaaaagtcctagaaatatcacaggtaaatgggtaaaattaacctcaaaaagtttctgacttgactttctaggggccgaaacacgcaagatccttctcagttctctcccttagtcttatgttttaattaacagaggcaaagtttttcaaagtcatgggtggggcttgctttatttcctctgatggtttccagcagggaaccttggccttaggatcttaagttttctggaatactaggttccattctcccagcttcccaggccccacccccctggagattctgattcagcggttccgggagagggcccaggaatttgtatttttagtaagagcatcgtgtgattcttatcatcagggaaatctggacactatggataataacaatttgcccacgaatcacaggttgtgggtagggcttagagagaaaaacagattcccaggccccaaggctcagggaatcagcttcaggaagcctgggctcagactcaggaatctgcatttctaacaaacacctcaggcaacatctggtggacggaaacactgtctttggtgctgagccaccaaactctattctgcaggtgttggatataaaacaaccagaatcagcagaaaccagtgtagaggtccaaagtagtgataaaaaaaaaaaaaaaaaaggagaaacatctgggacatctccgtctacctgaggccctggactgctgggtgtcttcaataccacatttcctggtctgacctagatgggccttttctctaaggccggcctccagaagccagggtgaagcccagaacattacacacaatgagatgcccatctgttcctgcatggggcagatcgagggtgcctatttatccaagcctggtagtcccaaacagtgatcaccctggttaaataaatacaaaaaggcaaaacatcttttggaattgttacatgctggttatatcatgcctgaaaattgcaaatgaaactagtacatgtaccaatgcctggtcataaatgaacacattgtttactacaaattctgctgaaataaacctgtcttcacatacagttgctaaggcacttgtgcttagaaaaacaaatactttaaagacaaacaataccttcacattttcccttcaaaagtgactaatttactcaatacttctgaaaaattgtaacgaacttcttctggaatccccatattaccgcatcccacacttgccaataactatatggagcgctttggaaacgccgagggaaatagcagacttggtaaggcttaaaaaaaaaaataaggcaagatcatagatgggatgaaaaactcaacttgaatgcttccccgtgaagtcagtctacgtttgatccaaatggttgaactccaaaagcacctcagcagttcagctctcttgatttcaaacccctgcccacatggctcaaatttgcaacttaaatattcggtatgaaaacgaaagttatttaactgttagcacaggctctcttctccaaaagagagtaggaagggcatacgtttcggcccacacacatacgccgatctttgacttctaaatatcagggcacaacacacacaattattttggctttgggagacaacactgtctgttatgttggggtgggtagttacaaaaaaatattgtcttgaacactgccagagctgacgattttatgcatgtgtagtacaaacggttctttttcattttggaaagaaaaagcacttaaaaaaggtttggtagggaggctctgcagcgatatttcacctcaatacatctttcaagtttgatagcttgtaagctcacggctttggttcttgtcttcaaccttcagacaactctaagctggctacagcagctgcagaggctgagtctttaaatgaaataaagaaataattgcttcagggaacaaagggaagcaaaaaaaaaaaaaaaaaagtcctgttagctgaactatgtggccccttgggacggtgtgtggtgtgtattcctgatgaatattgttcggtgtggtaaaggaatccctgcaaaaccccagagactcagaaaaagggtggcgtggtagtagaaacagtgggcttcagaggtgtacctgggttcgagctgaggctatgccactgaccagctacgtgaccttgagcactggccctcacctctcagggtctttgcctcttgtctgtgatatgggaatgacattacctgtctcacggggctgtaaatgaggcctggaaggatgatgtatgtcatgtgttgatttcacgtgggcaaactgaatgcccttggttatctctccccgctccccaaactctactagtggggaatggtataaatatataaaccaaaagaacaggagagaaaatgacatcccatcagatacagcaacaaaatgtcaggagatggaaagcagatggataagtcatcagtgtcttacagtagatgacgatgaaacctaaacagcagatttggggtggggcaggctccatcaggttctcctgcaggtgaggctaaaaacagggggactagttaaagactatatgagggccagatgcaccccaggtccctgccaccaccgcacacaatcaggcaaactacctctcccctatcttctcaggagagatgttcacaggtgaaactggactggggagcttgaaacatgggggcaacaggcacagaagaagaaagggatatgacgagatgctggaaatagggagatgaaatcctggttttcatagggcatgagaagctggctgtcccctcttcctgtttggctcccagacaattaacagccaagtttccactcattaggggggactacagggctcctctcagcagtgatggactaaacaaagacaaaagaaatgcagatagtcctgtttgggatccccaatcaatgactaggtcctcccctgcctgataatgcttctgtgaaatctgcaattcaacagatcccacccatgcctatagaactttcatatgtctttttacattcttttttttttgttttgagatggaggctcactcggtcgccagactggagtgaagtggcacatctcggctcactgcaacctctgccttctgggttcaagtgactgtcctgcctcagcctcccaagtagctgggattacaggtgagcaccaccacgcccagctaatttggtatttttggtagagacagggtttcaccatgttggccaggatggtttcaatctcttgaccttgtgatccacccgcctcggcttcccaaagtgctgggattacaggtgtgagccaccatgcctggcctacattctttaacattaatgggtagccaagcatcactagacatttgacaaggggggggggggggagaaaagcaaaacaaacaaacaaacaaacaaaaaaaaaaaaaaccaaaaacaaaaaaccaaccttccccctgaaaaaaaaaaaaacagaaaaaggaatccaatgacaagatacaacgcaaagaacagaagaaaatgtgaaagaaacaataattacaattatcatagagataaaatatgtaatatctatgaaattagaacagaataaattaaaaaatcagaaagccttggagtgaaaaaggaagacagcagctataaagaatttcaatgggccgggcgcggtggctcacgcctgtaatcccagcactttgggaggccgagacgggtggatcacgagatcaagagatcgagaccatcctggctaacgcggtgaaaccccgtctctactaaaatgacaaaaaaattagccgggcgtggtggcaggcgcctgtagtcccagctactcgggaggctgaggcaggagaatgccgtgaacccgggaggtggagcttgcagtgagccgagatcgcgccactgcactccagcctgggtgacagagtgagactccgtctcgaaataaataaataaaataaataaataaataaataaataaataaaagaatttcaatggaagaattttaagactcacttgaagaaatgaacaaaacaaccaaaaaatgaaagacagaagagaaaataaggaaattcaaggattaaactatgaaacccaatatccaattaaggggtgcagcagaaggaaagaaaagagaaaacacaggaggtaatcatgaaagctataagaaaatgttttgagaactgaaggacatgaattttcaaactgaagcgttcacaaaatacccaacacaataacgggggtaagcggggaagttatgctaaggccttctgtgtgaaatttaggatgctgggactaaagagatgctcctaagagcaaaataggatgtacaacaaggttctggaatcagacaggcactggacttctctatggcaataccggaagctagtagtcaaggcaagatgcctccaaaatttggagtgcaaattgtttccggcctaaaattttatatgcagtcaatcaatcaacaacaagggagataataaagatagttttggacaagtactatctcaagaaaatttatttcccaagtactctttcttagaaagctaggggaggcttaagggggtaaatcaagcaagaaaatgagttccaggaatgaagggctccaaaagaagaaagagttgatggaaagtctcaagaagatattaagaaggcctagcagaggagtgctgtcctagacagctaccagtttggactggtttagaaggacgaggactccaggagagctgaccccaaggaaaatataaaaaagacagattatttgatgtgcatctgacgatacccacaaattttttttttttttagtttggtagtaatttagggcaagaattataatagacaaaggggaaaatccatcctggctaacatggtgaaaccccatctctactaaaaaaaaaaacaaaaaatcagctgggtgtggtggcgggcgcctgtagtcccagctactcgggaggctgaggcaggagaatggcatgaacccgggaggtggagcttgcagtgagtcgggatcgcgccactgcagtccagcctgggtgacagagcaagactccgtctcaaaaaaacaaaaacaaaacaaaacacacaaagggaaaaatgacaataagttccaaaaaaacacaaaatattgcatgagaaaggagatctaattacaataaactacgtagctctgttaatgatattgatatggtcaaaatgaaaacaatgagtgataactaacaattgtagtttaactctgttggtagcacagagaaagaagtgtgagtgcctgagcatgtgtgtgggcggacaatgaaagaactaatcatttcccacaggaggaagttaagagacagcttctagaattgcaagcaaatcgagtcatgtcagtacaagtacattatttagaaataagaaagcaaaaccaagaagagagtgtgaaagagttgaaagtaccttcctttggagagtggggtgtaggggaaggaaggtgaaacaggtgactcttgctttctgttttctcttttgaaatacaccctgcactatttgtctttttaaattatgccattattttgactcatcaccaggtgaaagtctatgtcaaatgcatgccactgtgtgtggattgagggcaggtgtagggcaggatgggggtgagtgccacctgcatctgaacgccatggaacacgcaggtattgggtgttagagacagaagagaacacacattcattacactctcctcttggctgctcagcaagcacgtgtgcgcgtatacgcacaaacacacacacaggtatatacaatttcaagcaaatttgatacatttatcaaaatataattatcccaagcacaaccaaaactgcattcacttccttcccaacgggagaaaaatctcaaatcacatcttgctacagtatagcgagggaaggaggggcctctgtggtacaagtcccagatctctggttaatggtcatcttctcaacccagttcataaatagttctccatattatgaccaagtaatttagttatttccaatatatccgatatatacctgtagacaaatgccctgaggatgctaccaaaagctcctgtttggaaaaggggaaaggcacacattgccacccagtccaggacgtacatgcttcttattagggtgcagtaaccctgtcccctgggaggctcattcttgtctaatgtcctctgctgaaaaagacaaccctttgggggtttccgcactacctaaggtcagcttcaaaaagggaatgttgcatagccatggtgaacatggaacaagttctaggaagaaatgaggatccagaagtagaatcaacccgaacaaatattactgtcaaccaaatagagtttgtgtgtgttgtataaaatcactgtagaattatatgcttcaattactgagattaaatattcagtatcaggaaaaagcttgcctttcttaaaaagtatgttttggctgggcgcagtggctcacacctcccagcactttgggaggccgaagccgaaaagtcacccgagccgaggagttcacgactaacctgggcaacatggtgaaacctcgtgtccactaaaaacacaaaacattagctgggtgtggtggtgggtacctgtagtcccagctactcaggagggagggaggatcacctaagcctgggaatttgaagctgcagtgagccatgatcacgccactgcactccagcatgggcgatgggagtgagactcggtctcaaaaaaaaaaaaaaaaaaagtatgtttctttcctttcctattaaatacttccattgtggtacacatcatatttccctttctgtgttggttttccaagattctatcctcagtgctaaatttaatgctcaaatatggtattagtttaggaattggacatattttatttacgttctcttctacatgtaaacattttctattctttaacagctttgagattttatatatacatacatcttttattgtaaactacccatgtcctctttggaatacataggtcacaaattataaataaaatctatcttgggataggatttgagctatctttgctaaactgccctacaagattcctagagattgaggttggggaagaaactgggctttgaacagtccaaaggctccgctagccagtctttattgcttgctgttttatcttaagtctggttctgcaggctaaactctgtgaacgtattcatttatttatgcttttgtgtatattttggtgttgtttccaaggaaaagttctctttcaaatcctcccgccttgccttagttgaactaaggagaagtgggattttctcctgtgttgatgtgttcctgagtgttggatggggtgctgccagctaaccagaccaggactagagctaaggaagaagctgctggagctggggcagaggcactgggaatccaggaggtacaggactggcccagaggtggatggacggagtccctgcccacagggcaattcctttacacaaagaagaacctcagacaaataaatgggtactaaacatatgaacgatataagggtagagcaaaggcatcctggaagtcagtgtcacggtctccaccgtggggcctgtccgtggggcttcagcattcactggcgtgggagacctgcagcttaggtgtgtcaccaccgtgtggtggaagggagagtgacaggcatacagagcccagtgggttcccagttcagagatttatggtgcttttctaagccacagcttgaacaaaaatagaatctgtttattaaacttgtctctttcataacacaacacagacttcagaaagataactttacagcagacaaaataaagaggaggcactcatatttctccagctacctgctaatggctaatctcgagcatgctttattctgaggcctacaggaaggagtttcctcctctcacctccaactaaaaagaatcccctttctttactttggcattgaaccccttcagcagcacagctcacagtcctggccctggcttactagggcttgcagaatcatcttgcttcaccaagctggtttggaagcagcagaatttcctcttgagccaacaagtcttcccctcgctgaatgctctctggctgtttctaagaatgtgctctgcagttcccatgccccaagtcctcagatgccactagctattcagctctcatgccccccatcttctctccaaacacaaggccttacacccaaccagcaagcaactctaggaagattattttcaagacagattaaagtaacctgacagaaaatagaacaaaacatgaatatccggtatcatcatggatactggttggttaagcaaatttaaattcatttcaccaatattattgaattgggtacaatcactaaataaccactgggacacagcagccagggacctccatgtctcctaggtagataaagaaaaataataatgaatagtgagagcatttacaaagtgccaagcattgttctgaagaatacacatgctataattcatttcaccctcacaaatctcccaatgttgggtagatcccatgaatacttctagtttctaggcagtattctaggagtatctaagggatgctcgaggtctcacagctggtaaccaatggagctggattccaatccagaaagtcagattgtagacccctcaaaacagtgtctgcagccactgccttacacggcttcctggggaagtcatcccctacctgtaatcagcttatgaggacctcacagaagatgtggaattttagagactttttttttttttaatgagaacattataacttgggcatgaggtagctatgaagaattctcaaagacctgattaaggtccttggataagtgatgacagtgagataggaggtgtaagaaggtccggcggtctacccagaaaatgttaccataaaaatagaatactgtcattaattttgaagtgaatacgacactttgtactttgcaaagaaccgtgacatatatgttatccattttaagctttgcagtaaccccagatgtcatgtttaactttttatgtggtcaccatttatagtacttttttttttttttgagatggagtctctgtctgtcgcccaggctggagtgcagcggcacgatcttggctcactgcaagctccgcctcccgggttcacgccattctgctgtctcagcctcccaagtacctgggactacaggcacccgccaccacgcctggctaattttttttttgtatttttagtagagacggggtttcaccgtgttagccaggatggtctcgatttcctgacctagtgatctgcccgtctcggcctcccaaagtgctgggattacaggcgtgagccactgcccctggcccaagtcttattttctccatcttatagatgaagcaaatgatgaagattccacggctagcctagaggtggcctagggtttgggtcttctgatgtctattgcagtgctgttggtcacatcttgctaatttggccccagggtcagcaaagaactcttagtgagagagatggcgtaacacaagataggaaggaaaggaaagatatgaagtctggctggaaggcctaatggtgataaagtgaaagaggaagagaactcgtattttctgagcccttactatgtgcaaaaccctatggtgggcctcaatggctcaggaaagctggaaatacaacagaatcactgaaagagaagattcctgcatggaaggcaactgttgcttctccatcaggatcagctctgagtgagggtggaacatctgaagccaggcgtttcataaacaggagctttggcagtcttacactctttagagcagacaacaaggagcagacaggaatcaggaatcgctccttagagacttccagggatgggaagaatgcatgggaaaggattcttaagaaggtgtgtgcagaggagggtacttcattgatgaaacataaggaagaactaggggccagggaaactctagtgttggtaagcattatggactgaatcgtatcaccccaacattcatatgttgaagcccaaatcctcaatgtaactgtatttggagacaggaactttgaaaatgtaatgaaaatgaaaatgaggtcataagagtggggtactagtccaataggactgatgtcattataagaagaggaagagacaccagagggctctttccttctctgaacttgcatactctgagcatgcacagaggaaaggccacgtgagcacagagcaagaaggcagccatctgcaacccaaggacagaagcctcagcagaaaccgaccctgctggcaccctgatcttggatttctaatctccagaattctgagagaataaacttctgttggctaagcaaccccgcctggtattttgttatggcagcttgagcagactaatggagtgagccttgttggccctgccacctccctggctcttggccaacactaatttatatttgaaaactcagagtcacctcttctatgaggtctttctcattcatcctagccatttcttccttgatgcctcctctctatgtgaagggatcttatcttagaacccataacactttattgacttagtcttttttaaaacaagcctaactgttcctattagactccgagccccttgaaagaagagaccaccttagtcaactttatagtcctggtccctagcatgtagcagacattcaataattgtttatagacaaattaaagaaatgaacaaatctaggatattatcttgaaaatgtaggctgggaccaggcacggtggctcacaccagtaatcccagcactttcgggagctgaggcgggcaaatcacgaggtcaggagttcgagaccagcctggccaacaggtgaaatcccgtctctactaaaaatacaaaaaattagctgggcgtggtggcaggtgcctgtaattccagttactcgggaggctgaggcaggagaatcacttgaaaccaggaggcagaggttgcagtgagccaagatcgcgccaccgcactccagcgtgacgacagaatgagattccgtcccccctcccccccaaaaaaaggaggctgggtgcagtggctcatgcctgtaatcccagcactttgggaggccaagacaggtggatcacctgaggtcaggagttcgagaccagcctggccaacatggtgaaaccccatctctaccaaaaatacaaaaaattagccaggtgtggccaggcgcagtggctcatgcctgtaatcccagcactttgggaggccaaggcgggcggatcacgaggtcaggagattgagaccatcctggctaacacggtgaaaccctgcctctgctaaaaatacaaaaaattagccgggggcggtggcgggtgcctgtagtcccagctactcaggaggctgaggcaggagaatggcgcgaacccgggaggcggagattgcagtgagccgagatcgtgctactgtactccagcctgggagacagagtgagactccgtctcaaaaaaattagccaggcatggtggtgcatgcctgtaatcccagctactcgggaggctgaggcaggagaatggcgcgaacctgggaggcagagcttgcagtgagctgagatcgcaccactgcactccagcctgggcgacagagactctgtctcaaaaaaattagccaggcgtggtggtgcgtgcctgtaatcccagctacttgggaggctgtggcaggagaatagcttgaacctgggaggtggaggttgcagtgaaccaagatcacaccactgcattccagcctaggcaacgagagtgaaactccatctctcaaaaaaaaaaaaaaatgtatattagtgtaaatgtaaatgttatgacatgattaattaatgaattcattcattcaacaataaacttgtaaatggctggaaggaaaaaaagaagtaaattgttgaaagactaaaaaaaaaaaaaaacaaaccaagggcatttctagatagcgaagacatgacaaaatgaaggattagctggattagctgtgtaagtgaatataaagcagttatttgtagtaaccgcttgccatgcagtatgattttaattatacttaaatgtaaaggatagctgtacagagtaggggctgtgtgagctccaaggtgagacaaaggtggtggctgaatcctgcctctgctaatactagttgggtgattttagacaagttactaaacttctctgggcctcatctcattatttttttcaacataaatcttactcaagtataatacatatacagaaaattacataagctgtcaagagacaagctcaatgaatttactagttgccttatcttgtaaatgggaagaataacagcatctgttcatacaggacaggtatgaggacttcatgacatgatgctttggaagcatttggcatggtgtccaatgcacagtgaacctccaaaaacgtcagctctcatttatgtttacctcattaaactgcaatcttaacttgatgtagagatgttcaaaccttgtatcattttgcatacagtctgatagcatatgcccagagtttgcaaaaaaaaaaaaaaaagaaaaaaaaagaaaaagtgaatcctgctcctaatgtggtttagtgagtatagaaactcatctttagaactgagtatgagaatctcatcactgtcacccttcctgccactcccacttaatggaatgattcttcatctacttaaaatgccaaggaagcttagagtcagggccagaggtggcaacaaaatggatgtggagatgcttccttggttggtacatgaaagagagaaagacatcttttatttcagcattcgtgacttctcatacaagctgaatagaggtcatcattccagggctaggcaacagcaagtactcaataaatgtttgttagccggatgcagtagctcacgcctatggttcccattacctgggaggctgaagcaggaggactgcttgagcccaagagttcaaaaccaccctgggcaacacggcaagaccctatctctaaagaaataaaaataacagtaaaattagccaggcatggtggcacacacctgtagtcccagctgcctgggaggttgaggcaggagaatcacttgagcccaggaggtcaagactagcctaggtgatatagtgagtgtctgtctctcaataaatgaatgtttgttagctggggatgcagcaggagcatcttctgaaagaagggcaagttgggaccccactgtatcttaagcggtgttcctataaacaaagttattccatgtacctagcaagggtggaccaagtggttacctaaatagagatgacctgatgggtaaaaagaagtcctttcttttcccaagtgtcttccccaaacagcttcaggatacccaaaattccactgctggtagattcctgtttgtcacagtcagcctcctcctccgttcccatttaaaatggaaatgtcactggctgggaaagcacactctgtttctgacgtgggagcatggatgaactgatgggagtcctttcctcttgagcagaagaagatggacagtaaaagtgtcagtgactgaaggaagcatggatgtgagcacatgtggagcgtgagttggcggaggtggaactttctgacctctgtactttggccagcccagccctggcacccacaggcacaggagagttcctggcaatggaaaggctgatgaggaaatcagctcaggttttcctaagtgctcttccaacatcttccttccactgccacgtgcactcctgctttgtctttccctcttccaagtaactctctgtgagcaaatgtacttctgttattccactttaaaaaccaaaaaaaccgggccagccatggtggctcacgcctgtaatcccagtactttgggaggccaaggtgggtagatcacctgaggtcaggagactgagaccatcctggccaacatggtgaaaccccgtctctactaaaaatacaaaaattagccgggtgtggtggcggacatctgtaatcccagctactcaggagactgaggcagaagaattgcttgaaaccagaaggcggaggttgcagtgagccgagatcacgccactgcactccagtctaggcaacaagagcgaaactctgtctcaaaaacaaacaaaacaaaacaaaacaaaaccaaaccaaacctgagtagcatctgtccttgcaagcattcctttgcaactcctcagaagatccaggctcttctaagtagcagcagcagatgtggcttaaaacaagatgcttgaggggaatttacagtctgtgaccaattagccagatgcactcaccttcccacctggtttttctcttgtcggtgttttgcgagccctctctcactttccttgattctctgttggtagaaggtcatttccctttggcctaggagtttgcagtctgaggccatcttgggttcacatctgcttctggacttcagatggcactggtgaccaacacaagccttctccaacacacactcacgcaggcacagtgaccttttctcccggatgcatagctcatcatagttttccacattttttttgtgaattccaacttcagatggtgcaaatgtggtcacatggttaattcccaatctatgctatacagaatgctgagccttactgtgtctgcatgtcatttcccaagcaaaccgaggaactgtatttcagccacaaaacctcgatgatttggaaggaaaagaggggattgcctgcgtccgtcttcattcttacgctttttttttttttttttttttgagacaagagtctcactctgtcgcccaggctagagtgcagtggcgcgatctgggctcactgcaagctctgcctcccaggttcacaccattctcctgcctcagcctcctgagtagctgggactacaggcgcccgccaccacacccggctaattttttgtatttttagtagagacagggtttcaccgtgttagccaggatggtctcaatctcctgccctcgtgatctactgcctcagcctcccaaagtgcagggattacaggtgtgagccaccgtgctcgggccattcttacattatttaatactggtcataccacttcctgcttccagtcagtgaagtagagttaccgctgtgtctagaagctaccgctttaggctatttgttactctaaatgtaatgtaaactcctttcctttcagtttgggtttgcctcaatcaactacgtttgccaacacttggagatgtagagagctttaagttgttatctcgtcaagatcttggaacctaggcagggcatgaacatcaatcacccaagataaacatttgtttcaccagtgtttataaatttctggggttgaaaattccccaattaggcagggtgcggtggctcatgcctataatcccagcactttgggagaccgaggcgggcggatcacctgaggttgggggttcgagaccagcctgaccaacatggtgaaacctcgtctctactgaaaatacaaaattagccgggcatggtggcgcatgcctgtaatcccagctacttgggaggctgaggcaggagaatcacttgaacctgggaggaggaggttgcggtgagccacggtggtgccattgcactccagcctgggcaacaagagcgaaactccatctcaaaaaaaaaaaaaaaaagaaagaaagaaagaaaaagaaaaagaaaattccccaattatttaaaaaacctgtgagtcatgacctccccaaatcacaattatggtaaactcccctcccccttttattttgcttcagctagtttgagttgggttttgaaccttagaaatgttttgtagttttcttcgtagatctacttcttgttgagcttttatagctatcgtgaatgcaatctgttctccatctgtgatgttttctacctggttatgagtgttatatgagaatacaatttttgtatatttattttatatctggcaaaggacttggcgttcttagtttttcagttgattctcttgaaatttccaagtagacaactggaaatatttgcaagtaagatgttaattttggcttttcctctttatttattttgcatattgcagaggttgtgccttccaaattaatgatatgtattagttatgagatgggacattcttattttgttcttttttttttttttttttttttgagacggagtctcactgtcacccaggctggagtgcagtgatgcaatctcggctcactgcaaactccacctcccgggttcacaccattctcctgcctcagcctcctgagtagctgggactacaggagcctgccaccacgcccggctaattttttgtatttttagtacagactcggtttcactgtgttagccacaatggtcttgatctcctgacctcgtgatccacccgcctcggcctcccaaagtgctaggattacagacgtgagccaccactcctggccccttattttgttcttgatctgatcctctagtttttcaccattaggcaaaatgattagtaatgtttagtttgtgatagttattatttagcatgataatacagtgtgtgtcctttaattcctagtttctgaagagtaatttttaaaaaacaacaacaactaagaacagatactgagctctattaaatgcctttttagtatctactaaggtgattacaaggctttactccatttattaatgagatgaatcatgttaatatgtttcctaatattaacctctctttgtacacttgagattaatttggcttgggcacagtgctttacttttttttaatttttattttatttatttatttatttatatttatttttgagatggagtctcactctgtcgcccaggctggagtgcagtggcgcgatctcggctcactgcaagctccacctcccgcgttcacgccattctcctgcttcagcctcccgagtagctgggactacaggcgcctgccactatgtccggccatttttgtttttttttttgtatttttagtagagacggggtttcaccgtggtagccaggatggtcttgatctgacctcgtgatccgtccgtctcggcctcccaaagtgttgggattacaggcatgagccacggcgcccggccagtgctttactttttaaatagaaaactagatttattttgctattgttttaggtagggcattttagggtaactatattcataagtgagactggcatccagatttgtaagtaaatgttatctttgttgggtatggttattagagttattctaaattcatatagtgaaataggatgccttccttcttttctgtattctgaaatagtttatataacatagaaattatttttcctggaaagtttgaaatagtttgcccataaaactgcctagtaccagagtattttggggaggataattctttgtacactcctcctgtttctttctcagttactgttccatttatgttctctaattactctttaaactattttgggaacttgaagttttctagaagatcattgaaccgttaattagtataaatttataaatagtattctctaatttttaactcagcatctgtgtttatataccccttctcatccttaatatggtggttttgttttttttcttttttgccaaaatacttggcagacatttgcctatttaatctgccttttcaaatagatagtttttatatttattaataaacctactgtttatatgctttcaaatgcactgacctcttagtttgtcctgcattccttaagttggcttaatctaaagtcctaaatggtatccttaagttacctattcttatttttttctatttgtatattccctggatgctttgaattcataactgtgcttaaatagccaccctgctctaaaagctctaagagtgagcagaagcggtgtggcccacttccaggcatggacacataagcagcacacacttcatgctcttttccgcttctgaagtgtagccataaggtgcccatgacctggctttgaccaaggagatgaggatccacagagcactggtggagacaagacagagagaaagtgggctgagaatgactccatgaaaaggcaaaaccacaggaatagaagtcagatcagttgtttccagggtctgggggttcaggggatgaggagaaggcactggccacaaaggagcacaagggaactcatattcggggtggtggaaagattcagtatttttattgtagtagtggttgtagaactatttatgtttctcagaactcacagaattggtcaccgaaaaatggtgaattttatatgtgaattagatctaatatagattaaaaaaaaaaaaaaaaaggaagagacaggcacagtgggtcacacctgtaatcccagcactttgggaggccgaggtgggtggatcacaaggtcaagagatcgagaccatcctggccaacatggtgaaccccgtctctactaaaaatacaaaaattagctgggcgtggtggcgcattcctgtagtcccagctactcaggaggctgaggcaggagaatcgcttgaacccaggaggcggaggttgcagtgagctgagatcgtgccactgcactccggcctggcgacagagcgagactctgtctcaaataaataaataaataaccctaggaagaagagacttctccctccaacctagactgctcactccagagctgttccatgaaacacaaatacagttctacattctataagccacaatactgttataatatggttgcatctctctgttgtagtacctttaccctagtgtgtgtgtgtgtatgtgtatgtgttacacaaaagtattaacactgataaatagtagaattggagttagttcattttctaagttttgttcatctatattttcttcagtaaatgtgatttcgccacacataaaagaaaatataagaaatgttgcatattttagatctatatccagccaaaaagttaaattactagggcttaaaattaatctctaaaattagtacatgattaaggcggctttcaaaatcagtagaaatagggatgaacttttaaaataaatgctaatggaacaactgagtagccatctgtaaaaacatacacttcacaccaggataaactccaaatggatcaaaaacttaaatgcagcaaacaaaaccattaaaggtctagaaaaaaaatccatgaaataattcctttatgttatgtggagataacctttctcaccgtgacttaaaatctggacgtcataaaagaacaggttgataattacgactacctaaaaattagaaacttttcatgacaaaaaaaaaatcatcataagcaatgtcaaaggccaaataattaggaaaaaaatatttgaaattcattatcacacaggatccatctcccaaatttataaaaagtctctcaacttggtaagaaaaagatcagcaatccagagaaaatcagcactaagaacatcaacagactgttaagaaaaaaaaaggaaatacaaatggtcattaaaatatatccaaaggtattctatttcactcataagaaaaatacaaaagagtagccgggtgctgtggctcacgcctgtaatcccagcactttgggaggccaaggtgggcagatcacctgaggtcaggagtttgagaccagccggaccaacatggagaaacctcgtctctacaaaaaaatgaaaataaattaatacaaataattagtctggcgtggtggcgcatgcctgtaatcccagctactcgggaggctgaggcagaagaatctcttgttgcagcgaaccaagatcgtgccattgcactccagcctgggcaacaagagcgaaactgtctcaaaaaaaaaaaaaaaaaaaaaagaaaaaagaaagaaaaaagaaaacgaaaaatacaaaataaagctcttaggtttaatcatatgaattaccaatgttctacgatttctgacctacacaaatggtaatttcatgtggttcaacttaatacaatgaaataatattttttcctctatcagactggcaaaatcccacaagctgagtgccataatctttccacgagactgtgaggcgatagtcttatacaatgcttttgggagtataaaaccactttggagggcaatctggtaaaattgatcaaaatttccactctgggaaccatcctttagctatacctctacacatataaaagaatgtatgtgctaggtacagatgagtgttcacaatatgctacctttcatatatgggcgaaaaaaaaaatatgtatatatatatatatatacagtccctgacttatgatggtttggcttaacgactttttcactttagtatggtgatttcagctgtatacagtgaggactcacagaaccatcctgtttttcactttcggtatagtattcaataaattacatgagatattaaatattattattattattattttttgagatggagtctcgctctgttgccaggctggagtgcagtggcgcggtctcggctcactgcaacctccacctcctgggttcaagcgattctcctgcctcagcatcccaagtagctgggattacaggcatgctccaccacgcctggctaatttttgtatttttagtagagatggggttgcaccatgttggccaggctggtcttgaactcctgacctcgtggtccacctgcctcagcctcccaaagtgctgggattacaggtgtgagccaccgctcccagccaaattacatgagatattaaatattgtaaaaaagacttgtgcttgatgattttgcccaattgtaggctaatgtcagtgtcctgagtacatttaaggtaagctaggctaaactatgatgttgcgtaggttaagtgtattaaatgcattctcaattaatggtattttcaacccacgatggatttattgggatgtaactgcattgtaagttgaggagcacctctatatgcacttgatttgcttgtatggtgatgtatgcgtagtgatgctgtggtcaacagtggacagcatatatcatggtggtctcataagattacaggtgccctatacaggtcccctatacaggtgcatcttttttttttttttttttttttttgagatggagtcttgctctgtcacccaagctggagtgcagtggcatgattctggctcactgcaatctccgcctcccaggttcaagcgattctcctgccgcagcctcctgagtagctgagattacagatgcgcaccaccattcccggctaatttttgtatttttagaagagacggggtttcaccatgttggtcaggctggtcttgaactcctgaccttgtgatcctcccacctcagcctcccaaagtgctgggatgacagccatgagccactgtgcctggccacaggtgcaccattttaaaatcctttatgttgtacttttattatactatttatacgtctagatacataaatatttatcattgtgttacaactgtctacaatattctgcatagtaatacagtgttcaggagccaaggagcaacaggccataccatatagccaaagtgtgtagtaggctatgtcatctaggtttgtgtcagtacactctgtgatgctcacacaacaaaatcacttaatgactcatttctcagaacacacccctgttgttaagcgaaacagacctgaaaactttctcaaagcagttactcacttagggaaggagagggagtggagaagacagggagcggggaatcaaattcctcagcgtagatgttgttcatcgtattggtgattgaagtaaatactcaaaataaaaaacaaattaagggccaggtacggtatctcacacctgtaatcccagcactttgggagactgaggtgggtggatcaactaaggtcaggagttcaagaccagcctggccaacatggtgaaaacccgtctctactaaaaatacaaaaaaaaaaaaaaaaaaaaatagccatgcgtggtggtgcatgcctgtaatcccagctacttgggaggctgaggcgggagaatcacgtgaacccagaaggcggaggttgcagtgagcccagatagcagtactacactcacgcctgggcaaccaagcgagactctgtctcaaacaaacaaacaaacaaaaacaaataaggaatttaagaagtaaaactgcaggttttgacaattaaaatgaatcatttacgccgggcatggtggctcacgtctgtaatcccagcactttgggaggctgaggagggaggatcatgaggtcagcagtttgagaccagcctggccaacatggtgaaaccccatctctactaaaaatacaaaaattagctgggcgtggtggtgcatgcctgtaatccctgctactcgggaggctgaggtaggagaatacctggaacctgggaggcagaggttgcagtgagctgagatcctgccactgcactccagcctgggacagagcaagactccgtctcaaaaaataaataaataaagtaagtaaataaataaataaaatgactcgtttaccaaggtcttataaatcatcagtgccactgtgctgcatcatttatgtacttacaactattttttgccatcccccccaccaaaacaaataaaaaaccataaatgtgaattccatcactaggctgacgatcctgactgcctccctggccagtttctccaccttttctatgtcctgcttgggggagggctgacccccacatggggcaacacctgggctctcctgacttcggtcttcctctcgggtcagccaaaggaggcactggctggaggtcagaggtcaaaaggctaaagctgggggattggagttgcttctcctgttctcttcttgcatcagcagtggttctggcaatggctgcatccccttttaagcaaatttcctgtctgctgtgatctcctactgagttctagtaacactattttctccctcttactccttagggcctggaagcggggtggaattaacagtttcccactattgtttattcttaggtgcccgtcagggatcagaacgcgataccccagagtatggcactttggcatgctgagtactttgaactgagggagactgggaggcatcagaaaagcagggcctttctgaccttctcccatcctcctgtttcctgcccctctttgtcctctgagtcacagaagccagaattcctcttcccagaggctggtcttagaagctagaactcttctcccccaaaagcaagctataaaacctagaaaggtcactctctcccttctcccttgaagaccctcattccaaagggtttctgccccatacctgggagaaaggaaagctacacagagaggccaagaagacggaggttagcgatagaaaagcacaacagatttatttaatcaaagttgtatatgacgtgggggccttcagcaatgaagacccaaagacccaaggggaaaatgtccatttttatgcttagattcaatgaagagtggacagccatgtagaaatgtgatcaaacaaagacggtgtgatctaatagtaatagactgagtggggaaaccccgcaggacctgtctgctcagattcctcttggtctgtctgtgtgacattccttcctcccggggatagggcaggacccctttggaatgaaggtcttatgatctactttcagacaaggtaggtcagggaatttctttatggccagctcctacacagaaaggcagagtagaattagaggattatttctacgttttgagggagaaaggttctagttcctatgactcaccttggtgaaaaggaattacagccaggcgtggtggctcacgcctgtaatctcagcactttgggaggccgaggtgggtggatcatgaggtcaggagttcgagaccagcctggccaagatggtgaaaccctgtctctactaaaaatacaaaaattagctgggcatggtggcgtacgcctgtagtcccagctacttcggaggctgaggcgggagaattgcttgaacctgggaggcagaggttgcagtgagccgagatcgtgccatagcactctagcctggaggacaacagtgaaactccgtcaaaaaaaaaaaaaaaaaaaaaaaggaattctagtttctatggcctgccttgggcagaaagggaagcaggagaaggtcagaaacagactttgcttctgaagcccttccaatgtccttcagttcaaagtacacagaatgtcaaagcaccatattttggggtatcgtttgcaaagccccaacataattgacatggtgttaaaaaccccaaggataaacataaaaggaacctaaaaaaatacaatcagaaattttcaggaagcctagttttctttttttttcaaaagtgatttttctagttgtttgcttccaataagcagcttattctttaaattctgacttgactaataaggggggtaaggggtggcaaattagggggatcctttgaaaaaaagaaaacaagaaccttccccattcttccaaagagccaatatccagagctctttgcaaaactgttagtcctatctctagaaggacatttttctcacccatttatattgtaacggaaaatatcttccacgaagcaaacatttttgagatttcagctttcaaatgcacggtacttgtgataaagggtgttttcaagccctcttcttcacttaacctgccagctaacatgggaaaccattagctcaggctgctacaattaactcagggcttcttcttgaaaggctcacacaattcccagctacttatcatgcaaacaacctgggagactcattttccttgcaatgcggtgggaggggtaaattacggagataagtagattattggggaaaaagtcacactcggaggccttatgaaatgattaaactctgggaaattcatccccctaaatccctggcccctgatagtacacattcattactggatcctgggtaatgtacaatgaagaacctcctttagaagcaataaatactcccactccgctgaattttcacttaactttttaaacagtgagttctgtagttttgatgagtgagagtcatcatatacgaagcaaattaaaggaaagggaaggggtcatgagacttgtaagatttttaaatactgtactgttttgctaaaataggaaaagtacaaatattaaaataaaaccaataacatataactctagaaaaatagggtcttactgacttccttggattaacttcataaactccatatcaacagaaaccatttcatatttgattaacagccttgttcaaatctattatgacaaaatatatactctctaagaagtatttcctatagcaaatatttgtcaatagtcaagttgactcttattagtcaagttgactcttattagtcaagttgacgaacagcctgaaatgatgtttcggaaagaaaaagtctaggaaagtaacttaaatgaatgtaaccatgagctggagacagaaaatgaaccctcatttttctggcaaaagggggaaaaaaaacaacatacaaacacacacacaaaaaaacaggcaccctgataaccaaaatcctaataagagaacttcgtggtggagactgttagtatcagcgttgactttctactcccagctactgaattgcagattcagattgcaacctcaggcattccaaaatacagcagtgcactcacttaaaatcgctcttggaaatacgcgaggaattgctaactctctaagtaaagctgagcctttttgatagaataaaacacatctgcttcttccttataaatagactattcactacctggaggaattcagtcttgcccccacctgtctgcttaaagtgaagatctgctttgtgaggtacaatgtaacctgctcttgtctcaatacaaaaccttcagtaaaggctataatttatcaaaattcttggagctgcttttgtatgtgagcaaagagtgtgcacctgttttgggaggagagtgggacaggatgggctgagatgaatcttgtggggttggggaggggtggtccacggagatctgttctcatttgatttatagtaaggctattccaatttttataaatgaaatacctgaagcttggagaggttaagtaacttacccaaggtctcgatgttagagctgggattcagatctacactgattttggaacccaaagtctaaatactatactagacttatcttggaagacagtagagaacacaatcctagtttgatatctcaaattgctgtacttcacttatgggagtagacattcctggatggaacagaattgaagattttgaaagaggaggagtcggccgggtgcaatggctcgtgcctgtaatcctagcactttgggaggccgaggtgggcggatcccaaggtcaggagttcgagaccagcctgacccacgtggtgaaaccgcatctctactaaaaatacaaaaattagccaggtgtggtggtgtgcacctgtaatcccagctactcaggaggctgaggcaggagaattgcttgaacccaggaggcgaaggttgcagtgagctgagattgcgccactgcactccagcctggtagacagagcaagactccgtctcaaaaaaaaaaaaaaaaagaggagaagtcagtggggtaatacagaaaacccatccccctggctattcgcagctgcctgaaatatgtatctgcaatggaatgatatgtatttcacaacagaattgagattcaaatgagaatgcacagcaagaaagtaagacagaaagaaacaattttcactaaaaaaacttggtgtatatattaatgaagaactgcttttagaaactgcaatatgtaatattaacagtgagataataatcacatttatagttaaatagaaagaaatgtttttaatatccatgaaatgaggcacatatatcttggcatccctatttgaactgtgattaaaatagactgacggaatataaacagagtctagttattaagaacacagtcagtctgaagcccagttcaaccacttactagctgtgtggccttgggtaaatcactgaacctttctgtgcttcagtttcttcatctgcgaatgtggatattacatgtccctatctcattggatggttgtgaggattcaatgaaataatacatcgaagtacttgaaacagtgcctgataacatggtaagtactttataagtgttagtgttaaattctctttttttcttttttttttctgagacggagtcttgctctgttgcccaggctggagtgcagcagcgtgatcttggctcactgcaacctccccatcccaggttcaagctattctcctgcctcagcctcccgagtagctgagattacaggtgcccgccattatgcccagctaattttttgtatttttagtagagacggggtttcacctgttggccaggctggtccgaactcctgaccttgtgatttgcctgcctcagcctcctaaagtgctgggattacaggtgtgagccactgcgcccagcttcgttaaattcttattaaacacataaaaaaacctatataagcatgagactctttttttttttgttttttgttttgagatggagtttcgttcttgttgtccaggctggagtgcagtggcgtgatcttggctcaccgcaacctccacctcctgggttcaagtgattctcctgccttggcctcctgagtagctgggattacaggcatgcgccaccacgcccagctaattttgtatttttagtagagatggggtttctccacgttggtcaggctggtctcaaactcccgacctcaggtgatccacctgcctcggcctcccaaagtgctgggattacaggcgtgagccaccgcgtctggcaagcatgagacattttaagggatatcataaaagatagtaaatgcacaggttaaaagagtaaggaaattcagtgctggtgggaaggctgttgaatactcactgagttgaggcttatacagaaatcacgcaagctggactgatttgttaggagagcaaggcagaattatgagacggaaggtcacttgggttaaagagcaggtctgagtggagttagaaagtggaatgacaggtggttacattacagagaggaatttttagagttagaggtagaacagttccagatgtactaactccactctgcagtcacggagatggagaaattatgacctagagtgttggatagatcgtcaaggtagaatcttgcgtccccaggcatcctccagggaaatgggttaaagaggtcactgtgggccaggcgtggtggctcaggcctgtaatcccagcactttgggaggctgaggtaggtggatcacctgaggttgggagtttgagaccaacctgaccaacatggtgaaaccccctccctactgaaaaatacaaaattagccaggcatggtggcgcatgcctgtaatcccagctattcaggagactgagacaggagaatcacttcaatctgggaggcggaggttatggtgagccgagatcacgccattgcattccagtttgggcaacaagagtgaaactctgtctaaaaaaaagaaataaataaaaataagaggtcactgtgaattgagtgtcaaaatcctcaaggaacatgggtgggtgataagaaagtcaaaacgtatcagtgaggggttttcgttgaagatgtcgacatccactgcagccggtttagcaaaagagggctttttaaaaaagggaattaggagcttataaaaccttcaggacaagcagaaaacccaaccaagttttgaggattcacaatcagcaccaatagatccaataatccaacaggacagttcctacagaaatgccactgctgcagctgtctgccaagggttacagagaacagtaggaactaggtgccagaatctgctgaacacaaagagccaaatgtccccagctgccatgcccatcacaagatctgatcccctgtgcacagctaacaccctgtaagggtcacttctatctctaagtctttttgagacggagtctcgcttctgtcgcccaggctggagtgcagtggtgtgatctcagctcactgcatgcaacctccacctcctgggttcaagcgattcttatgcctcagcctcctgagtagctgggactacaggcacgtgccaccacacccggctaatattttgtatttttagtagagacggggtttcactatgttagccaggatggtctcgatctcctgacctcgtgatccacctgcctcggcctcctaaagtgctgggattacaggcatgagccaccgtgcccagcctctccctttaaattcccataacagtttacctataggtctctctatttactttaagttctcataagagtttacctacatttctctgacatcactgatctcatttggtttaacagttatttatatacacgtcttaactcccctactgaactaagctttctaaggcagtgtatatgatctactgacttctgtatttttttcccagcaaccagtgtaactccttgctctctaaaaatgtttgatgaatgaaagatgaattaacactttcatgccctctattatatcatttggtgatttccaatgtccgtgaggaatagaattgccaggtagtcagccaatttgttttgaggtttattctaaccaaaatgctaaacttctaaaaatgctcataattctgggtcttgctatacttatactacagacttcccattagatcatgagattgggaatatatattttatatctgtttttttgttttgttttgtttttgagacggagtctcactctctctcccagtctggagtgcagtgatatgatctcggctcactgcaagctccgcctcccaggttcataccattcttctgcctcagcctcccgagtaactgggactacaggcgcccccactcccatgcccggctaattttttgtattttttttttttttagtagagacggggtttcactgtgttagccaggatggtctcgatctcctgacctagtgatccacctgccttggcctcccaaagtgctgggattacaggcatgagccaccatgcccggccgcttatcttttatatctgtatataccctgaggaatatcctaagccccccagccgactgaatggattccccttggccaagggtagcccagagaagccttaaaaaactgagttcctggctgggcacggtggcttacacctgtaatcccagcactttgggaggccgaggcgggcagatcacgaggtcaagagatcgagaccatcctggccaacatggtgaaaccccgtctctactaaaaatacgaacattagccagtcgtggtggcatgcacctgtagtcccagctacttgggaggctgaggcaggagaatcgcttgaatccgggaggtggagtttgcagtcagccgagatcgtgccactgcactccagcctggcgacaacgtgagactctgtctcaaaaaaaaaaaaaaaaccaacaacaacaacaatagtaacaaaaacaagaaaaaaacaaaaacaaaaacaaaaaacaaaaaaaacctgagttcctggccatgacaggatgggaagtcagacacctcattataccccctccctcactaaccaccataaggctttctttcctaagagttaaaaaaacaaaaacaacaaaaaaaaaaaacaagcagcccttttgagacttgctccactgctgatttacccaactgaccagcattccctcctggtaagagaccatggaccatggacaggttctggccagtttacagaggctgcacgcagcatgcttctgagtcttccatctcaccctttgatgtaaagagcccaattctaatgcatttaaatgctaagtctccaccccagagggaaaatgtgggatgcgtgtcacatgcatttgtttactacacatgcacaacccttttcataaatattcataactcctataacatgttgactatgtatatttagccaacctgttcagcataaattcctgtctcatgcttccctctctcaaagtgcctgcttttggtttctatcggaggctatgcttcccagcctgcaggatggccggcctacaaaaataaagctggtgggcatggtggctcacgcctgtaatcctagcacttcaggaggctgaggtaggcagactgcctgagctcaggagtttgagaccagcctgggtaacatggtgaaacgctgtctctactaaaatacaaaaaacattagctgggtgtggtggtgtgtacctgtagtcccagctacttgggaggctgaggcaggagaaaggcttgaacccgggaggtagaggttgcaagtgagccgagatcacgccactgcactccagcctgggtgatagagtgagactccatctccaattaaaaaaaaaaaaaaagtaataaagctctcctttccaagtatatgaacctcgtgattcatcagttgacacccctataatgtctactgtaggacatgctcaaaggacacgtgatgacttgtctaagttcagatgttatctgggacatgtggatgggccctgaactttgtctaagtatgatactgtaatttataatgagaaatatatatttggccttgtttaatttcctggcagctgatcctaaaacctttggaatctctaaagtgataagtgtctttctgaatgttaatgagatgatggctgactgggggctcctagatagcatcaggatgggggaacagaggaagcaactgtatgattaggaggtttgaactttcagccccatcccatgacctccgggaagaggagagcagctgaaggttgagttgatcaccaatggtcaataatttaatctaccatgtttatgtaatgaagcctccacaaaaacccaaaagtacagggtttggacagcttccaggctgctgaccatgtggcggtactgcgagggtggcatgcccagagagtgcatggaagctctgtgcccctacccataccttaccctgtgcatctcttatatctgcctgttcattgtatccttttacaataaatgagtaaagtaaatgaagtgtttcttggagttccgtgacccattttaagcaaataatcgaacccaaggaaggggtcctgggaacccccaatttacagctggtcattgagaaattccagacactttgacttgtgattgacatttgaagtaggggacagtcttaggggccctgtgagatttaactctaattccaggtagatagtgtccattgcattaaattacaggacatctaattggtatccgccagagaactgatgagcaaggaaaatcattcacacctggtatcagaagtgaagcattgcgggtgaggagagtggaataggaaaagacagtcggttcttttttcctatctcacgcactaaggtgtctataagatttctgtatgatatatttgtgtagatgaaaggaataagggacattagactggatttactctggaaaagatatgatctaacacaagagaggacaagaggcataaaagagccatagctctgtaacaatgaagagaactgaaaaagaaccagtggtgaaagaaagagctctatacatttctggaagacagaacgtaaatgggatagggctgactactcaaatcaaggaagtagtacggcctagaaaacacatgaggaagagccggcactgaagagggcaccaacctgccaagcacacccttgagatgtagagatggcaaagcatgagtgagaaatggggctgaaaacaggattcactgaagatctttacacagaccctcccgcttaccaagtgataaaaccgcgccaggcaaataagtgtcttatctatccacaaaaagcaaggctgttggccgggcgcggtggctcacgcctggaatcccagcactttgggaggctgaggcgggcagatcacaagggcaggagatcgagaccatcctggctaacacagtgaaaccccgtctctactaaaaatacaaaaaaattagctgggcatggtggcaggcacctgtagtcccagctacttgggaggctgaggcaggagaatgtcgtgaacccgggaggtggagcttgcagtgagccgagattgcaccactgcactccagcctgggtgacagtgagactctgtctcagaaaaagaaaaaaaaaaaaaaaaagtggggctgttttctctacacaaatcaagcaaactatctctgggagactggagctgctagtgtaggtaggtgttgctgtcctagaacagagtcctctgctttctggaccatgtcagggttggggcagggagtttccccagtgacctggatgcgaggcccatcaatcagccagctccatccacatttacatagagcttcccattggcctttctacttcccaattcttacatatgaactcgctctgaagatacatcacacacttgagcaaagtctatggcatgctatagaaggcacagaataagcaaatagaaaaactgactctagaggacacagaaataattttttttaaatacttcaagttctagggtccatgtgcacaacgtgcaggtatgttacataggtatttatgtgccatgttggtttgctgcacccatcaactcatcatttacatgagatatttctcctaatgctatccctcccccagccccccacccaccaacaggccccagtgtgtgatgttccccacccaggacacagaagtaattctgataacagaagagaacttgaaaacaaaatacaacatgtggaagactcttgttagtattcttgaagaaactagaaaaaaatattgtacccataaaaataatgacagaatccaatggagaaggaataatctagaataagaaagagcacttggaaagtaaatgacccacaccctaaccatgttttgacatttcagaacagcaacaaaagaaaggccctaaaagcttccagagtgaaaaacgaacaatacggcagtaacaagataaataaaaacaggtcacaaacaaattggactcgtgtcagagttctcatcagtactggagatgatcagacattaaagctccgaagataaactattatttagaattctatacccagtaaaactatcaagcatgaggatggtataaagcatttttccacatgtgagaattcataaggcataccactcttgcccccctgttttagaaggtttagaatatagttcaacaaaatgtgaaaactgtgataaaagggaaaaaatgagatcagagaaacagaataatcacacaggataacaatgaatagaaatgccagaatgacaagcagttctcaaaacaggggtgcagagccagtgcggattggagcagaagatagcatgtagaagggagctctccaggaaaatcaataaagagtaaatgacaaactagcaaacaaccaaagaaataaatgaataaatacattcccctagagattatctgatgaatttttccacgtggaaattagtactgtgaagcattttaagagatgttgatatattaaaaaattacccacaagtgcattaaaaactaaagaaaatcccaggactttgggaggccgaggcgggcggatcacaaggtcaggagatcgagaccgtcctggctaacacagtgaaaccctgtctctactaaaaatacaaaaaattagctgggtgtggtggcgggtgcctgtagtcccagctactcaggaggctgaggcagaagaatggcgtgaacctgggaggcagaggttgcagtgagccgagattgtgccactgcactccagcctgggcgacacagcaagactctgtctcaaaaacaaaaacaaaaacaaaacaaaacaaacactaaagaaaagaaaaaactgcattatcgatacctggaaaatttaagttatacaatacagaaaatgcaacagcagcacatcatttgattcaacaggaaacaagatttacagtcatatcccatccagactggaacaagaagccagagggtttgaggatcttggtctccagggaaaaaggaagattcggttcagaaaaaaatttcaaaataaaatgaaagccggccaggcacagtggctcacacctgtaatcccagcactttgggaggccgaggtgggtagatcacgaggtcaggagttcaagaccagcctgaccaacatggtgaaaccctgtctctactaaaaatacaaaaattagccaggcctggtgtcacacacttgtaatccgagctactcgggaggctgagacaggagaatcacttgaacccagggggcagaggttgcaggagctgagatcttgccattgcactctagcctgggcaacatagtgagagtccatctcaaaaataaataaataaataaataaaataaaataaaagcaaactggaaactctaggaaatactaaaggtgatgtttaaaaaataaaaaataaaaattttactggccaggtgctgtgtggctcacacctgtaattccagcactttggaaggccgaggtgggcagatcacgaggtcaggagttcaagaccagcctgaccaacatggtgaaatcccgtctctactaaaaatacaaaaaataactgggcatggtggcacgcacctgtaatcccagctactggggaggctgaggcaggagaatcgcttgaacccgggaggtggaggttacagtgagccaagatggcaccactgcactccagcctgggtgacagagcaagactccatctcaaaaaaaaaaaaaagaaaacaaaaaaagctagcaaattaaaacatggcatggtttgaaaccagtgatgggaagaaaagacaataaatgttaatattctcctttgattaccacaaggattatgatttgggaattacagggagggaaatatcattaaccatagctcatttcttggtattacactgtataatattcatatacacataataatatgaaagttatttactggctcttaacttctggaaccaacttaaaggtacagtatagaaatcttccttgtggccgggcatggtggctcacacctgtaatcccagcactctgggatgctaaagtgggtggatcacctgagatcaggagttcaagactagcctggctaacatggtgaaacctcatctctattaaaaaaaaaaaaatacaaaagttagctgggtgtggtggcgtgcacctctagtcccagctagtcaagaggctgaggcaggagaatcacttgaacccaggaggcggaggttgcagtgagccaagatcatgccactgcactccagcctgggacagagcaagactattttccaaaaaaaaaaaagaaagaaatcttaattgtgatcccaacggggcctccaaaaaaaaaaaaaaacttaactctagttaaattggagtgcaaacgttatcaacagctgatagaaatgaagggcagagagacgagagaagaggtagaagaaaggtgagatggcatactgtctataatcagtgatacaggaaaaggaaatagagctttaagtgtattaaagttacaatagcaatacacagaggaataaaaataacgacatgggaaaggggagaggtatgtagagcgtatgaatgaaaccctatctatatcaggaaatcaataggtaatgtctaaagttgaaaaatcaaaaataggccaggcgcagtggctgacgcctgtaatcccagcactttgggaggccaagatgggcagatcacctgaagtcaggagttcgagatcagcctggccaacatggtaaaaccctgtctctgctaaaactacaaaaattagccgggcgtggtggcagatgcctgtaatcccagctacttgggaggctgaggcaggagaattgcttgaacccaggaggtggagtttgcagtgagctgagatagaaaaagaaaaaaaataacacatataaatatactacttatttatttatttattgagatagagtctccccctgtcgcccaggctggagtacactggcgcaatcccagctcactgcaacctccgcctcccaggttcaagcggttctcctgcctcagcctcctgagtagctgggattacaggtgcacaccaccaccctggctaattttttatatctttagtagagacggggtttcaccatgttggccaggctgttctcaaactcctgaccttgtgatctgcctgccttggcctcccaaagtgctgggactacaggcatgagccgccatgcccagcataaatataccatttattaatatgcaaataatcgccaaaaaacaggaaaaggaaaaatggttcaaactgattgactctggagatcaggacaggggataagaagagatggggcaggggccagctgatttgtttaaaactgtgtagatgcattatttaagtgtgttaaaagattttcacagagtaaacatgtactctggaacctgaactttttggctcatgactgctaagaaattaacctttgacaagtactattggattcacttatttctatcagaatacgttcgtcccagggctatccagaccccagccagcagtacacaagtcctcagcagtacccagatgacatgccacagggcatgatgtgaaggatggaggaagtataaatggcgggttagcggtcatctcagggaatttcaactctaggtcattacaaagaggaagatctcccctgggctcactgccggaataaccctgggtctcaccagacttccatggtcctgctggacagaataagtaaaatgtctgatattttccttttgaaagcactaggaacagctcaaggatttgcacagcagaatgaaagaggagctgtcactgagttccttaggactcacagcttgaaaggaaggaggaggcccacagggggcctgaggaccaagcccagcaggggacgctgagcacttccacagcccagggggtgggaccagagctcttaaagccacagatctcctctgcaggcacagagaccctcacagcagggatccattcacaccagtcacccttggagactgctatttatgctaaagaaatttatcccactgcattgtatgcttcttgtccagagttctcttggatcccttgtttacggccttagtcttatattgtgagcagtggaatggacaggccatttaagagggcagggatggctaatgatgggtctgttagccctgcagtcagtctttcctttgtgaaccaaacccaatttgggtgcatttgctaaaaaaaaaaaaaaaaaaaaaaaaaagaggcaaaaccctcatttgaagttgaagaaatgttagttgtattccattccttttatgaggaaaaaaaaaaacacaaacacacacactggaagaaaccaaaaactttataatatttatgatccattctttcggtggtcaaaatacatatccgattttttcaggtgtaggtacaaacactgtagttccttaagattgagaagatcttaaaaaatagggggtcttttcatcactagagagatgctaatttttatcttgcaaaaagtaaagagaagccccttcagaaaatgttttcttttgaggcagaacttaaacagatgccaatgctttcatgaattttgtgagctaaatccttataaatcctttgagttgacagatcaattattccttctaacagctaatgaactaataacccttggaaatttctccttccttgggtttaaaatagaaaaaaagaaaaccttagggggaaaaaatcaattaaagactacatagcaataagaatcaattaaactcattataactttttaaagagagctatattttcttcaagagctatgatttttaaattaaaaacacgtcaaataactctgtattttataaaccacaaatattcttaaaacatgtctttaattcacattgtgtccaggcaaaggaaagtgagaaaggctagaaaaacagaaaaggagacagagatggaccttgcagaaggcaatcagaagaacggtgggatcacggtgggatcaccgaatgcctctctgtacaaggcaccgtggtagactctcagggcaccagaaagagaaaaagacatacgcacacagcactggagaaaaaatgaagagaagagagaaaggaagggagattgcgttactccagaatgctctagacaacactgtgaagagaggaggcctgtcctgagcgtcttgctgatagaagtggagattagcaggagttggcagagtccatatgctgggcattcaaggagttaggcccaaacgggacaatgaggaccagagcaggtggcagaaagggaacgagaagaatgggaatgcacgcaggtgctggaggtgagccctgatcccaagaatgaggtggtacctgctgggggaatgggacacaggcgcagtggggcggagaggcatcggtcctatttgtggatctgacatcatggccaaagattttaacagatgagaaaactgaagcaatgggaatttcagtaaaagacttgctcaaggtctcagggcatccctctctctctctctctctctctgtctctctctctctctctcacacacacacacacacacacacacacacaaacacaaacacacactccagttgtacgtgtatgtacaagaaagtctgtgctttgtttttaattaaggaactagagcatgatggtcatccaggtaccagcccacaaacgctgctcttccttcctgcagtgcagttcttggaagtgaaaagcaaagtctcatttgaaattgagtgagtggtcttttttccaaattaacaactctggagggtgatacctagagaacatggcgcacattccaggggatgctgacagttctccaccctgtgagctcctggtgcgcagtgtgatggggtgtaaagaaagggaaacctaagagtcagaagaggccaggtgcggtggctcctgcctgtaatccctgcactttggggggctgaggtaggaggatcacctgaggtcaggagttcgagaccagcctgggcaacatggtgaaaccctgtctctactaaaaatacaaaaaaattagctgggcgtggtggcaggcacctgtaatcccagctactcgggaggctgaggcaggagaactgcttgaacccgggaagtgaaggttgcagtgagccatgattgtaccactgcactccaacatgggtgacaagagcaaaactccatctcaaaaaaaaaaaaaaaaaaaaaagagaagagctgggtcagcatcacagctccactcttatttggcctcagttgctctgactataacagggatacgaatggtccctgaccatggttccacttacaaatttttgacttcgagatgatgcaaaggcaatatgcattcagtagaaactgaattttgaattttgttattttcctgggctagtgatatgtggtatagtactctcttgtgatgccaggtggcagcagcaagtacagctcccagccagccacatgatcatgggagtaaacaaccagtattgtactctgtgatgtactgtgttgccagatgatcttgcacaactgtgggctaatgtaagtgttctgagcaccttgaagataggctaggccgagctatgatgttcaatagattaagggtattaaaagcgttttcaacttaacgatattttcaacttaagatgggtttattagaacataaccccctcataagtcaaagagcatctgtaattatagttatacctcaagttgtgaataggaataaaccaaccatagtttattcctatggtgataaaccaaactattcataagggcttataaggtatgtatagtgtatgaatgaaaccctatctatatcaggaaatccccaagacccatctatggacttgtggccctgttaaggtaaagctagggccagctttatgggtgtgtgaccctcagagatgacacagggttcccatgttaaagggggcccatgcttgattcaacactctgctgttgccatcttgacattcttgataatttccgaacaaggggccctgcattttcattttgcgatgggctgcgcgaattacatagttggtcctgggtaaagtcacttggttcagtgggaagagctcaggaaggtttccatctttggcaaatacttcccagtagactggaagtttgcagtgaacatgtgtttgctttccagctgaacccatttcttacatttgaggaacgcttcaccatacgggtcttggcaagaggcagggccacatgggccagatactggcattcctcagccttcctaccagctagagcgtggccagccaggtgcaataactctggagtgtgcaatgcttaaagtatgaaaggagagtggaaaattcactttggtgatggcagcagtggcatcaattatctagggacataaatggcagcccccagctatggtctctggtgtccagcgctagccatgctagctagtgggaaaaggttgggggtcgggaggcatccagcagtgtgtcaatgagatcctccactagatgggtctgtgatgaggttgcagtcttggttttagccacctttggttcttccctgtttcctttttttttttttctttttgagacagggtctcactctgtcatccaggctagagtgcagtggcacgatcatggctcattgcagccttgacctcctgggctcaggtgattctcccacctcagcctgccgagtagctaggactacaggtgcctgtcaccatacctggataatttttgtagagacagggtttcaccgtgttgcccaggctggtctcaaactcctgggctcaagtgatctgcttgcctcagcctcccaaagcgccaggatgacaggtgtgagccactgtgcccagcttccttccctgttttctagcctgttcatctagtcttcttggtgatttgcttttcaaattactcagtgttctttcgataaattccttttgcacttatgtggtcagagatggtttctgttgctcatagctacgagctttttctgatataaagttggactctggtggagttacgaccctgatcatcctttggctgagaggcagaaaatgggtcctgtgtcctgaggcagaacttgtcggccacatgtccctggtgataagacactagtgcttatgcattccaacacagaagggacatgggagactgcatgggtggaaaggcacaatatctttcctcacccattagcagggtcatggctgacattcctataacaaggatgggttaagaagacagaggcataacagatttatttaatcagtgttttacttgacacaggagccttcaaaaatgaagatctaatggctgggcatggtggctcacgcctgtaatcccagcagtttgggaggctgaggcgggcagatcacctgatgtcgggagttcaagaccagcctgaccaacagagaaacctcatctctactaaaaatacaaaattagccgggcgtgatggtgcatgcctgtaatcccagctattcgggaggctgaggcaggagaatcgcttgaacctgggaggcggaggttgcagtgagccgagatcacgccattgcactccagcctgggcaacaagagctaaactctgtctcaaaaaaaaaaaaagaagaagaagaaggaagaagaaggaagaaggaagaaggaggaagaaggaggaagaaggaggaaggaggacagaggaggaaggaggaaggaggaggaggaaggaggaagaaggaagaaagaagaagaagaaagaaagaagaagaaggaagaaggagaagagaaggagaaggaggaggaggagaaggagagggagagggagaaggaggagaaggagggggagagggagaaggagaagaagaagaaaaagaagatccaaagactcagggaaaactgtctatttctatgcttaggttggatgtgaatggacagctatgtagaaatgtgactggacaacaaggggtatgatctaatgttgatggacagagaggggaagcacagtaaggcccgtctgtttggattcttcctggtctctctgtgtggcattccttccacctgggtacagggcaggacctctctggaaacaggggtcttatgtcctacttttagacaaggtagggcagagaatttttttctttctgtttctgagatgaagtctcactctgtcgcccaagctgcagtgcagtggtgcaatcacggctcactgcagcctccacctcctgggcctgagtgatccccctgcctcagcctcctgaatactgggactacaggtgtgcaccaccacacccagctaatttttctccttccttcctcccttcctctcttttttccttccttcccttcttccctccctccctccctttccttcctttcttccttctgtccttccttccttcctccctctccttccttctttccttctccctccttccttccttcttttgtctctctctttccttctctctcattctttctctttcctcctttctctctctcctctccccccaccccctctctctttctttcttttcttttctttctttctttcagagctagatctcactatgttgcccaggctggtcttgaactcttggcctcaactgatcctccacctccagagaatttatttataaccagctcttacacagaaaggtggtgataggttagagttatatacctaggtttttgtggctggtattggagaagttgggttctagtttctatggcctgccttgaagagggattctactttctgtggcctgtcttggggaaaagggaaggaagaaaaagaagagcaggagagggtcagaaagagacagcctttgaggcccttccaaagtccttcagttcaaagtactcagcatgccaaagtgctacactttgggtcatcgttttccgagccccaacaaggtcatctggtccacactccttctgaacgtgggaatcctttatgaataattcaggatctgaatagcattcaacaaaagatgctactgaaaaccacagtgtgtgctaagcagaaagacttgatcacgggtgacaaacgctgaggttggccagctcccagttgtactgttcagggtcaatggccctcttagggctgtaaggatatccctaactgtcatcaaattgtcaaggctaaagttcagggaaatccacctcactcatggccaaatataaaatgtcattccttcagacatgtaattaagatggtggctgaggccggatgcggtggctcacgcctgtaatcccagcactttgggaggctgagacgggtggatcacctgaggacaggagttcaagaccagcctggccaacatggtgcaactccatctctactaaaagtacaaaaattagccggctgtggtgacaggcacctgtagtcccagctagtcaggagtctgaggcagaagaatcacttgaacccaggaggtggaggttgcagtgagctgagatcgcgccactgcacttgagcatgggcgacaagagcgagattccatctcaaaaaaaaaaaaaaaaaaaaaaaaaaaaaaaaagatggtgtctgagtccctaatgaattcccagagcataatgggactaaggtgctctgggattctgaaatctacagactacctagaaaagttcccacagaaacattatggccatagcgaaaacaaaacacgaaaaccaaaaacaaccaaagtgccaaacatctgcattgaggatgctacaggaaattactttcacctccttttataggcatgttcaatcaatggcaacaatattctacattttgctaagggctgaaggaagagaaaagagagtcaggaccagctcattttccaacacttgaaatgaactcctggctgaaactaaatcactcgctctctggcatcacggctatttctacagtgccacttggctggctgggtgattttccagtcactgggtgagggacactggatccaggacagggccatgagcgtgttaagagcagaaagacccaattatgaagaatcccctggaaagcccacaatgtagcccacccacctgggtctgaatggcaggcatgtgagcagaggcagaaaagcttcggtgccaaatgggggaggatgcagagccacttcgagtcccatcggaccactcaggccgttgcagctggagctgcctgcctgaggcaaagtaatgccaaagtgagcggtaggagcccgtcacagccaagcaaatggcaactggacagagttggccaagggctgccagacatgatagagcagggaaagaggcagagatgagggaataaggcagctgtcatttatttgggagggaagaggttggatcctgtaagggcaatagggtggaggggagggagagggctcagagggcctagggtcagattggaagcagcagaccccgaagcgtgctgatcctgaggcagagggtgcagctggtcatagctaagaggaaggtgaaggtgtgcaggccccttgctcagaggggagcagagggcagaggtgcgataccctgggaggtcccgcggcttcaaagggaaagggagaggatgggcagggagagagaaacaggaggcagagtccctccgtaagctttcccaagtgagtaaagtactcatacccagggctttatttgaatttatcacctcttattagtgtcttttgaaatgcgaattagctgattaaccactgctcacagccttccaactgttctttattctccagcattcagcaactttgttctaaatagggtaggccacagtagcccaccagggggaaattattctcaaggttacaagaacagcgaccaaggcaaaattaggccctggcctggatggaatcaagttgggagtgaggttgtgcctggagccaggctctaaccactcccaccccccaacccggtctacacacaaagcctccgaggatgctggttaccctggtgttagtccatccttgcgatgtatgaacagggctctggggaacaagatacacactcttctgccccctaccacttttttgttgatgatcaccattttctaaaaggtttattagttctaggtccctcaggaatgcccgtgcactggcttcggctttctgtttgggacgtgggttcacgtttacgaacaacaagggatggcccctggcagagcctcgttcgcactcgctcctgcctccagtttggcaacacaacacaaaggcggtatggcttgtatacactttccaggctgagcccctattcagagggggctgcagcttgcgcgtaatgggccccctacagacaaagccagcaagtttcttaattaagtctaagtgaaagacagatcccgcttacatcttcagagaaccttccttcagaacttcaaaaacagcctagactgcctatcaaatccaggcacgaataactagctagcaattttttctctttttaaatatagaaagccaggcctccggcgccaactcttcaaccccctctcactttccctgcaattttagacatgcctctggtttataaaacaggaaacaaagggacttcttgtgtgtcggagaagccctcagagggcctgcatttcattccggccttccccaaagcactgtgctgtctaaagagctctttaactggtttagtctcattaccatttccatgaggtatcaaaggatacgctacgaaaccagcatatgtacatatatcacataaggacacatcctgttacgcaacgatattaaaaaattaattattagctaattgccttttcagaaatgtgatttttcacatccctccctcccctccccctccaccctagccccagaaaccctctctcagacagacctttctgttttctgggctttgctgtgataatgttccttgcaaacagaaaccaattattctgcagcagtaagtcaccaggagtatgaattgctttaatttttcccccttttagcagctgcccagggtgggttgcgaggtggctgcagtaatgaagctgggatgaatactaaagcaggaccgaggccgggtgtcctgcagggaaaatgatgttcaaaaataaaagtgcgtttttgttgggagaagctaatcaatgaattggacgtttccaaaaaatgtgctttccgctctcaatttgcatcgccaatgctgctttccccaatgagtcctgtgcacctgactagcttgtaaaaatgtcaccttactgttaaagtgctaaacacgccctgtttttcctccgcctgttctctctctccctcccccctctctgcctttttccttctgcaattctttgctttctcattagaaatgcccagcaacgtctggcagacaaagacactgcaaacaaagtgtatggaaaggaaaaaaaaaattaaaagggaaaaaagtgcagaggaattcttcattcacggatctgtagaatacattaatatctgaaactgttggcacagcctaaaatacttgggcggctaacaatgcgggcaatgattccgagtctgggatcttcaaataaaccccagcgctgtcatggccaccaggaaggagaataatggcgatattagctgaccttcattttgttgtttcttcagtcctgactgctggacctctgtttgcttgttactaggatttcttagctgaaaaattttagcatttcccaggcaatacaagagccagtttattaggtaaataaaccaggccttaagcagtcttttctgctccataatgggaaatgggcaaattggaacgagggttgagttggagtcagggagaatgactcagaggcagagatctcatcatttccccctcatccaaaacaccaatgaacaatgcggacggagttaacaaatcatcagatcgacgtgctgcctttggttaacttaaccaacatcatccaccaagtaaggaagacaagattcacaaaaggaagggacaaaaatagcggctttcttcttctagagacctagatctgtaatgacatttcacttctcccaaggttccaaggaactggagactattttataattcatccaaatggagctaatggtgctatgtttcagtcatctgtcataaatgcttaaacattcttatgttattcaaaccattgtctagtgacaatcttaacgatgttaataaaatcagtaatgcagaactggatcctttttcagagtctctacatccagagggccttctggctgtctagactgtaacacaattggtaattattacatttatgtgtgcctgcttactgtttactatctcgattccctcccccaactgcaatataagctccctgagggcagggaccaccattgtatcctacctcacccaacacagtgcctagcacccaagacgtatttgcctagggaggtaatgatatttttggctacctttggggaaatgcatcccatctttaaaagctttcagctgccacgcccaagggcttcaagatgagaacgagacacaatacttcttaaagcagagtattcccctaccgagaatgaagatatgcgtccaagtttcctgtcgcttccagctttcaattcttttttaactgtgctttcttttgggattaaaaaataataatctcaatttttagattcaggaggtacatatacagatttgtcacatgggtatattgtgtgacactgaggtttaaggtacgaatgatcccctcagcgaggtagtgagcacagtatccaataggtggtttttcagcctttgctcccctccctctctcccccacaatagtccccaatgtcttttgttcccatctttatgtccatgtgtattcaatgtgtatctcccacttataagtgagaacacatggtatttggttttctgttcctctagctttcaaattaaaataacttattttattttttttgaaacagagtcttgctctgtcacccaggctggagtgcagtggcatgatctcggctcactgcaagctccgcctcccgggttcacgccattctcctgcctcagcctcccgagtagctgggactataggcgcccgccaccacgcccagctaatattttgtatttttttagtagagatggggtttcactgtgttagccaggatggtctggatctcctgaccttgtgatccgcccgccttggcctcccaaagtgctcggattacaggcgtgagccacggcgcctggcctaaaataacttataataaacacttgcttcaagcaggaggtcatgtaaatagatataacacacacatgttttttaaaagttacacagtcattttgttggaaaacatggaagacatagaaatttttcagactgcctaactgctcaatgggttcaccttacccaatttgtaactgcccagtgggttcaccttacctgctgcctagacagagccgatttctctagacaggggaatggcaatagagaaacagtaattatcacagaaccggctgagcaggagactggagttttattattactcaagccagtctccctgaacatttggggatcaaggttttaaaaaacaatttggtgggaggggaggggcagtgagctggggagtgctgattggttgggtcgaaggtgaaatcatgggtcgtccctgtcttcttgcactgagtcagttcctgggtgcgggggggtgtgggggtggggggcagtcacaagatcagatgggctggtttctcaatctgggtggtgccggttgatccatcaagggtagagtctggaaaccatctcaagtcctgactgtaggagcagtttagggagggccagaatcttgtagtctccagctacatgactcctaaagcataacttataatcttgtggttaatgttagtagtctagtccccaggcaagaaggaaattttttctggaaaagagctactatcatctttgttttaaacttttaaaactataaactaagtttctcccaacgttagttcagcctaaacccaggaatgaacaaggacagcttggaggttagaggcaagatggagtcgtttaaattggacctctttcactgtctcagtcataattttgcaaaggcggtttcggcttgggaagtgagaaaagtaagtctcgaagtatgcaggatatgatcccaaaatggttgaaaggaataaaaaagacaatacatgtttgcttagttttgttgctgctataacagaatatcacagactaggcatctatcaatggaagaatttatttggctcatggttctgaaggctgggaagtacaagaacatggcactctgatgagggtcaaaccaggtggaagggtggaaggcataaatgagcacataagacagacaggaaaagggggctgaattcccttgataagtgttaaatacagtgagttctaaatttcccgtcaaagaatcagtatgtcagtatgttcagttctttgttctccattttaaagtttaactttctcattctccttgcccctagtttcagtaaacaaccttttccaccatttctaatcagtagttcacatctatttcctggtcaccgcttcgatctgagtcacccctggtcacctgctctgacctgagtcacctgttcctaactgttcttcccatcaaactattcaccccaccactctgactcatacccctgctctctttaaaatagccaatcggaattagcttagactgtgtgatccaaccctagccaataggggaacaacacagcagcaggggttacctgcgtcaggaataaaaaccccttcccctctcttgttcagctgtgctctcaccattgctccatctgcaagtcacactcttctacagaagtaaaattgccttgctgagaaaattaaatttatgtttgagtgctatttcttttgcggcactgaaaatttatttctaacataagtaacccacttggtgataacagcactaatccactgatgagggcacggccctcatgatctaatcacctcttaaaggtctcacctcttaagaccatcataatggcaatcaaatgtcaatgtgagttttggcagagacattcaaaccacagcacatgtagacacgctatatgcattcatagaaaaaaaactggaaagatacacccaaactgttagtagtcatgatttgtaggaagtgaatttttattttgtttattgttctttatggtaccatttttctacagtaaattgattattttttaaaatcagaaataaccttcaataagtttttttaaaaaagataatatatgagctagatctttacctcaagaatttcgaaaaataaattatagttacactaatacaaccatggcattcaaggtgggctctctctctctcacacacacacacacgtagacacacacacacacactcacactcacgtaaatatactcacatgaacataaatacctaaagctatacataaagctctataggaacatttctggggggttatatggctatgtgtttattgatttcttgagacaaaactgctctgggcatctcagggaagttttctctttcttagcttgaagcaaccaggtatcacatttctgggttttaaaagagattatattcaaggatgctctattactttgaataggcgaaacattccaggctgatgggaattcatacctgtcaacagctgtgaattagcatttcaaaccccttctaatgtgacttatgaactttatcggtatgaggattcaacaccttgtagaaaagcaagtgctgaatgcaaaccagggtgaaaatgctttctgctagggagtagaagcctaaaggaatgatcaagatccatctgccaagaacaacttcacaggtggataggtgcaaaacgaccatgccaggaatgaggaaaatagacaatactttagatttctttcctttctttcctttccttcctttctttctccccttccccttcctcccttccttccccttccttccttccccttccttccttctttctttcttgagatggagtctcactctgtgtcccaggctggagtgcagtggcacgatctcagctcactgcaacctccgcttcccaggttaaagcaattctcctgcctcagcctcccgagttgctgggactgcaggcgcccgccaacacgtccagctaatttttgtgtttttagtagagatggagtttcaccatattggccaggctggtgtcgaactcctgatcttgtgatccacccacctcggcctcccaaagtgctgggataacaggtgtaagccaccgtgcccagcctactttcaatttctaactgggtatttagaggggtagtaaatatagctagaaaaaaaaagcttcagggtgaaatggtatgtttgatatttactcaccaaggtcttccccttttattatcactttttgttagtttccattcttattcctacaaggccacagccagaagtgggtgcaggagaaatgaagttctgaacatttgaatgaatgcctatttcaattccaatcattccctggaaaatgttaagtttaaagtaaaatggaatgaggtagtcctaacagctcaggaaacaataaaagggaactgagagctttacacgtcagaaaaactctcagacaatgcctaagaggattggaaagaaatttctaaaacatgtcgtccctacaaacacacatgaaaaactatcttgagaattccacaggaaaatatacatccatttaaaaaagaaactttgaagcacaaaaattaaagagaaaaggctttttcccagaatacaaaacactgcttgagttgtggaagaaaaagagctcattagtatttcaaaggaggttgataacttatttcaatgtccatactgggatagaggatgagccaagtagtatactcctcaaaatcctagggaccacttactctcctctgccatctcttattttatttctttttttgagatcgagtctcattctgttgcccaggctacagtgtagtggtgtaatctcagctcactgcaacctccacctcctgggttcaagcgattatcttgcctcagctgggattacaggcacacgccaccatgccccgctaatttttgtatttttagtagagacggggtttcaccatgttgggcaggctgatctcgaatttctgacctcaggtgatctgcccgccttggcctcccaaagtgctgggattacaggcgtaagccactgtgcccggccagaacctgcgtattaacaagatccccagatactgcgtctgtgctgttctggaggacataccatcccaaatcaaccctgaaggactgaaaagttagtgaagggaaatgcgggatagaaaagagggcaggtattctgggtagaggcgggaatgtgtacaaggccaccaaaataaaggaaagccagggatgccaactgttcagggtggctggatcctagtccatggaagagaaaaagaaagtgtgtattgagaaagggtgcagtgtggccaacggggaaggaagtgaaggaagattcggcctgagactagatcctgctaggctacggaaaccagtgctgaggagtttggactttattctgagggctttggggcacctctgaaggattttttttttttttttttttttgagatggagtctcactcttgtcgcccaggctggagtgcaatggtgtgatcttggctcattgcaacctccgcctcccgggttcaaattattctcttgcctcagcctccagagtagctgggattacaggtgcccgccaccacgcccggctaacttgtgtatttttagtagagatgggttttcaccatgttagccaggctggtctcaaactcctgacctcaggtgatccgcctacatcagcctcccaaagtgctgggattacaggcgtgagccacagcgtccaggtattctgaagggtttttaaactgaggagtgacttgatcagatcccctgaagacacatggtgcttcagctcattccactcctgagtaattccttactcatttcaaactaccaagagtccacccattttgtctgtgctaactcaagtctcttccagtcatggtggctggaactgatctgtttctcaaccctcaactcctgcagcactgtggatggaccactcacatggtctttgtcatggccactccatttctgcagtgagatttttgtctactctcttctactgatacagcatagcttttcaaagaacagtttccaaggaccacctatttcaggatcatctgagggtatttaataaaatcaatttccaaggcccaagaccccctgaatcggtatctctgtgtgtggggcccagatgtttgcattttaaaaaacattccagtcagatgacgtggcttacgcctgtaatcccagcactttgggaggctgaggcgggtggatcacaaggtcaggagatcgagaccatcctggctaacacagtgaaaccctgtctctactaaaaatacaaaaaattagctggttgtggtggcgggtgcctgtaatcccagctactccagaggctgaggcaggagaatggcgtgaacccgggaagcggagcttgcagtgaacagagatcatgccactgcactccagcctggttgacaaagcgagactccgtctcaaaaaaaaaaaaaaaaaaaaattccaggtgaagctcttaaatatgaaagccagagaatcacagtataagactacagcatcctgagacccagagccatcccagaaaccctagaatcagacaccgcacctctgtctacaaccttggcatgcggctgctcagggagacaagtaaacgaagtgttttaaattcctctctctactcattcttgattacataactaatcaaaatgcttccaaaaaccaaccaaccaatcaagaaaacttctaggaacttaattaactccagtataaaaggactcctcaggccgggtgcagtggctcacgcctgtaatcccagcactttgggaggccgaggcaggtggatcacgaggtcaggagatcgagaacgtcctggctaatacggtgaaaccctgtctctgctaaaaatacaaaaaattagccaggcgtcatggcaggtgcctgtaatcccagctacttgggaggctgaggcaggggaattccttgaacccaggaggtggaggttgcagtgagccgagatcgcgccactgcgccactgtactccagcctgggcgacagagtgagacaccatctaaaaaaaaaaggactcctcattcctgctgtgtactctgtctattggcctatgctcagaaagggctttttctttatgagacaggaatgtgcccggcttctgtcatcacatatataagacagacaagactggaatcaaactttcccacagaattggcgtaaggaccgaaagagacattatgtatctttgaaagcgccatggatactgcttactctgactattattatgaatgctttaagttggtcatttaggagctaagaaacactgatgagattctgtcttgtatgagcatgattgtggtgtttctttctctctcctgctggactttaagcaacttgaaggtaggactctaaggctgacgcaaccgcgggatcctcccatagcacagcattgctgaagggattcaataaaaatgtgatgaatgggtgaaagatgaccatgtcacagaagcccacgtgtaataaatagttcatttggaatgtgcacctgcgtgggaattctccaaacacctgccgaggccagtaactcctgttttctcagcctatcaaagagggcagctgctcctttccctcaggtgaccttctctcatttatcaaagctggaaagggctgtgattttccccaacatgcagactctctgagcaattaatagccctctcaaacagacttgtcctctaatgtcgatctgggaaaatgccatttaaaaatttgtttcactgaacattttcacaaaatgaaaattagaagatattaaaggcatctggctatgttaagtaacgggaatttatagtacttaaatttatctgcaaaaggaaaacatgataaacactagcatggttttctatcatttaaatcctaaattcacaggatggaacattcaactcctgattttccagaaaatctactcttatgaatcctaaagttatcttgaaaggcaggctttgtatttttccagtgaatatattgctgtttcttatcaatgttgcacttgatttttttttttttttttttttttttgagatggagttttgctcttgttgcccaggctggagtgcaatggcgtaatctgggctgaccgcaacctctgcctcccgggttcaagcgattctcctgcctcagcgtcctgagtagctgggatgacaggcatgtgcgactatgcctggctaattttgtatttttagtagagacggggtttctccatgttggttaggctggtctcaaactcccgacctcaggtgatctgcctgcctcggcctctcaaagtgctgggattacaggcgtgggccaccgcacccagctgaaatgatttttaaattgtaaaatttaaattataaattataaattatatatataaatatatattatatatataaattataaattgtaaaatttaaaattgtaaattataagggactcttttctctagtagataccacctttaaagtatcatgtggaaagtcgaaattaagcaatttcacatggaaatggaggttttggcttgccttgaaaaatcagaagagactgcgatattgggcccacattgctacctggcaacaatcacctggggctgacctcttgagagggatgctctctggttttgcttctctactgcagcctcactcctttctatgcccgcctggcctccacaatgaataaagagaaggaggcatggcttctcttccaaagatacatatattcatggatctctaataaacgaaagagtgaaaatacgtaattggcatagagggaaagtagagtagtcgccacaagacatgacttttttgtttgtttgttttttgagacagagtcttgctctgttgccaggctagagtgcaatggcgtgatctcggctcactgcaacctctgtctcctgggttcaagcgattctcctgcctcagcctcccgagtagctgggattacaggcatgtgccaccaggcctggctaatttttgtatttttagtagagacggggtttcaccatgtaggccaggctggtctcgaactcctgacctcaggtaatctgccggcttcggcctcctaaagtgctgggattacaggcatgagccaccgcgcccggccaagacatgactcaagtgcagctgaagcaagatttgaagttgaacagcaactgaggggagcccactgtgtgagcaaatgctgagaagcagaaatggacaagctaggtttgggggagaagaaataactggtttggctatagtgggaggtttccataggggtagaggaacaaggtggcagacgagaccatgtagagagaccgtggagagcctcagatccagagccaaggactgtgggctgtgcactctagggcagccatccccaacctttttggcaccagggaccaggttcacagaagacaatttttccacggcctggaggggaagggggagatggttttcgggatgaaactgtttcatctcagatcatcgggcattagagtctcataagaagcacacaacctacatccctcggatgtgcagttcacaatagggtttgcgctcctatatctaatgctgccactgatctgacaggaggcggagctcaggtggtaatgctcgctcaaccaccgctcacctgctgctgtgcggcccagttcctaaaaggccacagaccggtaccagtcctggcccaggggttggggacccctgctccagagccaggttggagctctccaaggtttacactaacaagggcctggcaagataagagtagtgtttcaggatgatccagtggggggcccttcagagaatggtgacagagaaaatgcaaagggagagccctaagcgtgcaagacatgctatggcctgaggggcagtaggcactggaggaggagaaagagctccacataggaaaggaattgtccagccagagctacgggaagaacagtggtgccaaacacaaataccggtgtgggctggcttcttgtctgggtttcaagtgtgtgtggcgcgtgtgtttatgatagtggggtgaggggttgcaaatgatgaatttggtttaaactttttgagtgccaggaaatgacagggagatcaagagacagatgtgcagataaaagtgcaaatggccgggcgcggtggctcacgcctgtaatcccagcactttgggacactgaggtgggcagagcatgaggtcaggagttcaagactagcctgaccaatatggtgaaaccccgtctgtactaaaaatacaaaaattagccaggtgtggtggtacgtgcctgtagtcccagctacttgggaggctgaggcaggagaatcgcctgaacccgggaggcggaggttgcagtgagccaagattgtgccattgcactccagcctggtgacaagagtgaaactgtctcaaaaaaaaaaaaaaaaaaaaaaaaagctgcaaatgtgaggatgcactgagtggtaaggacagctggagccaggagatggagaaggtttctaagaaaaacatgccccaagaggatctggaccacaaaacccagaaatgcttctgctccagttcaagaagcagtggagatgtgattcttcgatacgtagccttagaaaccaaaccacactgttgccccgggtactctcaaccactccaagtttttatagagcctttggaatgatggatggggctcagtttacccagagacagtaaaatcagatgaaaggggttaattagaactgttctctctactgctaggtgcaaaacagccacattggagccatgatgaagctacgtctatttaaacagccaaactgatcattgtaactgttttctctcttaaaataaaccccatgcttttagccatattcctgcttcttaaagcctctcatgtgaaagatgccaaaataatcctggaccttaaagaggtcttgatttatcatttcacagctggttcccatgcacctccctttccactttttcagagcctcactatataaatcctgccatcagatcagggaggcaggcatggtggtgatggatgtcaaacctgcgatggggaaagtgaagagcagttccctactgggaacagataagccagcagacttctcacagactgctcctgttaccaactcagccaaccccaccccctcctcctgctcccttggccctccccatctgccggatagggcctcccttctgctgcgaagcttccactcctgtagtgttctggtttgcgttctttgatgagaaatattaattccaggttaatactgatgttaaaaaataaaagcccgacctaattaaaaattcaagttaattttcacccaggttcccttaacttttaaaaaatgttctttttgtaaaaaagagtaaataggttacatgaggaggcccaagtaccaggaattgattagtggcacaatgaaaaaagttacaaaatataacaacaaccacttaaagcaaagttaatctagtttgctcaacagcccaggacttttgctgcctaagtacaggatgcttccttgcatatacttgcaaatttcaccttttaggctaaggagatgtttttcaattgatttgggaaggaggaaggggtcaagaccacggaggctccaggtaaaatgctgtaggtgggcagtctgcctctgatactaaacttttttttttttttttttttgagatagagtctcgctctgttgcccaggctgtcatgcaatgtcgtgatcttgtctcactgcaacctctgcttcctgggttcaagcaattcgcctgcctcagcctcccgagtagttgggattacaggcgtccgccaccacacccagctaatttttgtatttttagtagagacggggtttcgccatgttggtcaggctggtctcaaactcctgacctcaggtgatctgctcacctcagcctcccaaagtgctgggattacaggcatgagccaccaaacctcttcctttctttgctctcttcccatcacccagccctcctctgttcagtgcccaggcacactgagaccccacactgctgtctctggcctgcaaagatgcacaatgccacctcatgtaggcctgcttgcctgccccacccacacccccaactcaggtcataacatcactttcccatcaaagctccagtttccctactatggatgatttcctggtgatatttttaaaatcaaactaagcgactctaaaaggtgaataacaaactcattgacttcccactgtctcacacacaacacacccagcctttgcatctggtttagtgacttgttagcttacatccttggtcataacttggcagccagggagccaagtctgatttgcagttgtgttttaacctggtcagtgttttaaaaatcggcaaagtttacacaaaatcatcgctctctctctttctctctcaggagacaggtgatatggcatcctggggccacagttccacagggtagcagacgaggggctgaagagcaagttctctgtgggctctagttcacagggacacctgccactcctgactgtcatatacacacagctctcattttctttcttttttttttttagatggagttttgctcttgtcacccaggctggagtgccacggtgcaatctcagctcactgaaacctctgctccaggtttcaagtgattcttctgcctcagccttctcagtagctgggattacaagcatgcgccaccacacccggctaatttttgtatttttattagagacagggtttcaccacaatggccaggctggtctcaaactcctgaccccaggtgatccgcctgcctcggcctcccaaagtgctgggattacaggtgtgagccaccatgcctggccacatatctcattttctttacctggttgccatttgaatttgtgacttctggcttaaatgactctctaaatgagagcacaattaaataatttcacagaagtagggacaaagatatatttttaaaattttttatttttagatgacaaagaatatatatttatggggtacaaagtaatgttttagtatctacacacattgtggaatgattatatcaagttagttaacatatcccttatctcacatactttttttttttttttgtagtgacaacatttaaaatttgttctttcagctactttgaaatacagttgagtatcccttatccaaaatgcttgagaccagaaatgtttcgaactttggatattggaatatttgcattatacctccgggttatgcattccttttttttttttttttttttgagatggagtttcactcttgttgcccagactggagtgcagtggcacggtctcagctcactgctacctccgcgtcctgggttcaagtgattctcctgcctcagcctcctgagtagctggaattacaggcacacgccaccacacccggctcatttttgtatttttagtacagatggggtttcaccatgttggccaggctggtctcagacccctgacctcaagtgatctacctgcctcagcctcccaaagtgctgggattacaggcgtgagccaccacgcccggccggcccctgactattaagaccaggaagagtaatcatggtacaggaaagcagatcctatacagtaacacagagggcattttcaacaggagatatctgttgctttgcctttcagtatcactcttggctccttttcctcctctctcaacttttatatttcctctctttcatctctctgtctatccctccccatttctctttccttgactaaaccaaatattaccacgggagcacacatcttacagcactctgcctgtccatcccacttaacctcaatcctcagcactctggtgtgtcatggaaaattaagaatgtttgagaagtaccacggaaagaaaaagtttagcaagcaatgaccacaaaccactaaccctggtcacatctggtcactgttcttgacaaaactcaaaaactttatccaacactcaatggggggccccctctagcttatgcatgcaggtctgagggttgatttcacatgcatccaaataaagtattttaggaaaaagaaaacaaactcacaagccaggaggccaggaagcaaagagactccctagagcttctaacttgctgactggccacagtgacaccataggggtggctacactgaatctggtctgatgttcttaccagttttatggctgtaccagttttatgacagtgacatgaagagatatactcaaagaaatgcctctccttgctgggcacggtggctcccacctgtaatcccagcactctgggaggccgaggtgggcagatcacctgaggttgggagttcgagaccaacctgatcaacatggagaaaccccgtctctactaaaaatatacaactagctgggcgtggtagtgggtgcctctaatcccagttactcgggaggctgaggcaggagaatcgcttaaacccaggaggcagaggttgcagtgagctgagatcacaccattgtgctccacagcctgggcaacaagagagaaactccatctcaaaaaaataaaaaaataaaaaaaaaaaaagaaatgcctctccttttcagcaccttcagaagttagatgtatccccaacatctcctagttcactttaataacccattgccactctacataaaactgttttgaatcttttacaccaggaagccctcagccttcccaaattgcctgggctgctcaataccataaagctcctagagaaatgactctttatgaaaagtagtacttgtttctaatggagcagctatatatggaagcttttttcctttttaaaaataaattgtaaaatacataacaaaaatgaccattttaacaaaagtataaattcattggcaaaatacactcccaatgttgtgcaactatcactactacttattccagaactttctttttcttttttttgagacagggtctcactctgttccccagactggagtgcagtggcacgacgtcagctcattgcaaaactctgcctcccaggttcaagcgattctcctgcctcagcctcccaagtagctgggattacaggcacctgccaccatgcccagctaatttttgtatttttagtagaaactgggtttcactatgttggccaggctgattctagaacttttcatcagcccaaaaggaaacctcatacccattaagcagtctctctccatttctcccaactccccagtccctggcaatcactgatcagctttctgtctctatagatttgcctactctggacatttatataaattaaatcatataatatatagctttttgtttctggcttctttcacttggcataatgtttcaaggttcatttatattttagcatggattactacttcattccttttttgtggttgagtaatattccattgtatggtgtgtgtgaaggcttttgtgaaataaataatggtggttggatagtatgtaactgcaagctactaaactgaaggaatttatcctgtgtgacaggtggtatttcttttacatatgaacattgtagaatatgggaacctgctgggcgcggtggctcacacctgtaatcccagcactttgggaagccgaggtgggcagatcacaaggtcaggagatcgagaccatcctgacgttgaaaccccatctctactaaaaatacaaaaaattagccaggcgtggtgcggacgcctgtaatcccagctactcagaaggctgaggcaggagaatggcatgaatctgggaggcagaacttgcaatgagccgagattgcgccactgcactccagcctgggcaacagagcaagactctgtctcaaaaaaaaaaaaaaaaaaaagaatatgggaaccaatgtatagcctatccaaaccattcataatctaataaactttctatccctattcaaatttcatctttccagactgagaagtcctttaaaaaaatttgaaggctcagaaaatcctcatccacattatttcagttgcctttcaatgaatccaattcaaaggcagtcatttgtgctagttgctgggaatcagaattgcaagacacagtccctgcactcaggaagctcaaggtctagtgagaagataaacatccgaacaatttcaccacactgtgataactttcaggatgtaaatctaaactgtaaggactcaagttcacgaagttttccagctgagggagcttatgcaagcttaatatgtgggtcagaaatgctttggtttggcttcctaccttcctgatggccaaggtcttcagagaaaagcttatacattaatcgtcccttatgcatggaggacgcgttccaagacccccaagggatgcctgaaaccagggacaggactgactctacaaatactatcttttttcctatacatacatacctacgataaagttaactttttgagatggagttttgctcttgttgcccaggctggagtgtaatggcacaatctcggctcactgcaacctctgccttccgggttcaagtgattctcctgcctcagcctcccgagtagctgggattataggcgtccacttccatacccagctaatttttatatttttagtagggacagcatttcaccatgttggccaggccggtctcaaactcctgaccttgggtgatctgcctacctcggcctgctaaagtgcttagattacagacataaggtaagccactgcacccggccgataaatttattttcttttctttttttttttttttttttttgaaacagagttttgctcttgttgtccaggctagagtgcagtggcgcaatctcgcctcactgtaacctccgcctcctgggttcaagtgattctcctgcctcagtctcctgagtagctggaattagaagtgcccaccactacgcctggctaattttttgtatttttagtagagatggagttttaccatgttggccaggctggtctcgaactcctcacttaaggcgatccacccgccttggcctcccaaagtgctgggattacaggcattagccaccacgccgggctgataaagttaatttctaagttaggcacagtaagagattaacaaccataactaataataaaatagaacaattataacaatataccgtaataaaagttatgtgaatgtggtctctctctctctctctctctcaacagatctgactgtactgtactcctcctccttcttgtgataatgtgagaggatgaaataaatgcctacgggatgagaggaagtgatcctcctgcctcagcctccctggtagctggaactactggcatgcaccaccacaccgggctagtttttaaatttttcttttgtagagatggggtctgactatgttgaccagactggccctcaaactcctggcctgaagcaatcctcacactttggcttcccaaagtgcggggattacaggcgtgattgtcccaaatgtcagcagtgtgacactgcgttaggctactattgacctcctggcaatatgtcagaagcaagatcatctggttcgagtaatcctgaatcactgagccctgatgatggccatagctggatgtgaggagcagatcatggtaatgactaatgaatgggccgcgtatacagcgtggatacgctggacaaggggatgattcatatccagggtgggatggggtgggatggcgtgagatttcatcacacttctcagaacagcatgcaatttaaaacttatgaattgtttacttctggaattttccatttaatattttaggattgactgtggttgaccacaggtaactgaaactgtggaaagcaagaccaagggggaactactgtaatgagagcagttggtgttgctttcctgagtagctgggctcttctgattgaccctagaagttagcatctatcatatttgcctaatgcgacatcttgctcacactaaagtgtttttttttttgtttttgtttttgttttctttttttgagacggagtctctgttgcccaggctggagtgcagtggcacgatctcggctcactgcaacctctgcctcccaggttcaagtgattctcctgcctcatcctcctgagtacctgggattacaggtgcccgccaccacacctggctaatttttgtatttttagtagagacagggcttcaccatgttggccaggctggtctcgaatgcctgacctcgggtgatccacccgccttggcctcccaaagtgctgggattacaggcgtgagccaccacacccagcctaaaatgtttttatcttttaaaatcttcctatctttcaggatgagatataaaagtgctgattagtagcagacctagaaagaaatttcatcaggcattccttcactccttagacatattaaaaatattaacatgggaactaaggcactaacccatgggcagcttcatcgtctatactttccatctttctctccaactgtttatgttgaaagatttcaacctgacagaaaagccgaaaagatagtataatgaacatctatataggccaatgttaaatggtgaataatgaatgtttttaatgtggttatatgtaataatgtcataataatgtagtgatttccttgtctttttttttttttttttttttttgagacggagtctcacactgtcacccaggctggattgcaatctctgcctcccaggttcaggtgtttctcctgcctcagcctcccaagtagctgggattacaggcgcgcaccaccacacctggctaattttttgtatttttagtagagacagggtttcactatgttggcctgactggtctccaactcctgacctcgtgatctgcccgcctcggcctcccaaagtgctgggattacaggtgtgagccacggcgcccggcctattcatttctaaaaacttaaacatgcatctcctaagaacaagaatattctccaacagaatcatatcattgttaatctgaagaattttaacactgatacaacattatctaatgcacagtccatattcaaatgtccctcatttactcaataatgtccttctagctgggtatgtttttaaaatctggaatccgatcaaaatcagaaactgtatttagttgtcatatttctttagtttcctttaatctacaattcttctatcctttttctatccttcatgaccctgatattttccttgtctcacagaacacccatcaatctgaactactcttatagtgtctgttgatgtcattcaagttaacatttttggcataaatacagtaggtgatgttgtgttaattataccgcatcaaatttggagcagtgtactgtgtcctgtaatcctagcgctttgggaggccgacttgggaggatcacttgagctcaggatttcaagaccagcctgggcaacatggtgagacccccatctctacaaaaaatacaaaaaattagctgggtacggtggtgtgcgcctatagtcccagctacttgggaggctgaggcaggaggattgtttgagcctggaagatggagggcttcggtgagctacgattgtgccactgcactccagcctgggtgacagagcaagatcctgcctaaaaaaaaaaaaaaagaaaaacaacaaaaaaaaacttggggcttcataatccaggttgtcatactcctggtgatgctaagtttgatcacttttttcaagtgtctttcctccttaataattaataaataatctgtgtggtgatactttcagactgtggttatcctgcttcccatatcttttcacccaatagttttggcattgatggtcaatcctgaaacaattactggtggttgcaaaagctgtttttctaattttatcttttttttttaatatatcttagctgggagaaagagcctctccccatccttactcccactttttttttttttttttttgagacggagtcttgctctgtggcccaggcgggagtgcagtggcgcaatctcggctcactgcaagctccgcctcccgggttcacgccattctcctgcctcagcctcccgggttcacgccattctcctgcctcagcctcccgagtagctgggactacaggcgcccgccatcacgcccggctaatttttttgtatttttttagtagagacggggtttcaccgtgttagccaggatggtctcgatctcctgacctcgtgatccacccgcctcggcctcccccttactcccacttttttttaagtatcactgtggatacgcaaactcatggactcatggatgcatttttcaagttcagtatctataatccattaacattgttattctttttattgctccaattgcctccattttttttttcagactcttttttcagggtcttactctgttgcccaggcaacagtgcagtggtgtgatcaaagctcactgcagcctttaactcctgggctcaagtgatcctcctgcctcagcctccctggtagctgggactactggcatgcaccaccacaccaggctagtttttaaatttttctttggtagagacggggtctgactatgttgaccgtcagactggccttaaactcctggcctgaagcaatcctcacactttggcttcccaaagtgctgggattacaggcatgactgccccaaatgtgacctgtgggagtccctataagtcagctcctgtgttcttttacatagccccatcattgtttgtgcgcttccttgatctcagacccaagatgttctaggcttgccttttatcttcctgtcccagatttagactcagttgctcctgcaaagagtcttagtttcttttgggagtgaatagtatttagaaaccaagaactgggtgtaaactgtgctcattactacaggagtatcactgcttctacatgctttcagtggttaaagtgggcaatgtatttatttacttaaagtagcagcccaccatgatacttccaattcaaaccaaacaccataaagatcattattacttttctcattcacattcactatttatctccctagttcccaataacatcaatatatttactcacttactctccccaactaatacacaaagcagatccagaattactctaatatcactctaaacaataaatctacttagtagaattcaagatttctgcaattcaatgtccttaaaaatatccaactaagggtgcgtaaagtatatttaagtcacttacattcttctttactgaatacattctctgtattttaaattaacagatttttctttcctatttgtaagtttatttctcaagatataacagaacctacaaatgtaaagagcttcaaaattttaacaactattttatcaaaatgattaatgtataagctaaaaagtcaagtaatcctaaaaaaaggttataataaaaaccagtgatttctacctgctccttctgactttcctcctcatcaaaagcactcacttttcacttattttggctgtttcttctgttacttatctccacacttttaaactatatgcccataccataatctttaaattccatcaattttaaatattacacagtcaccttctctttcattataggagtatttagctctcttgtactccacctcttcaatctcccatctaccctatagttgaatcatatattttgattaaatcaaacatctaacaattacgttatcatggctatgtttgtatttactcttaacatactataatcatgcttccatttctgtattactttttgttttcctggaattaataattgtctcactttttttttttttttttttttgagatggagtctcactctgtcacccaggctggagtgcggtggtgagatctcggctcactgcaaccttcaccttctgggttcaagtgattctcctgcctcggcttcccgagtggttgggattacaggcccgtgccaacatgcctggctaatttttgtatttttagtagagacggggtttcaccatgttggtcaggctggtcttgatctcctaatctcatgatccgcctgcctcggcctcccaaagtgctgggattacaggcaggagccaccgtgcccggcccatatttactcttaacatactataatcgtgcttccatttctgtattactttttgttttcctgggattaataattgcctctctttttcaattgcttgaaatccctcctactaaatctcataaccttcagcaatcactcagtgtaatttttcacgcaggaaaacataccatctattttccctcttagctctagctctctattctagaacagctgttctcttggtctgttgtgcagccttccactgctgtcatcctgggagttgtctttacttctctcccttgtttctgtcctcccagatcttctttctagggttaatatttgtcagtagcttcctgcaatactaccacccctgtttttgctgagatattggatgccattctaagttcagatcctttgaaagtaatctgttgtcccctacctcccacccctagggaggcagaaacttctctttaactgggtgctctgaaatttcattatgttgtgatttgacatgggtctttttttatttcatttcttaagctggatattgataatggactctttcaataaatatggttactcctgtctgtcagttcttgggaaatttctggcattatttcctttggtaatttgttgactgttgttttctcattgtggcattcctactctttcgatcttggatggatcctctaattttgatatcttcctgtgtcttttggttctactttgtggaacttttttttttttttttttttgagacatggtctcaccctgtcacccaggctggaatgcagtggcacaatcacagctcactgcagccttgacctcctgggctcaagcaatctcctctcgcctgtctcctgaatagctgggactacaggcatgcaccaccacacctagcaattttttttttttttttttttgagacggagtctcattctgtcgcccaggctggagtgcaatggcgcaatctcggctcactgcaacctccgcctcccgagttcaagcgattctcctgcctcagcctctcgcctcccgagtagctgggattacaggcgcgctccaccactcctggctaatttttgtatttttagtagagatgggatttcaccatgttggtcaggctggtctcgaacttctgacctcgtgatctgcccgcctcagcctcccaaagtgctgggattacaggcgtgagccactgcacccggccacctagctaatttttaaaaacttttgtagagacagggtctcgctattttgactaggctggtcttgaactcctggggtctagcaatccgctcacttcagccctccaaagtgctgggattacaggcaaaagccaccaggcccagcccatctcttcaactttgaaactgccaggagtgaccactgatccttcccattcattgctttttttcacagaccacctctcagttccttcttttacagagagaaagaaaggaagtagctgagggatgtaagccaacttaactagaagacattaagttcagttgttctacatttgttcacatctaaaattacttaatatgtaggtggtaggtccatttgtcaagcagtagaaatagcatcgttccttccagtagctcagtgtgacaatactgtttcttctattaaaacaatgtctgcattttggggtttgcagaaattcactgtttggcatgactttaagaatagctctaaccaaatggtccatgagaatacataaaaacctttttcagttcaacaggtccacgaagaacccaataattctgaaagaaacatcgaaggctggaaaaacatgtcagatgattgtcaggagaatatatgttgcacatctcagtggtgcccatgtaagctgcctatatgccaggtatgacctggtgtctgccagctccacacctgcccttctctgctcagtcatgctggggcttggagtctgtgaactacccttcccaggctcccctgccagctggcttcctgttatgttctgccaaaataaggcactgtcaggagttcagaaagcaagaagaggggtgaggctgttcctcttcctctctttccccatctgcttctggcagcatctctgcaagtgtctgtattctaacagtgttccccatggcagtggcagcctctctttggcagtcccagaacgagcaaggcaggcctgcttctgctgcagcccaggggccaggtcctaggcatctctagcactggctgagcggcaatcccaggagtactgtggtgtgcagcagcgcatttgcatctttgctctcctaggcttaagggtggcagctgcttcacacaaggactaatttctggattactgcaccttccccttttcattctctccatccttttaacagttttttttttttttttttttttttttaggcaaagtcttgctctgtcaccccggctgaagtgcagtggcatgatctcaactcactgcaacctccgcctcccaggttcaagcaattctcctgcctcagcctcctgagtagctgggattacaggcatgtgccaccatgcctggctaatttttgtatttttagagacggggtttcgccatgttggccaggctggcggtctcaaactcctgatctcaggtgatctgcctgccttggcctccccaaatgttgggattataggcgtgagccactgcgcccggcccttctaacagtattctaacaagttgtttgcattctgtctcctctgagtgaaatacctagtatggttattctttttcctgattggctcccaactgacggaacctctctgagggatttaaaaaataagaagaaaaaaagactggccaggcacggtggctcacgcctgtaatcccagcactttgggaggccaaggcaaggtggatcacctgagctcaggagtttgagaacagcctagcctgtggttttgtagaaaactccatctctacaaaaaatacaaaaagtagctgagtatggtggtgtgcacctgtagtcccagctacttagggggctgaagccagaggatctcttgtgcccaggaggttgaggctgcagggagctgtgatcatgtcatttcattccagctggacaacagagtgagactctgtctcaaaaaaataaaataaaataaaatataaaaaattaaaatttttaaatactccagaagtcttaattttcagaaagagtgaagggcgcaatgcctcatctatggttatgattgcaaaagtacaaactgatttcaattgttttattgacaaagtcatacatctctagaagatgacagtttctctaatgtgaagtcccaaattcaagaggatttccattagtttccagaataagtagctaagtgcacaacagccctctctgtaaagtttgactgctacaaaaataagaaaactggtttgcatgctgctaagatgaccgaacacaaaaacatcttttaataaggagctgaaaccaagttgggagaaggctgcttcagtcttcaatttttaggtgcagtggctcacacctgtaaatcccagcacttcaggaggccaaggtagatcgtttgaaaccaggagttcaagacaagcctaggtaagaaagcgagacttcatctctaccaaaaaaacaaacaaaaaaattagctgggcatggtggtgcacacctgtagtttcagctacaggggacgaactccagggctcaagtgatcctcctgatagcttagcacagaggtatgaccatgccactgcactccagcctgggcaactgagcgagaccctgtctctaaacagaagggaaaaaaaggtcttcaattttgcaaaagggcagccatggtacaccactcagttgttcattcacggtcttcaacccactttaaaaggcataatggaaatgacaagaaaacagatacaaaaggtatttttaagaggatgcggcagaatgtatcataaagttattacacagtaacagtttttaaatgcacttcttgggactattcctgtgctccgttatcttctaaacacacttccagatggccccatgttcggtgacacattgaggagagaaagcggctggtgaggccacacaaaagaaaccggaggatggcagggtgctaggaatgctggctgaagggtgggatgcagcttgggcatgaggcctttaaaaggcatattcttgaccaagatgataaatagagaggacagtaattaagggaggaagactggaactgagagaaaacaggaaaggagagagtagggggaaaagattacaaagagagaagtgaggatgagtacaggaaactccgggagcacccaataccccagggcaggagatgtgatttaaggatgggaacattatggctgtatttgattggcttacatgtaatagtccccagccccttgggggtcaccagtgctacagggaaacctgggtgggattatatccagcatcctctcagtggaactaaggcttttttttttctttttttttttgagatggagttttgctcttgttgcccaggctggagtgcaatggcgcaatcttggctcactgcaacctccatctcccgggttcaagagatccttctgcctcagcctcccaaatagctgggattacaggcgcctgccaccacgcctggctaatttttgtaattttagtagagatggggtttcaacatgttggccaggctggtattgaactcctgacctcaggtggaactaaggctcttgagcctgactttgggcgttaatacgcaggaaaagaggtattactctctgtggaagttatcaccttcaagataaacacactggccctgggaagaaaggttgaatagagagcctgaaatccccaaagagaaatcccttgaagggctcctctgaactcccatcacccacaaacttaagagttttcctggtattccacaatgctgagacatattttttttttttttttttttttgggacagagtcttgctctgtcgcccaggctggagtgcagtggtgcaatctcggctcactgcaagctccgcctcccacgttcatgccattctcccgcctcagcctcccaaatagctgggactacaagcgccgaccaccatgcccggctaatatttttgtatttttagtagagacagggtttcaccgtgttagccaggatggtctcgatctcctgagctcgtgatccgcccgccttggcctcccgaagtgctgggattacaggtgtgagccaccgtgcctggactgtgataggagttttaattttctctggttaatgaaatttcagggaagggatcaaaggtgattttatttctctttggtgggtcctgtttccaggcagataagggagcttcagagaagagcctcattctgtgctttgggagggacagaggattgagggacaggagtggggagaaggttaaagagcccctgaggtgtctttagttccgcgtgtcaaagggccattttttgaggtattgtttcctgagcctgacatacggaacaggatggcacaatattttgaagatgccaaggaattttgaaattacactattttaaccttgccataatttaatggaaagggggaacaccaagtatttcttcattttttaaattaaaaactttctattgtgggcaaaatacatataatgtaaaattaaccgtcttttttttttttttttttttttttgagtcagagtctcactcttgtagcccaggctggagtgcagtggtgccatcgcagctcactgcaacctctgcctcccgggttcaagcgattctcctgcctcagcctcccgagtagctgggattacagtcgtgcaccaccacgcccagctcatttttgttatttttagtagagatgaggtttcaccatgttggccaggctggtctcgaactcctgacctcaggtgatctgcctgcctcggcctcccaaagtgctgggattacagtgttgagctaccatctctactatatttactcactttcaaaagaacccttttctgttttccttccagataagttataccagccaaaatatcaacaaaatggtgaaaaatcttaattccctgtctgcaagaaaaaaaatatttattagtgttaaaaaaaaaaaaaaaaagactgtagaaatccaaaagtcattttgaaagcaacgaccgttttaagggccaaaagagaaatacgggctgtttcgagcgtgaatcaaagtgtcaaagaacatttggaggctgctcggtagacatgcactctctcaaggacaactgagatgcatgcctgactgagtcacggctgagcacccagcgctcagcagtcagctccagagctgcagaaagtaacccagtgagacccgcggtgccggctacaggtccctgacagctgatacccaacttcaatacaaagatcaatttgctgctagtccagagaaattgaccttcgtgttcagactcatgggcagaaaaagtcaacagtgatttaaaaatgaaccccaaatcaattattctaaggaatttaacgctggttcaatgactgaaaattgtcattgcctggctctgaaatagaaaggaaaggtgagccaaaaaataaataccgagtcattggtaaggttctgttggagtcaattaatggatccctagagctgattaaagaaaaaaaaattattaatgcaacatctggagttaagttatttaaaagctaataccagggcttatgccactgaatttccaagggacttggcaaaggagaattatctatttattttctaaataccacagattcctttaaattacccaacctctcttgcttcattcaaacatgtgcagcttcaagtgggcgtctactgcattagattagataagtcacaagggcagagtctctggactgcaggcgttgctttgcagttgagctgctctcttcacatgggtaccaccataatgtatgctccagggtgaagagcagcaggagtagggatttactcacggacagaacaatcaatgtggccaacagagatgctttgtacagaattactaattagtgcagcaaggtattaattattataatttctaaaaatattacaattccatctttaattttgtttagttccattcaacttttaacagtgattgtttcttgtaagcaacgttagatgtcacaactaacatgaaagcaaaactgtgtctcattctctgagcacgcaccaataactggcaggagctggatgcctcttaaacagagtggcaagcaccagaaagtcaggaaggtaatctgatatttgaatttccatttagacaatatccaaagaagataatccatgtgtgattaactgtgactttaataaccctacaaaccacgcacgcctccatttgattcattttatagttacagttttaaagaaaggaaaggcatcaaatctgtacccaaaacatcaattttagggaacttattcaaaaaatttaaagtgtctaccagctcacttttaaacatgtaactaggctggacgcagtggctcatgcctgtaatcccagcaccttgggaggctgaagtgggcagatcacttgaggtcaggagttcaagatcagcctggccaccatggtgaaaccccgtctctactaaaaatacaaaaattagccggggtgttggcccatgcctgtaatcccagcttctcaggaggctgaagcataagaatcgcttgaaccagggaggcggaggttgcagtgagatcgtaccactgtactcgggcctgcatgacagtgtgagactctgtctcaacaaacaaacaaacatgtaattaaaaacagccctagagctataatgccaacttgggagaaaaacataaggaatctctatctaccaattacttttgaacacagaacccagaagtaaagattctctgtaattctattcctttattttcctgccctaatacatactaaaacctgccaaatcttctccttatcttccattaaaaattctctctctggctgggcgcggtggctcacacctataatcccagtactttgggaggccgaggtgggcgtatcacgaggacaggagtctaagaccagactggctaacatggtgaaaccccgtctctactaaacaaaacacaaaaaagttagccaggcgtggtggcgggcgcctgtagtcccagctactagggaggttgaggcaggagaatggcgtgaactcaggaggcggagcttgcagtgagctgagattgtgccactgcactccagcctggagcctgggcgacagagtgagactccgtctcaaaaaaaaaaaaaaataaataaataaataaataaataatctctttcttgttttgttccaatgagaaaaactatatatgtttgaaaaaaaaattcaaataataaaaacacactgaaggtaaaagtctctattcaggtatgatttaactctgcatgtatttaacttgatgcggccaccctgtatgataggagaggatcagcaaaggtcttgcctattcccctagctcataactgatttagtgtgagtgcacgtgtgtatacagtgtggtggttaattctcttcaaaggagtatggaaagaggatgacagagttggatggaacctcaaagaccatccagtggcaaaatacatataatgtaaaattaaccatctgaggccagggatcattgattttacatgtgaaaagacataaagtgattttgcctcttctctcccgacccaggcttagccagctttggtaaattcagtcccaactagaatccaattcttcatttcatttcaatttacggatataaaagaaaaatctatatataaatagtgagcacttgagtgtaatgagaactgatgagttaggctgggttcacaaaatatattcagcaggtattgggattctatttctcccataagtaggtagacaaatagtgtcgggaaagcatactttgagtatgcaaaactaagtctgtcccaggacaactgactgtacttctaaacccagccctcatttgctggtcccagcaggtgggtgaaaacagatgaattaattggtaagcaaacactaccagaaaacgcgtacaaacatgtacacgtacatcagtcatatcatcaatcaaggcccacacggtgtaattattactcaataagaacagaaaccactcttagaaatcataccttatctttccaaaccacaccaagcaaaaacaataatcaaaaaaagattctactctgtgatcatttctgaccccttgatgattgcaaaaatcactgccttctaacagattacaaagagtgtggaggtctctgaggtggtcacggtgatagctctgagcctgtcagtccctatcaaccaccttctattataaataaaggttttccaattttgcacttctctcaaaggcttcaatttgcctggattaagctgaagcgtcaacgtttgaacttactgctcctattcccactccccaaataaatgctgttagcagaaaaacaggcttttccacagtaggaactcaaaatcaaagcagacaacattgatgtggtcacatataaacgatattctgaccacaaacacttaacacgcgcattatccaaaccccatgagcaatcgcagggtacaggatagagtgaatctttcagggcaccaagagaaagaaaggtcagcgagtcatacattttagctcctgaaatgaatatccagcaatgccaatatattcatcaaagtgccacagtattctcttagattacagaagcaggtctcctaagagctttatactataccatttcactacttagtatatattatcttcatgatggagaagtcatttattgaaaatactccaggtatgtctggggaggggaacagtttaaactgattgaagaagacatgtttaaaaataataataagaacaacttaagaagagggacctgccttatttatctttgtaataatgatagctaggtagatatttgctatgttattattattgttgtttatatttttttttgagacagttttttgctcttgttgcccaggctggagggcagcggcgcgatcttggctcactgcaacctctgcctcctgggttcaagcgattctcctgcctcagcctcctgagtagctgggattacaggtgcccaccaccacgctcagctaattttttttgtatttttagtagagatggggttccaccatggtggccaggctggtctcaaactcttgacctcaggtgatccacccgcctcggcctcccaaagagctgagattacaggcatgagctaccgcgcctggccggtatttgatatattattatactataaccctctgggggttgcagtttatataaatatggtcaaagttacagtcttttacatttttctgtactaataaatagatttcattattattttaaatgactacctaattgggacaaagagccagaaataggatgaggagaagagaaagtgatgaggagaagagaaagtgatgaggagaagagaaagtaatgaagagaaaagagagttcagagttagaacaaacaggcctggcgtctgcctagatagatatgagaaagagagatcccaaagtagtatattgtgacatgttttatttggcccacatggtattttttttatgtgaatttattgtcaacattaaaatattgggacatttcacttagagatccagatttcaggcttctcttaaacaaataaacagatgatgtaggaattctcagcttgcattcccacttagtaaaaatctgccgttgacggctctagtttgccactggagataatcccagctgcccacttaatgcaggaaggtttccctgtctggcccttgaaggcatttgaagagatgaaggaagtttggggcctgaaaaaataggaagcatggaagaggaagcttattttgggacaaagaacatgtagacatggaaaaggtgttgcaggcaatcaagagaaactagctagctggtagctaatgaagacacagacttgggattcaagtgaggtttgggtctgagatgtggaactgtgagttacccatgaagttaaattaaaaaagcagatgaagtggtttaaagaaaagttatcaaggaaaagagagcagaggactgagccttaagtattgtcctcaaaagacaggggggccacgtgaggtggctcacgcctgtaatcccagcacttcgggaggccgaggtgggcggaacatgaggttaggagttcgagaccagcctgaccaacagggtgaaaccctgtctctattaaaaatacaaaaaagtagccaggcatggtggtgtgcacctgtaaccccagctactcaggaggctgaggcaggagaatcgtttgaacccaggagatggaggttgcagtgagctgagatcacactattgatctccagcctgggcaacagagcgagactctgtcttggaaaaaaacaaaaacaaaaagagagagagacagaggaagagggaaaaaatgagaggccatggagaacaaaacaatcaccataggttccatgatctggtcccagcctgcctagcttcattttccacgcctctcagcaagcagccttgatcccagccagacaggctatgtcttagagaaacctggtgctgtcaatgccttcttcgaatctatttcccactgcctggaatgctattttctcctctctgcctgtgttacatttttgtttgtttgttttttgaaacagagtctcactttgttccccaggcaggagtgcagtggcatgatctaggctcactgcaacctccgcctcccgggttcaagtgattctcctgcctcagcctcctgggtagctgggactacaggcatgtaccgccatgcctggctaatttgtgtatttttagtagagatggggtttcacaatgttggccaggctggtcttgaactcctgacctcgtgatctgcccaccttggccttccaaagtgctgggattacaagtgtgagccatcgcacccggcctgcgttacatttctattcacctttctcgaatgagctcgggcccacgcttcaccactatgctatatacgtatgtaagaagtctgcacttgcagtctgtaactatatacaaacaaaaatcttttaaaaagccaaaaaataagcccaagagttgccccaaatgcccaagagatgcctgtcacagtgtcccctgcaccactatcacattgctctgagtctgctgccttcccatttgattgagccctccatgaggtcagggaccaggactccttcattttatcctcagtggtgttcaataaatgataacagaaaaaaggaagggaaggaatgagcaactgatgtggcgggataaatcttgacataatgctgggtcacagaagtcaaggaagaagagctatttctgccagagagaaccatctcaaatatgagaagttattccaggagaatgagggctgatgagaagcactggatttcagcaagaatctgccactaataaggttggggtgggggatggtttctgatactttactggaaaataacttggaaatatatatcaaaaggcttaacactgtttgcaccctgaggctgaacaaatctacttgggaaacacatctgtaatggacaatgtgggtttttgttttttttgtttttttttttttggttttgctttttttccctgtccagatccaagttttgtttctgttttgaaggtgctcctgttacatgacctcttggtagggggcggcttctcacttcccattgaggatgtcaaagccaccagattcttcctcagactcccttaagagaggcagaggcacccacgtgttcagcaactctggcctcaccatccagatcacaaccttcttgccaaggacagctgctctgtcctctggccctgcagctgtcacttatctgggcctcaaataaccctccagtcagggccccatggttataaggcagccagagtctgcctctgattctggttcctgggagtatcctaatggaaatcctacctgagagaaaaagatcctaaatatcgaaaaaagtgctatgcatttcatgtagcatgatttacacagcaaaatgtgggaataaactaaggcccccaaaccaggaacacagaagtaaatgatggtattgctacttgataaaatggtactcaccattagaagtaaaatatagcataatgttaaaaaacagaaggtttgttgttgttgttgttgagacacagtcttgctctgtcgcccaggctggagtgcagtggtaggatctcggctcactgcaacctccaccttctgggttcaagcaattctcctgcctcagcctccctaatagctgggattacaggcacctgccattaggcctggctaatttttgtatttttagtacagacggggtttttgccatgttggtcaggctggtctcgaactcctgacttcaggtgatccacctgcctcagcttcccaaagagttgggattataggtgtgagccaccatgcccagccaaaagaaggatttaaaaatacagtattatcataatcttgtaaaaaattacttgcagaaaagatgactgggagtaataaaacattaggcaaataagtatttttccctaaaaattctacttaacttttaaattacaaaagtaatacaggcttactgtaatatattctgaagacatagaaagaaaacattgatgggccaggcatggtggctcacgcctgtaatcccagcactttgggaggccgaggagggccaatcacgaggtcaggagatcgagaccatcctggctaacacagtgaaactccgtctctactaaaaatacaaaacattagccaggcctggtggggggtgcctgcagtcccagctactcggaaggttgaggcaggagaatggcatgaacccaggaagcatagcttgcactgagccactctactccagcctgggtgacagagcgagactccatctcaaaaacaaacaaacaaacaaaagaaaacattgatgatcccaacacccagccccctgccttacccatgtcctgccattcccacatcaccaatggtgaccacgtgcccctccacacctctcttcagactctaaccaacactgcacatgcaggtctctctcctccttttctttccgtcctccctccctccttttccttaagtgggaccatagtatatatactccctgcttattttggtttggcttttcacttaccaaactcagaagcagcttgtcttactaattcttcagacctctgctcctgtgttgcagcctcttggaaacctctgagcccttggctgactcagacccgtctgtactacctgcagtcattagtgatttacagcatgtgtcccctctctcctatactcttaagtcctatctaccttttaccctttttttttttttttaaagaaacaggatctcatcactgcccaggctgaagtgcagtggcacaatcatagctcaccgcaacgttgaactcctaggttcaagggatcctcccatcccagcctcccaagtagctgggactataggcgtgagccactgtgcccagtcctatctacatttttagctccagttcctagcccagtacctggcacacagatgatatccactatctgtgctggcatggatgaagaagagaacagatgaatgggaaaacttgaggacaagatggttttgaaggcagataggcactgatgaaggacaaggcatttctccattgatactgaattaaggatgacacagcgggtacagagacagacacacaagaatgtaaagaaaaaggggccaagagatttaactagcttacctcaatgaaccatgataagggaaagaagaagtaaaaacaatagccagatagaaatattcttgataaacagcatgataaataaaggaactggcatagttccttctttgttccagattaattgcttattcttgtggtaaaagattaaaaataattctctgagagacaaaagtagctctaaagtctgttaaataaacaagactacttagaactcagtttcttacctatgttttataaggttcaaaagagctaatatgataaaaagcatgttggtcaggcacagtgtcatacatctgtaatcccagcactttgggaggctgaggcaggcagatcgcttgagtccaggagtttgagaccagcctgggcaacatggtgaaatcctgtctataaaaaataaaataaaaattagccaggcatgacggcgagtgcctgtagtcccaggtactcagcaggctcaggtgggaggctcacttaagcctgggaggtggaggttgcagtgagtgccactgcactccagccaggatgacagaccagacagaccctgtaccaaaaaaaaaaaaaaaaaaaaaaaagaaagaaaaaagaaaaaaagcaagccaggtgcggtggctcacacctgtaatcccaacactttgggaggctgaggcaggcaatcacttgaggctggggggttgaggccagcctaagcaacatggtgaaaccccgtctctactaaaaaatactaaaattagccaggcatggtgatacacacctgtaatcccagctaattgggaggctgaggcaggagaatcacttgaactcaggaggcggaggttgcagtgagccgagatcacaccattgcactccagcctgggcgaaagagcaagactccatctcaaaaaacaaaaatgaattaaaccccacatcttatcatagctggcatttataaaggactcactagtactagtcattgtgccacctaactgttctcacttagtctacagaacaatcacatgtactactaattgctatcctccttttagagtgaagggaactgagacttagagagggcaagcagctctctaagtcacccaggctgtaagtggcagatcccaaattgtgccccaggactgtcggacgccacacctgtgctgcatgctactactcttaaccagggtcctgccccacctccctaagaagatcacattcagatgagctgaaggcagatccaatggtcgtcgattgagacagcattaatgcaatgtcagctgggttgatttctaaccacatcactgaaacactactaaaatcacaataaacgtgcttagacaacattacgtaatagtcaatatgctgagaagcaagactgtacatccacccgagtcattcagaattcttagtctggtctttcacaattggcgccctctgtcagactcagacaaggctctattttgaattctaatgaggaccaagcacactgaatatttaaactgcaattacaaagatcctacttttatgtaaatgtccttaatggaagtaacagatctgaaaatacatagaggtaccagtggaaaaatatcagtctaatttgcatttagaagctagaaaaaaaaaaaaacagtattgttttctacttgatgctatcattggggtggggttgagggaggaaaagggaggaaaatccacacaaaaatctcggtaaaaattttaaagcctgtgctcctgagtgaaaggttcacaaagaggtacttgaatcccttgttaagaactgaacaaacaaattcatcatcgggcctctctcctgtgtggccccttgcagttcagtctgtattcataactagaaattctctcactgctcaagcatctatgactgatacatcggcccatcaaggaagatatgccaagggtagcgaaacaaaaggccatttcatgattcacaacctatttttacactcctttgtgtaaaatgatgatgtggcggctgctatccacactgcacccaagtcctcttaaacagtgatagaattgccctgtgaatggtaattgagttacactccactgggctgcttaattcccaccccctatagttaaagtacaccttgcttgcagtttgattatgcatttgtatgtgttcatatataaaacagccaatgtggctttgcacttgagaagagcaggtggttaactcttcgctgtatctcgaagctcttgcaccaaccctctgcccctcaaacgcctttcttattaagatcataatttaactgcctagcatttgggcattctcttcaagatgctaacatttatcaaatggattatgctttttttttttttctttcttctggtttgtcctctggttgattctttcttctgctgataccaaatatgttcactggattttttaatttcagttacctgttatttctagaagttctatctggtcccttttcaaaatttctgtgttacttattatagttttcgggtttcttaagatgctttcaagcttgtcatttttaaaatatattttaaaaagtggaattgagtttataatcaacgtctgataattctactactgcaattctgttcagattcatgtccatggtctattgctggtcctcactcatgctgtgctgtttccgggtatgctagaatatatttgactatgtgctggtcattgcccttagaaatttatttttagttggctcctagcatcctagaatatgctttcctccagaggcatttcatttgtttttgccaggcacctcgagctataacaggtgagtctgcctcaaaccaaattcatggtatgatgtttcccggtctaccctgagtatgtatgtccagggggcaaattcacatgtgggcctttctgtgaccacaagttgtcaatactgtattttccctcccgtctttttcttctcctattctgctcagtgccaacgctgccctttccacaaccccccatggtaagtttagttctggttcacttttactctgagggtgtagctctttggggtcccagtttcttgtgggaagggtctcccatgacatttcctaattagagtgggtgcccagggactaaatttccaccccatttgcctgcccctctcaggctacagaagtgtctggctttatcagattaaaaaaattatttttatttttatttattaattttttttctgagatggagtcatgcttttttgcccaggctggagtgcagtggcatgatctcggctaactgcaatctctgcctcccgggttcaagcgattctcctgcctcagcctcccaactagctgggattacaggcacgcaccaccacgcctggctaatttttgtattcttagtagagacagggtttcaacatgttggccaggctggtcttgaactcttgaccttgtgatccacccgcctcggcctcccaaagtgctgggattacaggcatgagccaccacgcccagccctcattttttttttttttttttttttaaggaaaatactgaaaagtgggccaggcgcggtggctcacgcctgtaatcccaaaactttggtaggctgaggtgggcagatcacctgaggtcaggagatcgagaccagcctgaccaacatggagaaactctgtctttaacaaaaatacaaaaattagcccagcgtggtggtgcatgcctgtaatcccagctactcaggaggctgaggcaggagaatagcttgaacctgggagacggaggttgcagtgagctgaggtcatgccattgcactccagcctgggaaacaagagcaagaagactccatctcaaaaaaaaaaaaagaaaagaaaagaaaaagaaaaagaaaaagaaaatactggaaagtacctaagagtttagaggctgaaagcaaaaccaagccaggctaatatgaaggttcctcaaacatttaaaaactgaattaccattttatccaacaactccacttctgtatatatacacaaaaaaggaaagacttgagcagctatttgtacagcaacatttatggtggcattattcacaatagccaaaaggtggaacaacctgtgtccactgacaaatggataaacaaaatgtgatatatacataaaatggaattattattcagccttacaaagcaatgaaattctgatacacactacaacatggatgaatcttgaagacatcaccctaaataagccagatataaaagtatacatatgatcccgcttacaataggtacctagaataatcatatctacagagacagaaagtagaaaagtagttaccaagggctgaaagagggaggaatagggaattattgtcttggataaatttcagtttgggatgttaaaaaaagtggctgggcgcagtggctcacacctgtaatccaagcactttggaaggccgaggagggtggatcacccgaggctgggagtttgagaccagcctgattaacatggagaaactctgtctctactaaaaatacaaaattagccagatgtggtggcgcatgcctgtaatcccagccactcaggaggctgaggcaggagaatcgctcgaacccggaaggcagaggttgcagtgagctgagattgcaccattgcattccagtcagggcaacaagagcagaactctatctaaaaaaaaaaaaaaaaaagttctggacagcctcggccacgaagtgagactctatctctagaatttcttttttttaatgccactgaactgtacatttaaatgtagttaagatggtaaattttatgctatatatattttaccacaattaatttttttttttttttgatggagtctcactgtgtcacccaggctggagtgcagcggcacgatcgcggctcactgcaacctctgcctcccaggtttaagcgattctcctgcctcagcttcccaagcaactgggactacaggcgtgtaccaccacgcctggctaatttttgtatttgtagtagagatggggtttcaccatgttggccaggttggtcttgaactcttgacctcaggtgatccacatgcctcggccttccaaagtgctgggattacaggcgtgagccaccatgcccagccaaaagaaatttttttaaacaggtcaggttaattttgccaagagttgctagacctactcagtaagttccacaatatgctttgtgttcacaggcataatattgatcagttgaaggcttaaaaggaaattcctgagaggcttaaatacttgactgacccccgtacagctttagagaccacatgctgaccttcatcgacatgcaaaaactagcactgcatgtcaacaaatgcatatataaaatgcaaaaattgtcctgtaaaggtatcaggcataggaaataagtacagttacttggttgttgatccataatactgataaaattattaagtaaatattacaaaaagaattgaagaaataacagaaataatgatctctaaagtatttccattaaaagaataaagaggttgggcgcggtggctcacacccgtaatcccagcactttgggaggctaaggtgggcagatcacctgaggtcaggagtttgagaccagcctgggcaacatggtgaaactccatctctactaaaaatacaaaaattagctgggtgtggtggtgcacgccttaatcccagctactcaggaggctgaggcaggagaaatcacttgaacctgggaggcagaggttgcagtgagctgagattgtgccactgcactccagccagggtgacagagtgagactctgtctcaaaaaaaaaaaaaaaaaaaaaaagaagaattttcttttttcagtatctacttaacactgctatactgatgaacttctcccttttgaatcattacatataattctgtggcagataatatatacatatataattaaataaaatgaggcatgagataaatgtatagttattttaaaatatggacacaagttttccaaacgtattttagtacttctgggattccttaaattcttttctattttcaaaaaacaacacttaagagtccagctcagaagacattatgacacttctgggtaaaaatactacacaccagatattaacatcaaattaaaaactggcaacagtgtaagaaatattccacattcattatgacttcatgagtggcatgtgctgagttactatgttgcaaacacaaaaacttgccaacatgtctatgaatatattcattccaaactagcaacataattgctgagaacaacaaaaacaacatatataacattgtatgtcttcctgctctagacatatagtaacgagagctaataccagtacttgctcaccgcacacaatgtaccaaagatggttttaagtgatatatatatgttaggttggtgccaaagtcattgcagtaatggcaaaaaccacgtttacttttgcaccaaccatatacatatatacccacatacacatacatacatatatatattacatacacgcaatcatttatttctcataacaatcctttgaggtctatatctctattatccccatttcaaagatgggaaaatcgtggcaaaagggagtttaggctttcctgaggtcacgcagctagagagagttcgtgaagctcgggtgtgaggccaggctctagagctcactctcatgatatctatgctctggcacctctcacatacgtatggaaagctgggggaggtggccagcactggacactttacatagtccatacaactgaattttgataaccaaattctccgctttcttataattaggaaactgaggcccagattaagagagaggtggaagtgaactcatattgagaggtgaagccggctggacttctgggtcgggtggggacttggagaacttttctgtctcactaaaggattataaacacaccaatcagcgctctgtgtctcgctaaaggtttgaaaacgcaccaatcagcactctgtaaaaaatgccccaatcagcgctctgtgtctagacaaaggtttataaacacaccaaccagcatgctgtaaaacacaccaaccagcacgctgtaaaaatgcaccaatcagtgctctgtgtctagcttaaggtttgtaaacgcaccaatcagcactctgtaaaaatagaccaatcagcactctgtaaaatggaccaatcagcactctgtaaaatggaccaatcagcactctgtaaaatagaccaatcagcaggacatgggcggagccaaagagaggaataaaatcaggccacctgaggcagcaaccctgacccgctcgggtccccttacatgctgtggaagctttgttctttcactgttcacaataaatcttgctgctgctcactctttcggtccgcaccacctttgtgagcagtaacaccggctgcaacggtctgcagcttcactcctgaagtcagcgagaccacgaacccaccggaaggaagaaattccggacacatctgaacatcggaaggaacaaactccggacacaccatcttcaagaactgtaacattcactgcgagggtccacagcttcattcttgaagtcagcgagaccaagaacccacctgaaggaaccaattccggacacagtatctctcatctttaaagtttcaggatctatcatagataacaaagtccctgtggccagaagttatgggagaagattgataaagcaaaaactgaggaccagaagcacagggcaggatggtcgggcaggacagtggtgataaagggtctcaaggagaccccatggggctccactacctctgagcttgcagagtctctatgtgcctgaccctctctcaccccattgttctagccttctttcttactgagcaaacacagccagggaaggtgatgcttctgaagctgcacatctcagggacccttgcccagagcttccaaagtggacagatggagaggatccattacatttttcatattaaaaaggctgaaagtttggcaaagtatgttctcagatctctaggttttttttaaattgcttttgtaattcttttttttttttaaagacacaaggtttcactctgtcacccaagtggaagtacagtaagacaatcatggctcactgcagcctcagcctcctgggctcaagtgattctcctgtctcagcctcccaagcagctaggactacaggcacataccaccatgcctggctaatttttaaaattaattaattttgagacagggtctcactctgtcacccaggctggagtgcaatggcacaatctcagttcactgcaaccttcaagcaattctccctcttcagcctcccaagtagctgggactactacaggtgtgtaccacaatggctggctatttttttgtatctttagtagagacagggtctcgccatgttgcccaggctgctaatttttaaattttttatagagacagagaggtcttgctatgttgcccaggctggtctcaaactcctgagccactgcaggtggcctgtgattctagttttcataaatatgtcagctttataatcttggtgcacccttgtgagacgaagcacccaaaaacaattactgtgattactactgctattcccatcatttatcatcacgtacctttgggcaaggcactgtgcaccggcaatacacaatttaaacctcacaaaagtctgcatcagaatttctgcagaacaagcacctgcagcagaactgcttggtacacttgttaaataatgaacattcttgaactccaccctagatctactcaatcagaatccccaggggagggcctcaggatcagtattttaagcaagccctccaagcgattcttatcttggcatatgaatccccattttacatacaaggtatcaagaggtaaggtgacttgacaaagataccatcactaaacataggatttgaactcaattaagcttgtggttattttaagacggcacaaaagcaagtgagatcccctttaaaacccgccaaccagtataatgttatacaatttcccaaaccattaatctctgtaaacacacagaaaggacttttaaattaaaaacaaaaacaacaacaaaaaaacaatgaatgatatgccctttgaactccatttcattttgaccagatttaaccattgtttagcaatttcagtgcttcatcaaatggaactgcctgtatcagaagagcaaccaaatccccacagtaattagacaaacaggaaactcagagcagagtaaatccacaagctatgacagaaacagagccataacgtagctatctcttaccacaagaggctgactttctgtccaccatgtttacccgcctggtttcattgcgaagtttttcatctgtgttctccactaggttggcaaggtcgtcaattatctctagaaaggaaacatacatgattactattcctgaaataccccggttcacatcacagtatcacagctgtggttgttcatcctagcaataatgatctcgagtgcagtaactgaaaaggtacagaactcatgtcgattctttgaaaactgcaattctgattgtaaaaggaaaaaaaaaagcagtagtaaagaagaaaactgatttaacacaattccagcagacaggagaaatgccacattcagaggaaagaaagcatgacctgccgaatttatgcctagccaagctgtcattcaagtataaaggaacagacaggccaggcacggtggctcacgcctataatcccagcactttggaaggctgaggagggaggattgcctgaggtcaggagttcgagaccggcctggccaacatagtgaaaccttttctctactaaaaatacaaaaattagccgggtgtggtggtgtgcacctgtaatcccagctactcgggaggctgaggtaggagaatcgcttgaacccgggaggcagaggttgcactgagccaagatcacgctgctgcattccagcctgggtgacagaacaagactccatctcaaaaaaaaaaaaaaaaaaaggaacagacggcacagtagacttcagggactacctgggcccttcttgagaaaactacatgatgaagaaatctagccaatcaaaagataaataaagagatgatggagagaaccaaatccatttaaatactggactaagagtaaacaaatacgtggattagataacagaaaggtacagaaaggtcacaacagtacaatgtaattccaactgaaaaattagtcagtggttgcgagtggggaaggaaggtgaaaagaaattgaaagtgctaatttcttcatctctcgcaacgaggcatatcgagcagttgaaaagttaatcatacagaaacttgtagccttttaaaatcaccaaaactttaatgttttttgttaagcttgagggatcttttagtaattactatctcttgtaaagaatccttgatgtgggctgggcacggtggctcacacctataatcccagcactttgggaggccgaggcaggaggatcacctgaggttgggagttcgagaccagcctgaccaacatggtgaaaccccgtctctaccaaaaatacaaaattaatcggtcatggtggcgcatgcctgtaatcctacctactcgggaggctgaggcaggagaatcgcttgaaccagggaggtggaggttgcagtgagccgagattgcaccactgcactccagtttgggcgacagagagagactctgtctcaaaaaaaaaaagaaaagaatccttgatgtgaaattcatttcttttttaattctaatctttttaagtgaaattgagcccttcacaacatttaaaatagcatatatagtatagtacgatcttaactatgtaaaattatttgtatccatctttttatatttacaaacctataggggtatatgtggataatattaatctaatgctactaatgattatttctagatggtgggatcctgtgtgactgctgccttcttccttgcatttttctgtgttgtttgaatttctgtgtgttttttttttttttttttttttgagagagagggtcttgctctgtcacccagactggatacagggtaccacaatagctcactgcagtcttcaaggctctagcaatcctcccatctcaacctcctgagtagctgagactgtaagcatgtgccaccactcccaggttattgtttaaattttttgtagagaccaggccctgctatgtcacccaggctggtctcaaactcctggcctcaagagatcctcttgtgtcagcctctcaaagtgttaggattacaaccatgagtcactgtgcctggcctgaatttcttacagtgagcctatatagtcatgtgccacatgacatttcagtcgatgaccgaccacatctacgacagtagtaccataagtggtacagtattataatgttataataccatatttttactgtaccttttctatgtttggatacagaaacttttttttttttttttttttttagagggagtctcactcttgtcgcccaggctggagtgcagtggtgtcatagcagctcaccacaacctctgcctctcaagttcaagcgattcttccgcatcagccttccaagtaagtgggattacgggtgcgcaccacccgtaatttttgtatttttgtatttttagtagagatggggtttcaccatgttggccaggctggtctcgaactcctgacctcaaatgatccacccacctcgacctcccaaagggctggaattacaggcgtcagccactgcacccgaccatatttaccatcttgttacaactgcttacatgcaataatatgctgtacaggttttcagcctaggggcaataggccataccatacatatagcctaggcatgcagcaggctttaccatctagttttgtgtgagtacactccatgatgttcgcacaatgagaaaactacctaacaacacatttctcagaacatatctctgtcaagggatttatgactattatatttttcattttgttttttttttttcctccctccttctccctccttcctgtttttatagtgactgctttggagatgtgctgttcaataccagtcaccatttttcttaaagcattaagtaaagcaaacaaggaaatcaaataaagtttccagaatgatgtgtgagctaaattctgaaggcgacatgggtgaaaaagcaggaaaaaggcaacccatgcaaaaagaatagtatctgaaaggcacaaaggagttgggtgctcctgcttcttgcctcctgcagcacttcctacaaacctcttatttatagaccgtatagttatattctatcgatttgtttacatgtctttaacaggaagattatgatacaaactaatttttattcatccttatacctcccacccctaggagaatgccttgtatacagcaagataaaataaatatgaaaagataaagacaatgaatgggctggtggctcacgcctgtaatcccagcactttgggaggccgaggcgggcggatcacaaggtcaggagtttgagaccagcctggccaacatggtggaaccccttctctgctaaaaataccaaaattagctgggcatggtggcgtgcgcctgtaattccagatacttgggaggctgaggcaggagaattgcttgaacccaggaggtggaggttgcagtgaggtgagatcgcatcactgtactccagcctgggtgacagagcaagactctgtcttgggggaaaaaacaaacaaacaaacaaacaatgtcctaacttatccttgtttctagtcctgattcattttaattcattttctatacaatactcagaacatattttaattctctcatatttcaatgaattaaaatataaatagctacatgtatcgaacaactcagctctaaagcaataacttaaaaaagaaaccaagaaaacactcacacacacacacacacacacacacatatgccctgccaagaggtatagttttaaaataaaaattaacagaagaaataaaattacatactaaaaatgtatgattcaggaaaggggtaaagaggaacaaaagatagatgggatgaaaggaacagaaatacaatatctatctggcatgcttaaattcaactatatcaatagtcacattaatgtaaacagactaaacttttcaattaaaagacaaagggtatcacgcaagattttttttcttttttaaattatactttaagttctaggtacatgtgcacaacgtgcaggtttgttacataggtatacatgtgccatgttggtttgctgcacccatcaactcgtcatttacattaggtatttctcctaatgctatccctcccccagcaagatttttaaaaaaagatgacacaactatatactttgctatgaaactcactataaagcatagtgtttgtatgagaaaggtggcaaagctatattaatatcagaccagacagacttcttgaaaaggagtattattagacataaaaaggaacttttcatcatgatgaaaggacacatgtcaaaaatgggaaattctgtcatatttgaaaattaaggaaaacacttctgatttccccacagggcaaagatgaaaccacaagagaaagcagaaagcagaaagaaggacaactgctatagactggatgttggtgtgccttcaaaattatgttgaagcctcatcaccagtgtgatgacatttggatgtggggcctttgggaggtgaatggtgatgagagtaaagcccgtatgaatgaacgaatcctgttccatgcatgagatttatgaccttataaaagagttcctagagagcatcctcatttcttccaccatgtgaagttacaatgaagacagctgtctatgaaccaggaaacagatcctcaccagacaccagatctgtaggcaccttgatcttgactccccagcttccacaacggtgagaatttctattgtttataagccagccagttgatggcattttaatatagcagcttgaatagaacaagacaacaacctagcacaaaagtttttaggatgctactaaagcacgacttatggaagtttagtgctctaaatgcatatattagtaaagaagaaagatgtgaaatcaatgatcagactcaaggagctaatagtatgatcatctcaataaatgcagacaaagggtatgacgaaattcagtgtccatccatgatacaaattatcagcaaaatagaaacgaaagggaacttcttcagcctgaggaaggctatctatatttaaaactctcagagctaacatcatacttacaggtggaacatggaacattttttatctaagatcaggaacaaggctatgacgtctattctgacagcatctgttgaacattttattagaagtcccagattgttcaataaggcaggggggaagaaagcaaaaaggtatgaaagggagctgtaaaggtgcatttgcagatgacatgattgtacacccagaaaacgataaagtctatttaaaaactactagaactagtaagtaaatctaataaatttgcacatacagtcaatagtaaaaggcaatatatttctatataccagtgataaagaacggagaaaaaataaaagtaaaaaaatccattataacggcatcaaaagccatattacatactcagaaataaatctaactgaagatgtgtaagacctctataataaaaactataaaacattgctgggagaaatgaaagaaggcctaaaaaaaggagaactggcctgacccatatggtagttctatctgtggttttctgaggaacccccatgctgttctccatcatagctgtactagttcacattcccacctacagtataaaagagttcctttttttctccacatatcctcaccctcatttgttatttttttttttttcatatattggttgctcatttataagagagaacacggtattttaaagatactggttcatttttttttcaattgacagatatcgtacagaattttatacattgaatgcaatcttaatcaaaattctagcaggcttttaaaatgaaacctgcaagccaattctaaaatttacaaagaaaattatttagaataaccaaaataatcttaacaaagaaaaacaggctggatgcggtggctcacgcctgtaatcccagcactttgggaggcctaggcgggtggatcatgaggtcaggagattgagaccatcctggctaacatggtgaaaccccgtctctactaaaaatacaaaaaattagccaggcgtgatggtgggctcctgtagtcccagctactcgggaggctgaggcaggagaatggcatgaacccgggaggcggagcttgcagagagccaagaaaggcacccactgcactccagcctgagcaacagagcgagactccatctcaaacaaaacaaaacaaaacaaaacagaacaaaacaagttggaggtattatgttaccaaaattcacaatttattataaatatatactaatcaagagagtctgatattagaataaggacaaacacatcaatggaacaaaacagagtccagatagacttgtgtgtgtgtgtgtgtgtgtgtgtacatgcacacacgcacgtgctcaattctcaacaaaggaaagaaaattcttttcaacatatggtgctggaaaaactggatatatgtatgaggaagtaaaaaacccctcaacccttttctctccataccaaaaaaaaaaaaaaattgtgatggttcatagacttaactgtaaaacctagaactgtaaagcttctaaaagaaaaaaaaaaaagagagaaaatttttatagcctggagtaggtaggcaaaaatttcttggacaggacataaaaagactatccacaaaagaaaagagattggtcaatctgatttagcaaatcctcaaaggaagtgatttctagattttgtgacatcctgatgctctgggcatagtattcttcctaaaatgtaatgggaggacttggacacatggcttcagtctttgtctcatcagcattgaacacagttctgtttatatatagtagcatatgtaaaagtggacatttttatgatccacgcctcattctctatcaagagaaattttctgttcatccaaagatactattacaaaaattaataaataagccacagaatggtagaaaatatttgtagaacatatatctgacatagtatttgtatctagagtatataaagatctcctacatattaacaataaagaaaagctaactttaaaataggcaaaagatctgaacagatgttttacagaagaagatatacaaatggccaataaacacatgaaaaacagctcaaatattgttaagtcattagggaaatgcaaatttcaaccaaaataagatactgcttcacactcactacagtgtgcaaactaaagacttacaatactaattgttgggggaaaatatggcacaaagggcgctgtacaagtatttgtcaattctcatcaagttaaccatatatctaccatcttacccagaaactttactcctaggttttttgttttttgttttttgaggtggcatcttgctctattaccaccctggagctggagtgcagtggcacgatctccgctcactgcaacctccgcttccgagttcaagcaattctccagcctcgccctcctgagtagctgggatttacaggcacgcgccactgcgcctgtctaatttttgaatttttagtagagacggggtttcaccatgttggccaggctggtcttgaactcctaacctcaggtgatccacctgcctcggctgggattacaggcatgagccatcatgcctggctcactcctaggtatttaccaaacggaaataaaagcctatttctcaaaaaaaaaaaaaaaaaagcctgtacaaaaatatacatagcaaccttattcatgagggccccaaactagaaacaacccaaatatccatcattaggagaacagaaaagcaaattggggtatatctgttaatggaatactattcggcaatagaaagcatgagctactcatgcatgccacaactgtctaaatctcaaaaagttttgttggctaaaaataagaaaacaatcattatatgctttgtgattccatttataagaaatacaaggataaacctagcctacaaaatagacatcagaaagtggttgcctctggggtgcttgactagaaagggacatgaggaaactttctgggaggatggaaatgttcgaaaggtcatacaaattcacgcaaatgggtacagctgtcaaaacacacagaagggaggaagggaagtcaggagggagggaagcagggagggagggagctggcaggcgggcaggcaggcaggcaggcaagacaaaacaaatgccttagaataacaaaatttcagacctgcaagagtcatgcaatcaccttgtagttccttccccttttataacatccctggcagtgggatggttaatctttcaccaaacactcccagagactggtaacatggaaactcatgagaaaatcagttccatggctgagttagagggtgactttgataattataaagtcctttattctgagctaaaattctgcctgctctcaacttctaccttaggtatttctttttctttcttttttcctcttctttttttgagacagagtttcactcttgttgcccaggctggagtgcagtggcgcgatctcagctcactgcaacctccacctcccgggttcaaacaagtctcctgcctcagcctcccaagtagctgaaattacaggcaccccttaagtatttctagaccaacacaatatcagtgttctttccttcataattttcctcatatatctccttggtcttctcctctaggttaaagatacttagatccaaactttagcaaacgctcaaaggaagtgatttcgagatcttgtgacatcctgatgctctgggcatagtattcttcctaaaaacgtgatgggaggacttggacacatagcttcagtctttgtctcatcagcattgaacacagctgagtttatatatagtagcatatgtaaaagtgggcttttttttctttttgagagggagtcttgcgctctgtcactcaggctggagtgcagtggcacgatctcggctcactgcaagctccgcctcccgggttcacgccattctcctgcctcagcctcccgagtaatgggactacaggcgcccgccaccacacccggctaattttttgtatttttagtagacacgggtttcaccgtgttagccaagatggtctcgatctcctgacctcatgatccgcccgccttggccttccaaagtgctgggattacaggcgtgagccaccacgcctggccaaaaagtgggcatttttatgatctgtgcctcattctctatcaagacagtccacagtaacaatcatgctttgtacttggccttgtagttgactctgagcttggtacactgttctcacgcaaccgaatacaatcagtattgcgtgatgcatcaacgccacaatacataatacaaaattcagggctaatagcctctgttactataagaaaatcaagtgcaaaatattccttgtctgacaagaaatacagtatgtcggatgttatatgttaactgggtttctagatagatttctttgtaagtttataaatattcataatatgacttagaggtaaatcaataaatctgtagcagattagatcaatgaaaaccagtagtcaacacttgtagggattaatgttttaatctagaccgaaaacgaagtttttcattttggttggtaaacctctcctctttattagttgttgtttctaaacaactctattttttttttttttttttgagacattacttcgctcttgttgcccaggctggagtgcagtggtgtgatctcggctcactgcaacctccgcctcccaggttcaagtgattctcatgcctcagcctcctgagtagctgggattacagatgcctgccaccacaccagctaattttttatatttttagtagagacagggtttcataatgttggccaggctggtctcgaactcctgacctcaggtgatccactcacctctgtctcccaaagtgctgggattacaggcgtgagccaccatgcccggcctaaacaactctactttttaagttataaaaattattcaatagcagtttataaatgcgaggggaaaaagtaaacattatccaaataccccagtataacaacagtgtaattcccccatgtgttcactacaatttgacataaacatatacattttttcgggcgtggtggctcacgcctgtaatcccagcactttgggaggccgaggtgggcggatcacctgaggtcgggagttcaaaaccagcctgaccaacatggagaaatgccatctgtactaaaaatacaaaatcagccgggtgtggtggtgcatgcctgtaatcccacctacttaggaggctgaggcaggagaattgcttgaacccaggaggcgggggttacagtgagccaacacagtgccattgcactccagcctgggcaacaagagcaaaactctgtctcaaaaaaaagaaaaaaaaaaaaaaaaaccatacattttcatttaattgcaatatataagcctcccccatctaatgatatcatttgtattttttcatgtagctacaaagtcttcagttataatttctcatggttacaaaatattcattccataaaataaccattccttaaataatagcccattgttggatacttagaatgtttctatatttctaaataatgagtctataaattctttcctccattatcattggttctttttaatcatttccttaacaaagtgtgattatgactgcctcataaactttgaaacagattgccaaattactttttaatagacttatactgccactgttggtttgatgggattcattccacttgtcagttatgacctcagaagatttcctaggccagagagccttggggaattcccactctgcagaccaggcactaccaaggtgggaatttccctaaccacagtctattaagagcaaattaaatacaggtttcagagtataggttgtgaaacaaccagctgactagttcagattcctgactgtagagcctccaaagagaaactgataccctgcttcctggtcagtacttgcatttggtttcacgaaggagcttatatttcaatcacatgttaatctgagatatcgagtgacattccagcacagaatggacaaaatggaacaacgtaaagtataccacaaaatgacagcatcacaaggattaagaaatattatatgatgtcaaaatacccgactccaataatacttcatcatttttctactctcaattacagcctcaatacattctatatatagggagagagtttgctatatattttcagatacatttggtgcctttttatactcataacggactcataatggcagtagtaaagtcattatgttattatgctttttgcttatgttcttaataatatttgaagacaaatgttaaaaaaaatctatagtgaagatagagtttttcttgagggtattagtttaattccctccgttccctataattgatatcatactcaaatttatcaatggaaaccaaaaatggggggtggtggtgacctctgataataccgtacactaggaaaagatacattccagagaacagggacacaaggaaaaaccaatctgtgacttcttaaaggaaaggtaatgctttgcctatggcatcctatggcagggagctgcaaggaactcccgcagatcaaagtggagcctctgggaaccacccaggctttggggacacagggaaagctcctttgcctggcagaaattccccttggccacactcgctcacaccttatacacagccagatgggccaggttaggcaaaaaacacaggctcctttccgacttcctcttgaccataaaccatggtctctcatctaggcttaaaaatgtgtaacaggagtctggacgcagtggctcaggcctgtaatcccagcactttgggaggctgaggtgggcggatcacctgagatcaggagttgaagaccagcctgaccaatctgatgaaaccccgtctctactaaatatacaaaaattacctgggcgtggtggtggttgtctgtaatcccagctactcaggaggctgagacagaagaatcacttgaacctgggaggcagaggttgcagtgagctgagatcgcgccattgcactacggcctggacagcaagagcgaaactccgtctcaaaaaaaaaaaaagtgtaacacagggtcggtgcggtggctcatgcctgtaatcccagcactttgggaggctgtggcaggtggatcacgaggtcaggagtttgagaccagcctggccaacgtagtgaaaccctgtctctactaaaaatacaaaaaaaaaaaaaaaattagccaggcatggtggtgggcacctgtagtcccagctactcgggaggctgaggcaggagaatcacttgaacccgggaggtggaggttgcagtgagccgagatcgcgccattgcactccagcctgggcgacagagcgagactccgtctcaaaaaaaaaaaaaaaaaaagaagggggagatattttaaattaaaagacattaaagaggcaaaacagttaaacgcaatctgtaatctgattgctggagcaccccctcaaaaaaaagtgacaaaactttattggggcaatggcagcaatttaaatagaaactccatattagtcattattaccatatcaaagttaagtttcttggatatgctaatgacactgcagttatataggaaaacaacctacacagaagaatattaggagatagattaggaacagatgccaaagtatatagaagcattacgagacaccctcaccttacttcaaaccattcacaggctgggctcggtggttcacaacttgtaatctcagcactttgggtggtagaggctggtggatcacttgaggtcaggagttcgagaccagcccggccaacatggtgaaaccctgtctactaaaaacacaaaaattagccagacatggtggtgcatgcctgtagtcccagttacttgggaggctgaggcaggagaattgcttgaacctgggaagtggaggttgcagtgagcggagatcatgccattgcactccagcctggacatcacagcaagactccatctcaaaagaatttaaaaatattaaataataataattcgctctggggggaaaaggtacataaatacacacacacactcatgcagcaacaaaaaagcaaaacaaatgtggctaaacgttaacaactggtgaatctagtaaatgaagggtgaccagatatgcctgaagaatatactgttaacttttctgtagctttagaaaaacctttaaaataaaaagatgagggaaaaaaaaaagccacagacttagattgggttacagaaaaagagagagagaaaaaaaaaaaggaaaccatattgctatatagatgggaagcatatggcagagtagggtaactaaagtcctagatttcacactggagaaataaaaagggagcctcaggagccaaaatgcaccaggaagatcacagactgggaggagcttagaaaagcaaccccttaaagttgttcatgaagtcctggattctcctttgagaagtgcatacacggagctgaccccaaatagtatacgtagacattgagagctgaactacaggagagaaaaccacccaactcccagtctggtcactggctactgcacctgtgggacagacccaaacagtactggaaagactttgaaaacttcttcaatggtagttggaacctgtggcctcaactcaaccagggcaattgcctgctaaaataaaaaatatcaacatctctgtaggatttaaaccaacagccagagtctcataaaataataatcaaaatgtccaggatacaacgcaaaattttgcagcatatgaacatccggaaaatttcaagttgcataagaaacctgggaaaagacaacaagatgccattgctaagaagcatagttgttggagttatctgacaaagactttaaagcagctataataaaaatgctgggccaggcatttttgggagctgaatcgtgatgattgtttgagcccaggagttcaagatcagtctggacaacatagtgagaacctgtctctacaaaaaataaaaaattagctgggcatagtggcatgcatctgtagtttcagcttctcagcaggctaagaaaggagaatcacttgagcccaggaggttgaggctgcagtgagctgtgactgcaccactacacttcagcctggatgacagagtgagaccctgtttcaaaaatacaaagtaaataaaaataaaaatgctccaagaagtaatggtgaacactcttgaaatatagtctcagcaaagaaacaaaaaatatagagaagaaccaaatgcaacttttgaaactgaaaaacacaataaccaaatttgaaaactcactggatgggatcaatagcagaatggacatgatacaggaaagaggtggtgaactggaagatagttccaataaaaatgaatagagcctcaaggacctatgggataatgggaaaaagtcaaacattcatgccactggagtctcagaagagagaaaaaagagtgtgggccagaaaaaatacgtgaacaaataatggttgaaagttttctaaatttggcaaagaacatacacctacatatttgagaagctcagcaaaccccaaacaagataaacacaaagaagtccaggccacaacacatcatatccaaattgctgaacactaaagacaaagaaaaaaataattgaacacaaccaaagaaaaacaacacattgctttataggggaacaaaaatttcaaagactggatttctcatcaaaaatcagaggccagaaggaagtatagcaccagttttaaagtgctgaaagaaaagagctatcaacacaaaattctataaccagcaaaactatccttcagcaccgaggtgaaataaagatactctagacgaagaagtactaagaaaatatgttgtcaacagatctactctaagagaacagctaaaggaagttcttcagacagaagaaaaacgataccagtaggaaacctgaaacgaaggatgaacagcagaaatggtaaacatttggataaatattctccagctgacttctctgtttggtggatgaaaaccaaactcatactgtctgatcttcaatgcacgtaagtataatacataagacaattatataccatagagcagggtaggcaaatgggcctatagggtgtaaggttgatacactccatgtgaaaagattagatactgattctaagtagactgtaaatttttaagtatgtatattgtcatccctagttaccactaaaacaatctatacaaaaagctacagtaaataacaaaatagaaaaataaaaaagcggtactaagaagttcatatatatgatacaatttatatgacattatcccaaagacaaaagtttagtgacagaggacaggtcagtcagtggttgtcaggagttaggaatgggtgagagtatggtcggtttacaaaagaaacacaaggaagtttctggagcaatggaatggttctgggtcccatttgtgtagtggctaaacaaacctacacatgtgtaaaaattcacagaacaacaaacacagtcaattttgttttgtgttaatttaagaattaaaatttaaaaatatacaagagagatacaggtaaaggtagaatctaagagaacacagtatgtaaagaacaagaggaggaaaaacaatagaagcaaagcaagtggcaaaaacaaaaacaaaaacaaaacaaagaaaaaacccacactgttgtcacagagggcagcgccgcaaggaagggagtgtggaatttgccatgtctactggatgggctactgggcagtcagtgtcaaccatgctaagcgcggctttggatgtgggagggatggggagagagagcaaagtgtctgaattgcaggaatgtatacatgtcaaagtgtgggaatgggaaaacagccaagtctggactagtgtattaccaaaagctcatattatttatttatttatttaaattcatttttttttttgagactaagtctcactctattgcccaggctggagtgcagtgacaccatcttggctcactgcaacctctgcctcccgggttcaagtgattctcccgagtagctgggattacaggcgcccgccaccatgcccagctaacttttgacagtttagtagagatggggtttcactatgttggccatactcgtcttgaactcctgacctcaagtgatcagcctgcctcagcctcccaaagtgctgggattacaggcgtgagccaccgcgcctggccgaaaagctcatattatttaaaaccataacaacaactgccaatatttagtaaaaattgccagatgctaagccattgtttctcaatctagaggcacaaacagttataaagtttaaaaaagtttggccaggcacagtggctcatgcctgtaatcccagcactttgggaggccgaggcaggtgaatcacgaggtcaggagtttgagaccagcctggcctggcctggccgacatgatgaaaccccatctctactaaaaatacaaaaaaatagctgggcgtagtggcgggcgccgtaatcccaactactcggcaggctgaggtaggagaatcacttgaacccgggaggcagaggttgcagtgagcagagattgcgccactgcactccagcccaggtgaaagagcaagaccccgtctcaaaaaaaaaaaaagtttaaacaaattcttccacacccctcagtattgatgttactgtatttatttaattaaatataaatgtaagtatatattcattatgtttatagctctttatagtgctaaaacaaatattcatataaaaatgaaaactacaaaacccaaattctatttaaccacaataatttaatgttgaagacaatgcgtgttttgggaatcctaaattgtgcttaaaacatgaatatggcagctggacgcagtggctcatgcctctaatcccagcactttgggaagctgaggcgggcacatcaatcacttgaggtaaggagttccagaccagactggccaccatggtaaaaataaaaaaaatcagccaggcacctgtaatcccatctacttgggagcctgaggcaagagaatcgcttgaacctgggaggcagaggttgcagtgagcccagatcgcaccactgcactccagcctgggagacggagcaagactgtctcaaacaaaacaaaacaaaacaaaaaaatgcacaaatatggtacaggctaaggtataggtcctttgggtttgtcctgctgttctttatgtcaactgtgaaggcatcctttatacggtgcctagtgacaggctttggccttctcttggaagcaaatacttcattacatattaagtataccttcttttctcaacagccaaaaatgactaagatccaagacaattatacccagaagttcaaatgtgggctggaattgtatagccagacacaattagtcctcccagatgacccagaatattcttttaattttaaaatattatcatcagcataaaaacaaaacatgtagaacagctctaatttgaggacacagtgcaaaaagccttacattacttaggcgttaaacaaccctacaatagctgcaataaataaagacctcatcagttttcctagcccctcaatgaaaagtttactttaaaaaaatgtaagccacatcaaaacctttgcttactaaggtaacaacaataagaaaagaaagaaaagaaaagtaacattttccattattttagaagactggaatcctgatgataatgtgctcagctctgaatgaaataatttacagattatcaacatgtgtttcttagcaacctgtgtgcataaaaaggtacaatatattgtatgattccaattatatgacattctggaaaggcaaaactatagaaagggtaaaataatcagtggttgccaggagtttgggagaaaggggggagtgataaataggaggaagcataggaatttgggggggcggggtggcagtaaaaatactctatatgggccgggcgcagtggctcacgcctgtaatcccgcactttgggaggctgaggtgggcgggtcatctgaggtcagctgaggtgggcgggtcatctgaggtcaggagttcaagaccagcctggccaacatggtgagaccccgtctctattaaaaatacaaaattagccgggcatggtggcgagtgcctgtaatcccagctactcgggaggctgaggcaggagattcgcttgaacccaggaggcggaggttgcagtgagtcgagatcgagccattgcactccatccagcctgggcaacaagagtgaaacaccatctgaaaaaaaaaaaaaacaactctatatgatactgtaaagatagacaggtgacattatgcatgtatcaaaatccgaactgtacagcacaaggagtgaaccttaatgaatgtacattaaaaaaacaatcatttagaagactggagattccagcaataaatgcagactgtgataagggcatcaaactgcattacaaatgtatgcaacaacatcactgaatgaggtaggaagagaaggtgctgacctaagtagctttggaaatgagtggcatctataagactaaaagcgaagggacttgcacataagccctgaattctagttggtaaagttgtttcccacaggggtacaggttaacaattctgacaccgctatacatgtacattggcactaaacaattaaggacatgggctgggcgcggtggcccacgcctgtaatcccagcactttgggaggccgaggcaggcagatcacgacgtcaggagttcgagaccagcctggccaacatggtgaaaacccgtctctactaaaaatacaaaaattagctgggcgtggtggcgggtgcctgtaatctcagctactcaggaggctgaggcaggagaattgcttgaacccgggagggagaggttgcagtaagccgagatcgtgccactgcactccagcctgggtgacaagagcaagactccgtgttgaaaaataacaacaacaacaaaaccaattaaggacatgaatagcagatagtgggagccaaactctcactgttggaatgatagtctacagataagcaagaggatgaggctacaacaatccatgtggtgatggatttgagaacaaacccacattgtatgtcagaggagtacagaagccaactggaagagttctcgataaccaaaggtggaagattctgaacaacaaaattgttttgaattataacccaaagtataaaataaatatccatgagtccatattgataaaaatacatgattgaggccgggcacggtagctcacacctgtaattccagcaccttgggaggtcaagaggggtgatcacttgaggtcagttcaagaccagcctggtcaacatggtgaaaccccgtttctactaaaggtacaaaaagtacaaagaaaaaaaattagccaggcttggtggcagttgcctgtaatatcaggtactcaggaagctgaggcaggagaatcgcttgaacccgggaggcagaggttgccgtgagccgagatcacgccattgcactccagcctgggggacagagtgagattctgtctccaaaaaaaaaaaagaaagaaagaacaaacaaaataacatgattgaataatacgtgaaggcgaagagacaaatctccagctagtttatgtaaatactccactgtcaaggaagaaagagtgtaactctctctttcttaggtgtaggctgcatgtagtgactcctttcaaagaacagtgtggaaatggggaaggagtaacttcgaggtggagaagcctaacgaacaccaccttagccaggtgatcgaggtcaacattagttacaaatcacattcacagtatgtgacatatcttgatatgatatgatgaaaatacactttatctgtgatcttccacccaacaactcataaccccagtgttatcataagaaaaacatcaggcaaattctagctgtgtagtatcctacgaaatacctgagcattacccccacaaaactgtcaacatcaaaaacaagggaagtctgagacaccgccacagctcagaggaaactaaggagatggagcaactaaatataatgccgtatcctagaacaggaaaaggacattgggtcaaaattaagaaaatattaataaacttactttaatgataatatatcaatatcggcccattaattgcacaaatatatcatgctaatgtaagacattaactacaggggaaaatggatgtggagtatacaggaaccctctgtactatctattcaatttctctgtaaatctaaaactgttctaaaaaataaagtcatactatctgatttcaagacttcctataaaactacagtcatctggctgggtgcagtgctcacttaaggaacctccagtaatttgggaggccgaggctggtggatcacttagggtcaggagtttgagaccagcctggcctacattgtgaaatcctgtctctactaaaagtacaaatattagttggtcatgctggtgtgcacctgtaatcccagctactcgggaggtggaggcatgagaatcgcttgaacctgggaagtggaggttgcagtgagccaagatggtacccctgcactccagcctgggtgacagagtgagactccagctcaaaaaaaaaaaaaaaaagctacagtaatcaagacagtacagtattcacatacggacagagaaaatgataaatggaacaggaaagggtgcagcaatagattcaggcatgtcgccaactgatttttccactatatatatatccacatgaacctcaggttccaaaaaatctcagcaggcccatttcttccattctcacagcatccctatttacatggaagagtgagaacatactaagggatcataacaattcccgagtggctcctatgagcaaggtactgtttccattcatccttaggctggcatgtgaggcaagtgttactaaaggtgaagctcaacaaggttaagtggtttgcgcaaagtgacagagctgaggagtggcaaagctgggtctgtagtgcaacctgtctgattctggcagctttctcacaacattcagaaagaaatgtcgaagaaagaaaaagtgggcgtcagctcaaacatcccaagcctgccctgtttgtcctgttttgttttgctttgttcgaaagatgagatccggccgggtgcggtggctcacacctgtagtcccagtactttgggaggccgaggcaggcagatcacctgaggtcaagagttcgagaccagcctgactaacatggcaaaaccccatctctactaaaaatacaaaaattagctgggtgtggcggtgcgtgcctgtaatcccagctactcgggaggctgaggcaggagaatcacttgaacccgggaggcagaggttgcagtgagccaagatcacgccattgcactccagtctgggcaacagggagagactctgtctcaaaaaaaaaaaaaaaagaaagaaagaaagaaagatgagatcattcaagtttactccataagtgtcttccaaaatattaagtaaatatttaatgaatagttactaaaatgaacatggtagcttattaggccaaatttatgatccagttgagtgtgcctgtatgttatatatacattttataataacttgggggcttctgcataggcagtggaattatttatttatttaatttgttgttattattttttttttttttgagacggagtctcactctgtcgcccaggctggagtgcagtggcgcgatcttggctaactgcaagctccgcctcccgggttcatgccattctcctgcctcagcctgccgagtagctgagactacaggcgcccgccaccacgctcagctaattttttgtatttttaatagagacgggattcaccgtgttagccaggatggtctcgatctcctgaccttgtgatccgcctgcctcagcctccaaagtgctggggttacaggtgtgagccaccgcaccaggcttatttatttatttttttttttttgagatggagtctcgcgctgtcacgcaggctggagtgcaatggtgcaatctcggctcactgcaacctccacctcccaggttcaagcgattctcctgcctcagcctcccgagtagctggtattacaggcacacaccaccacgcctggctaatttttgtatttttagtagagacagggtttcaccatgttggtcaggctggtctcaaacttccaacttcaggtgatccgcctgccttggcctcccaaagtgctgggattacaggcgtgagccacccgcgcccggccgagtcagtggaattatttaaatgctattaaagtaaaactatgttatttcaattgttataaaaatgtacagtggttacttttgctctgttgtatcttgttggttacaatcatggattatctaacttcaagtcttggatcagaatacaacctccaactgtgagccaaggtcatttgctaacgtttcccccctcacaattatagaaaatgctgtacagtttttatatctctattttatcattccagcttctagagaatctctcatgaaatatctagacccgaactagtagaactctgctctctttgaaaaatagcctacatttcaaatccagatcttaggatatgtcagcctgagaaacttcctttccttctggactcagaaatgctaacaggatcacagccttacattgccatatctgcccctgctattgaatatttagagcaaattctaatttcaaattcttatagttagaacaaagtatttaaatctaaaaataattagagattgagaaagtctagaatgctatttctgggttcttcctcttgtatctcaacaaaacagactagctttttatgaaattcataaacttatgttatttctaagttaggtcttatactctgttttcagtcgatttcatataaatgaatagttttaaaagtagttatgatgatggtaatacaattttgaagcactctaaccattttacaaattgtttattgtctcatctgatactcctgtcaatccggaaaaatatacagggagctgttagaatattttatagatgtcaaaacaggcccacatggattacgtaacttgtccaagttacctcactaataagtgctagggcaggagaagacgggtctctggatttcagtctgaatgctttactcagaagctcatgcctctcctgtctcaaatttcaggtctaactccagactaaatatagtctgcattcttctcattccataggaacatcaccttggtttctccatatttctctttcttataggagatctctgacgaagcccagatagttgggtaagactgagatgctgacagattgagttccatgacatctgtcagttagaaagccaaagttaaccatgtactcttgttttaaaaaaacaagtaacttgaagaggttttctctactttacaagagagcattcctcctttgtggaaaagttatctaccattttccacctagtcttcacacttcagacatatttttttaggtgcgtttcacccttctaaaggggggatgtgaagggaagagctctgtaccagcaatttccagaggcagggatttacaggcaggtctcttagagccacagttggcccatgtatctttgattttctgattatatgtacgttttcaatagcccttgtattttgtttatttatttatttatttatttattattatttgtttttagacagcgttttgctcttgttccccaggctggagtgcaatggcacgatctcggctcactgcaacctccgcctcctgagttcaagcgattctcctgcctcagcctcctgagtagctggaattacaggcatgcaccaccatgtctggcaaattttttgtatttttagtagagacggggtttctccatgttggtcaggctgatctcgaactcctgatctcaggtgatctgcccgcctcggcctcccaaagtgctgggattacaggcgtgagtcaccgcacccagcctttttaatatatttttaaatcatttactaatatatctcattttattccaacactgctgcttgcatttctttccaagcatagagaagaaatccaaatacaaagtactacacataatacagtgcaacaaaaatgaggtaggggcgtcccactcattaaacaattgctgacttgaaaatgtcccaattttataaaatgtatcaagagaccgacactttgcattgtattttattcctctatgtcagttaacaattaattacctctcagctccaaattcacccttcaatacctactctgcactaactggctgaactctaagaattcctcctttgcagtgagcatgatgctaaacttaactttcgcagcagagggcgatagagggaaaatgcaagaggaaagggttgctccagaatcctgggtgcttgtgtgtttttcttcttcctgctaatgccaggctgtatcagtgactatggatacggagaatatccaagggtgctccatcccaactgtgagctcatagcagacaacgagcagagcttcacgaattcatagcttcggtctggtgactgcctcgccacagccctcctgacatgaacatcacaaacccatcatatagaggactgacatccaaaagagacaaagggcattgtagggataaggggatttggtggtacagggacactccataagagtctgtccagactggaccaaggagataaaggaatcaggggagggaggagtctccaatcaaaagacgaaactgacaggctacctacaaacaccatatcaatctagagaggaatttcacaattctatcacaggtatgggggactggtggtgaaagtatcgataaagacaactatgcaaagttttaaacagaagcaattactttagagaaaagggcataaagaaataaaatctaattgcagtacacaccatggctcagttgtgaatgacatttacataatcatagaacaataaacactgattcaacactgaaaacactgacatgtgtgtgcgatggcataagtaggaaatgtgtgtgtgtgtagacttacttcaagttagattaacatcttccttaggaggaagtcaacagatgtcgaagactgaaaacatttaagaaatagcagcatattatttagaaatagacattcaactacatttgacccttaaacaacttggaggttatggtgccgacacccagcaaagttgaacatcacttttttttttttattttttcccctgagatggagtctcgctctgtcgcccaggctggagtccagtggcacgatctcggctcactgcaacctctgcctcccgggttcaagcaattctcctgcctcagcctcccgactagctgggagtacaggagtctgcaaccacgcctggctaattctttgtatttttagtagagacggggtttcaccatgttggccaggctggtctcgaactcctgacctcatgatctgcccgcctcggcctcccaaagtgctgggattacgggagtgagccaccacatccggcccacatacaactcttttgactcccccaaaacttaactaaccgtctactgttaactgaaagccttactgataacataaacagtcaattaacatattttgtatatgttatatgtattatacattatattcttacaataaagtaagctagagaaaaggaaatattcagaaaatcataaggaagagaaaatatattaccaatttattaagtggatcataataaaagtcttcatcctcgttatcttcacattgagtaggctgaggaggaggaagaaaaggggttggtcttgctgtctcaggtggcagaggtggaggaagtgaagaaggtagaaggggaggcaggaaagggaggcacacttggtgtaattttatggaaatacactgtaatttgcctgacttctttgctttttcatttctctaaaaatgtttctatatgataccaatccttcttccactgtttgctttagtttcagtgcacattatcacagaagggtccatgtcataaaagaagtcaaaagtagtctttttttttttggatggagtctcgctctgtcaccacgctggagtgcagtggcgtgatctcagctcactgcaacctctgactcccaggttcaagtgattctcctgcctcagcctcccgagtggctgggattacaggcacacaccaccacacccagctaatttttgtattttcagcagagatggggtttcaccatgttggccaggatggtttcgatctcctgacctcgtgatctgcctgccttggcctcccaaagtgctgggattacaggcgtgagccactgcgcctggcctgtcaaaagccatcttgaatccctggaacccttctgccagatcgtttagccagtttgttttctggcactgctgcttttatgtcttcttcctcgttgtctggcactggtttggaagcagacatctccatcaggtcaacttatgttaattcctctggtgtggtgtctgttagctcttgattttctccaagatccctatcttgaaacccttcaacctccacccacatccccaatttttttttttggcctctccacagtctctctcatgatttttttgtttggctctgttgtaaatcttgtgaagtcatgtactacatctggacacagttttctccagcaggaaattattgttttgggcttgatggcttccatagctttttctgtcataacaatagcatcttcaatggtgtcattattctagactttcaagatgttctatcggggttctcttccatagcattggcaatcctttctgtagagtaccacgtgtaatgagacttaaaggtccttgtgaccccctgatctagagtctgaattagagaccttgggtttggaagcaagtagaacacattgatgccttcagtgttgaacctttggggttctgaatggccatgggcattgtccagtatcaaaagaactttaaaaggcagtcccctactggtaaggtactccctgacttcagggacaaagcatcaatgaaatcgatctggaaaaggggctcttgttttctaggccttcttgtacaacgaaaagatgagcaactttttgcttcaaggcttggaggttagcagctttagatataagggcagtcctgatcataagcccaaatgcatttgcacaaaactgtagagttagcttaacccttcctgccttaaattctgatgcttgattcttttccttactagtaaatgtcatgtttggcttttccccccaccagaattggtcactcacttgcaatgaaaatctgtcaggcagatatactttctccttgataattttcttaatgacatcttggaacttgtctgctgcctcttggttgatggaagttgcttcacctactatcttgacatgattcaaacaaaacctctttctgaaattatcaaaccatccgttactggcattaaattctccagctttagatcagatccttcactttccttttgctttaagttgtcatagaatgacactgctttttctcagatcacattagcgtgtatagatatgcctttcttatagcaatcctgcactacagaatagctgcattttcaatatgagattaaaaggtataagtgcaaggattttgcacctgctggcatagctgcagtgacggcttcatgtatttccttttcttataattatccttatgatggatttatttatcttgaaattgtgggcaattgtagctgcagaccttagtctgcagtacatggcaagcaattcaacttttccttgtaatgtcataactttacttcttgggagcatttccagggtgaatcactagtatcacattgtatgggtcccatggtgttgttcagtgtttatattattgcactaaacacaaaaaataagagagaagttcaaggggccactttttttgtactgtggtatacaatttactggagcgataactgctcaggcagagatgattaacatcatagagcagcattttaagtggatactcacagcatctgagcttgcctcaatagcaacaggaggtgactatgaaattactacattatcacagtatgctctacagttcattttgtgcagcatgatttaatactgcatctttccatttgtttacatttctgtccactgtgaaggatgccatacatgatctgtgtttgtgtgcatctgttttgataaattttaactttgcaagtagatctgtgtatattttatagtagcaaatgataaaatagatgagcatctgcatatatttttagcatttttacgtagctaactttttcttaaaaattttcagtgtttctagactatacaattcatctgagagttttttcaaattgtcacaaatctccaaaaaatttttccaatatgtttattgaaaaagatccatgtataagtggagctgcatagctcccgggtcaagtgtatattggactatagacactttaccataaaccactaaaagaatcataagcactggttctgaggggtaagacttggaggcaaggagggctgatgaagagagctgcttctcctaagctgcctaattctgattgttcatactattcagaggtattattctgataaaagtgaaaattaaattttaaaaaattaagtccaaagaagaatgttaactgaataataaacaggtcaatatgaaagaaatcacgaaggcctcagaagcactgcttcggcaatgaagaagcactggaaagtttttgcaagcaaatgccatgatcagaactatatttttaatatatgtgacttttaaaatagagacggggtcttgctatgttgcccaagctggtgtcgaactcctaatctcaagtgatcccccctgccttggcctcccaaagtgctgggattaaaggcatgagccaccccacctggccccagcaccgtattttacaaagaataggagggagatagaaaaaacaaaccatagacaaaaagaaggagagcttgaattaaaaacaacaacaaaaaccacaaccaaacaatagaaatgtgttgacaaaaggagtcaaactctgtaaaatatttgaagggatttattctgagccaaatatgagtgaccatggccgtgtcacagccctcaggagatcctgggaacatgtgcccaaggtggttggggtgcagcttggttttatacattttagagaggcataaaacatcaatcaaacacatttaagaaatacattggtttggtccagaaaggcgggacaactcaaagcagggggtggggttggagggggcgggacagcttccaggctatgggtgaatttaaactttttctggttgacaattggttgagtttgtctaaagacctgggattgatagacagcaaatattcaggttaagataaagactgtggagaccaaagttcttctgaagtcttacagtagctgcccttagagacaagagatgacaaatgtttcctattcagatcttagttaatctctttaggattgggagggtctggaaaaagaaggtctagctatgttaatggagatttttacagatgcaaatgttccccccacaaggaacagctttgcagggccatttcaaaatatggcaaagaaacatgttttggggtaaaatattttgattttcttccttgtcttgtaatgttacgccagaggcaggttggaaagttaagtcacgatatatataaaaataaaacccgtctgatgagaatttatgatttatggggcatgactccccagaccccttatataggaatttgggcaagataaaaaaatcagagtttagttctcaaatgtctggcgaacaccatactgaatggaggaaacagcgctttggactccatttgtggcgggaagatcagaagggtgtaagcgttggtcactataaggatgtctcaatctttatccatctagtaattctccaactataaattagttatccccaggaaagggatagccagtgagggagtcatgaacatcatagtctttcttgtagaataccatctcatatatggataaaaaccaccctgggttatgaatcagtctttcaagagctttcacctagtgtggatttttagccatgtctcaatcagaccacccttgagtaaactgaccatcaaagttctggacctaagagctgagaagccaaaccttggaagtaatgatgcttggataaaaaccacaaagccatgcttactcatacatcctttcactcaccagggctctggcctacgtgtttagtaacatagactaaggaatgacaggttaacttttttctttataacacagctacaaaaagatggaacagagaaaatggggtagacaatgtatctggatttcaggaagacatgtaacaaaaacggaagccattacacctgtgattaatgaatcagaaacatcctcttccagaaaagtctacgtgagggtcctaagtctacgtgagggtcctatgcaggtccaggagaactggggattctgagaaattaggacagacgtgcactaggaacagaagaaagaatcgtacctactggaatgcactcaggccaagccacaaactggaaatcagagttaagcccaggttctccctaccccccctactgctcagaacctctctattccaagtatggtactcagccagcagcagccactgcccaaccccctgcccccgcccccaccagagctggttagacatgcagaatctcaggctccacacctcaaatctaacaaatcaaatcttcattttaacaagatatcacctatgcccattaagtttgggaagcaccaacttaggagagaaaggagtctttccggtttctgccttcccccgtggtgcctgcaggcgtagaaactaggcaaacacctggtgtttaaagctgtctagatagtaacagaatcatttgtatactatgaaagtgctaaggagaatctggcaactatgtatcttctggaaaaggcactgattccaggacactcaattatgtcttaggagcttgattttggagttaaatgagaagaatacagcatgaatcacggatttccctttatagccgcctattttatttaaacaaaaaatgctaaacattaattttagttgtacttaattgaataatttctcaggggaatcgttcagggagagtttaaaactgcctgtttccaaaagccattacaaattggcatatactattatgtcactgtgccaaccaaaacagcacactttaatgtccctgaggccgccttcgctccagatgtgttcagaactcctagtaatgtaatgcaggcaaaaaccatatttacatgaagtcgtgttttgaatatccttttccaattatctggaatgagataatagatccctaattggaagcactggggggaaaaaaagccaggtcagtggttcctcccttgtgaatgcttttattagtgaaaactaaaacagtctgtacaaaagtaagagaaatctcctttgccacagttaatcatcggaacatctataaacttagaaactgccctatggtcacctctaattagccagctgatttttaaaagattgatcttgtcttttcctatgaatcgtaagtacgaaaggattgggggtgggggagggagaaatggaatgcaagggcaagaaatccaaaaactgctttggcaagagaacagacaaatgcgatggctgtacagctgttgctccctccaccttcatcccacccaaatatcttccactctgtttcatgcttgcatgaatggcatggattctgaatttctcttttattcctgactaatgatggtcataacatcactaccagataagtcatcattgcttatgattgagttaatttctatttcaaattatatctgctgataaagaatcatctgtttattctcaaagcatgtataagtaaaaattaaatagcaaattttacactttttgctaaaattgtacgtttccttccttaacattcattatctaatagagcttaaatttaagtcaaataagtgtttttgtacaaatcggcatttctcttccattacagtggagactggctcccacacgtcataaaacgcggtaacgtgccatgcaatcaggcacgctcagttactggagttgtctatcttcacagatgtcacagagaagccatctgaaaagctacgcatagtgcagctgttcttggctgttagcaagataaacttggaaaccttgatctttcaaatgttcaaaatcggaatgggttttccaaatataaattaattaccaaattccatgtgttgacaagcaaacactctaatgtttacgtttcaacttgacaaaagaaatgtaagcatattatccataaacttctaaaagaaacaaactccatgtattaacttcattacatttttttcctaaaatgtttaaaaacattatcatgaaatgtaacatacgaagagaaaagcaaaacttatgtgtacagtttaacaaatgattacaaagcaaaaccacgtagtctcaaaaaatctcaactcatttactcaatgggcaatcaacaaacatttacaatacaccaggcactgtgttaggtgctaatttgaacacttaggaagtattacttgttagcattatttgctcaaataacaaccactgcaaagtccataattcttacctacctgtgtttcaaggcaaacaaatatatactttatcatgtggacaaggagcattttcctccaataaatctaccctagaggtttgtactcttgggatacttaacaatatatcacttctgaaaggaccacaagaaagtgcttggtggtcagtaacacccagatgtgaacttttctctctgacctatactagcagtgaatgatgttctcaatgtctctctgattaacccttgaattcaggcctcttcctccagaacaaaggcttccccacttgggagctgcttagaactttcccaagcaccttgcaaagtgtcttatttttcatactgtgcttagatctgaaaaaagcctttgttgtagcatgaagactctaaaatccctggctataaaacgaatgttctcaacaccaggaaaaacacagtccatagctttgctttaagagaaattgttttgcctaattaatcacaaagttttcaagtaaacttggtttgtaaaattctcaaaagcagttcagctgtttccaaattgcacatcggaaaattcctatgttacatagtccgggataatcaatgttaaaacaatatacataacaggatcgtttcctcactaggttccatttctgtcaggaagggagggagaattttaagccaaaatcgtaattcaagccaataatctgcaaacttgggtgtacaagatgattcactggaatgtggaaagaaaatactaaaatttccattaatatgctgcatttacttcttaatctctcagcctttttagaagcaacctaatatatagaacagtagtatatataatttttcagatacaattataaaaatattcgagagggttgctcataattcctactaatgggatgcatgatctaaaaatgttggaagtcactgtactaaaagtggtatagacaagctataaaagaatacaagtacatggaactcaaaagtctcaaaagttaaatatctttgtcattattcaattaaatattaaagtcctagtagtaaaaagtgagtattcagtcaacttgagttgacggaggattaaaaaatacacaaatacatagtccaaggaacacagtggtaagatgttaatattagggaaactagggtgagggaaataagaaagctctttgcattatttttgcaacttttctataaatctaaaattggttcaaaatcaacacttaaagtgacttgtaactaatcacagcagcaatttttttttttttttgagacggagttttgctcttgttgcccaggctggagtgcaatggcacaatctcagctcactgcaacctctgtctcccaggttcaggtgattctcctgcctcagcctcccgagtagctgggattacaggcatgcaccaccacacccagctaattttgtatttttagtagagacaggttttctccatgttggtcaggctggtctcaaactcccgacctcaggtgatccgcccatctcggcctcccaaagtgcagggattacacgcgtgagccaccacacccggcctcacaggagcaaattttgaaaattattttaaataaagcagagtggaagttaccctaaaatggaagttactcatgtgcattcccccacacccaggctctccatcctatgccatagatcaccataactgatgtgccctcgacattatctcagagccctcattcccttcagcatttaagagtttctgtcaaaatacatatttgttcacagagtgctctctgcatgtaaatataattcgtctttagagttctgatagaagatgataaaaataggttgagaactgctgaactatagattgaggggtgtagaggaagtagagaaaggacgtaatcaaagaaaaaaatcatgagaatttccgaacatgattagatgtttgctttaggaagaaaagttgcaataggacaaagggtgcctatttaatagtaactggacactatgtgttaggcattgggctaagtcctagatgtataagaatgactgactgatggagatacaaccctgaccctcaagaagcttactagagaaaaaaataccagaaaggaggctgtgcaatagcactgagatgtaacagggagctgaactaggccagtggtggaagaccggccaggagcaacaccagggagcagaactcacccaatctgttatgagtaggaaattctttgctcacaggcagactgaccagggctaagtgggtcttttcactggagacagagagaatggcagttcaacacccctactctgttattgcacatcaactggcaagcactgcccaaaggtaaaatgtggacagagaggccaacaacctaggctggtagctgggggacatggagctgtgattcttgggaattcttaggaacacagctgtgaacgtaaaggagacctgtttctcaagacttgtaggttatttacatttgtgcacccagaaaagggcttcctgagcatcagattgtaattgcacagataggagctaagggttttcaatggtagcctttatctctccattgtttttccccctagtcatatctacctcagatctaaagaaacaagcttcaatccttgagaaactactgccaagcttccagtgtttccactaccccaacactatgtatatccacagaataaataggtgaatacaaagaagccagagaacaagggcttctgagtgaaagtggggccaagtgtaactgtgagaagctgactgccaacacagatggagggctgtgctcgtgtatacctcaacggaaaaaaacttgcagggacagccacaaatatatgtacgtatgtaagtatgtatgcatctatcgatccatccatcgatccatccatccatccgtccatctaaccgtccatccacccatccgcccacccacctatccactcaaccatccacctatctatccaacaaatcatccatccacccacctacccatctgtccatccatccatccatccatccaaccatctatctgcccgtccgtctgtccatccatccatccacccatctgtccatccatccatccatccatccatccatccatccatccatccatccaaccatccatccatccatccatccatccatgaaagcaaatgccagcatccaagaggtggcgaaaatccagcacagactcctgagtgaaggtaagtggtagctacagaatttccctaagaaaggcacagagcatcagtcaaattggagggaaagggctggaacactgcttctcaaactctctgtggtgcagaactttttttttttcattttcaatgtgtcacagacaaaagcttttgcaaaatacaacaaaaatgatttactaggaaaattaaatttttaagcccattaacagtataactggatgtcatggcaacaccaaatgttataaaagtctgaattcttattctcaatgtcatacttacctcattgcaaactggtaacaaacagctcaaggacaggcacttgtctcataaccatgctttgggctaggggacttgtgtgaagtcgagttgacagagtaaactgtctgaggtactcagtgagaactaaagctgacacccaggtgtcacagggtgagaccgctctacccagggtcaaccacaagaaccagtcaggcacaaatctgtttgtgtctgttttgggtcttctttctcacccagtcacaaaacacagcttttgatacttgctttgtttggaaactgatacctgagttctgcttttttttttttttttttttttttgagttggagtttctctcttgtcatccaggccggagtgcagtggcaccatcttggctcactgcaacctctacctcctgggttcaagcgattctcctgcctcagcctcccgagtagctgggattacaggcacccgccaccatgcccagctaatttttgtatttttagtagagatggggtttcaccatgttggccaggctggtcttgaactcctgacctcaggtggcccacccgcctcggcctcccaaagtgctgggattataggtgtgagccaccacgcccggtctgcctgagttctgcattccaccccatcccacagcctgaggaaggacaataggcctcaacacacagttgtaacaaggttggtggacaacagcctctttttctagcatcttcaaacctcttttcctttctccaggcacctttccttctgcctttaaacacatcagcctggggtcctctccttgtgtcataaactaattataaaatgaaacctcaagatccttcacttgatgttgacgccctccctagttttctcctgtgttagtttgcacctttctttcattaacaagttcctggtatctgtagcctcaaataaggtcctagaacctggcttctactctacatactctagtgaacccatcaatgaccctgggacatgactgttacaaaagcaatggcttttcggcgggtgcggtggctcactcctgtaatcccagcactttgggaggccgaggcgggaggatcacaaggtcaggagattgagcatcctggttaacacagtgaaaccccatctctactaaaaatacaaaaaattagccgggcgtggtggcaggcgcctgtagtcccagctactcaggaggctgaggcaagagaatggcgtgaacccggtaggtggagcttgcagtgagccaagattgcgccactgcactccagcctgactgacagggcaagactccgtctcaacaacaacaacaaaaagcaatggcttttcttctgtatcatcttatccagcttcttcatggcttttgaaataggctgttcacccagcctttgaaactctcatctacaaatcccaaaataacatactaacccatttccagcttctatgctggcatcccttcttcttttggagttttctcacgtctttgccctggctgctcttgcttgtaacagtaatgagttctcctggatttatttacaactttataatgaaccccacttgggccactccaggcagtcatttcccttgagttctcattccctatctccaagtgtctccagagctgtgctgacgtgaaggtttcctgttaccttacacctgcttctcagccctggttgcacattaaaagcatgtgggttattttaagtcataccttacctaggcttcattctcagagatcccaacttaattggactagggtgaaactgccttgcaaagatgatgacatcgagagaaatgtagcatggctgactccatcctgcttctagcctctcaggctggctgtcctttgctcagtcctggacacaggccaaattaactatgggaggaatttagtttgtagtttaatttttttttttttaagatggagtctcgctctgttgcccaggctggagtacagtagcacgatctcagttcactgaaacgtccacctcccaggttcaagcaattctctgcctcggcctcccgagtagctgggattacaggcacatgccaccacgcccggctaatttttgtatttttagtagagacgggatttcgccatcttggccaggctggccttgaactcctgacctcgtgatctgcccaccttggcctcccaaagtgctgggattacagatgtgagccaccacgcccggcctgcagtttaatttttaagccaggataatagttattccctaaaacaaaccccctccttgctcagggactgaaaccacctttgaaaaaaaactaatgaaatcccatgagattaggattatgcaaggggcttgaattctgctaaaatgtacacagttagaggataaccagccagtgttttggaggtcacaagatttctaactaccccaattgttcctatagataacatcattattgtagaagtcaagattgatcttttgagatgttttttcagatttttccattctggcaaccaactgccttgacccagacctgtgactcatgactcagcgggtcctgtggccccctacccagaggctgactcagtgcacacagactgttttccacacccctatgggttcctctccagccaatcagcagcacccattacttaggcccctgcccaccaaactatccttgaaaaaccaagctttctgggaagctgatttgagtaatcaacttctgtccttctgcttggttagctctgcattaaactctttctctactgcaataacgctgtctcagtgaattggttttgtctgtgtagtgggcaaaaagaacacgttagatgattacagagttagggccaaagctttagtatatttttttcctttaatgctaagcctataaaaccattgccaaggaacgatttttctcaaagttagatgcaccctggaatcacctagaggagctttaaaattacagatgcccgtttcctactcccagaaattctgatttagttagttggggtataataaaaaatctatttgtctttgtccccagttcctggcacaaagctcctaaaactcttgtgatttccttactaataggagtgtcttttgttattcataaaaaaccccttgttaagcccctagcataaacatatctgagtttatgctaatgaggtgaccctcagtggggccctagatagcttcaggatggggactggtctccagaaggaaccaaccatgtgattacagagttggaactcttagcccccaaacccaacctctgaggtggtgagacaaactggagactgatgtcaatcacaaatggccaacgatgtaatcaatcatgcctatgtaatggaacctccacgaacacccctaaatgatgggactcagagagcttctgagtaggcaaatgcatccctgtgccagaagggggttgcatgctcactccacggggacaggagctcctgtgctggggacacttctggaccttgccctaagtgcctcttcatcaggctgttccttgcatccctggtaacaaaatagtacagcattttcctgagctcagtgagttgttctagcaaatcatcaaacttggtagaagattgtgggaacctccagtttgtagccacgttggacagaagtgtgggtaaactggagacccagtgcttgcagctggtatctgaagtaagggcagccttgtgagacggagcccttcaaactgtggagtctgatgctaattagagccagaattgaaccagactgtagcacagccaagtggtggcaaggaatcagagacgtggtattggaaaagtccccatatatttgttgtcaggagggaaaaacctctgattggtatagggtgcagcccagacatcaggcatcaggattttaaaactctcaaggtgattctaataggcagtgaaagtcgaaaactaacagtaagtgtgggatacatccccattaggagatggttctaacaacatgccagcagagacaatctaagaggatttattcaagaaattaaaggcaaaggactttctcctcagagaatgcccttttaccatgttctttccgtttttctaaaaaaaaaaaaaaacaaaaaaaaaaacaaggctgggtgcagtggctcacgcctgtaatcccagcactttaggaggctgaggcaggcggatcatgagatcaggagatcgagaccatcctggctaacacgtgaaaccccgtctctactaaaaatacaaaaaattagccgggcgtggtggcgggcgcctgtagtctcagctacttgggaggctgaggcaggagaatggcatgaacgtgggaggtggagcttgcagtgagctgagatcacgccactgcactctagcctgggcgacagagcaagactccgtctcaaaaaaaaaaaaaggggggggggaagggggagggagaggaacatttgagaatgaatgctttcattttttgcccacacccccccctctttttttttcttttttttttttttttaaagagatgggctctctccctgtcacccaggctggagtgcagtggcaccatcacagttcactacagcctcaacctcctgggctcaagcaatcctcccacttcagcctccttagtagctgggactacagacctgtgccatcatccctaatttttttcaaaaattgttttgtagaaataggggtctcactatgttgttcaggctggtccagaactcttggccccgagtgagcctcctgcctcagcctcccaaagtcctgggagtagaggtgtgtatcaccatgcccagttcgttattttatttaaaaaatttttcttagacacagggtctcactatgttgagatcgcccaaggtgatctcaaactcctggcctcaagtgatcctcccacctcagcctcccaagtaagctgggactgtataggcataagccaccattaattgctttgatttagaattaatggtttttaatttaccttataagaggccaattaaaatcaatcacctttttaacaaggtgtgttttggggagtggactacagatcccagaaaatacatggaaccagttggatcattcacaagagaagggtggaagttgaatttcaacagcaaaaaggacaacaaatgggaggtagatattaagtatcgagaatgctctatctgggaattccaacagcttcttacattgcatggtgaaaacctttctgttagcagagttggtcactgggtccatgaacggtcacggcctcaggatgaggccccaaacttaacctccactgagaagactgtgtttcctgagcccatagagctctattttgctcttatggacctgaattttacttaaaacaaacaaaacaggtggtgagaagagtgagcagaaatacatatccagtctaactgcagaatcccataagattcacggaaacttcagaggaaataggaaattatctgtgtagaaaccttttcttttggcataggctaacttttcagtaattgtgtaaaagttaccctcattgttcatttgactaaactactgtggtttattgtgcagtggcgttaaactatcaagaatcaatctgctgaacccacttaaacccattctgtaatattagtgttgggctgtttagatgaattagtcacacatctcacagtctctcttacaacattcttggtgaaaaattagaaaagcatgagctcaatgtgtattcttagatgggtaaccccatggcacagggaccgcactcaggaaatattcgttgactgaaggagtcctgagaactcatcaatcatattcaacatcggccgccagggactcagaaatccttgcccacagcagcggccctgaacctctgcagttctcttaagcccgtggctccacagccacctccctttttctcagcaggtgttctcatcaattatttcctaaagggcacgactccgccaagttagctctcttccttcgaccagtaaccttacctataggtgcctatcagttccattctaaatgtcccctctccttctccagggaggaccctcgcctatctgctgccaccgtggcccgcccacagcactttcccgcatcttcaccttctcggttctggcctgtttctcagtccatagacatgctccaacccctcccttctattaaaccagccttcatgctcatgcttactaagcttccttcttcctttcaacaccaaccttcttgagaggttaagtctacaattctgcccccacaacttgaatcctcatacactcacaacccactacaactgagcttgaggcgcgattattacggggacagtgttcctgccgaggtcatcagtgacttactggaaaattccaatggcttattttcagtcttccgtctattgatgagagtttgcactctcgttttatccaaccagaagagagtctctcaacttagaattgtggacggtcattttcataggcaacatttacgtgcatgtgcctttaagtacattagggggtggaaatggagatgagtcccattgttccaccagtttctcagcgggctctctgacctcccttgaaatgaagaaacgcaactggactattgcaataacctccaaattcgtttccccaacttgagtccttggatctcaatcctatacctatccctaatctaacctttgcattactatagaattttttttggctgggcactgtggctcacacctgtaatcccagcactttgggaggccgaggcgggcggatcacctgaggtcgggtgtttgagaccagcctgaccaacatggagaaactccgtctctactaaatatacgaaattagccgggcatggtggcgcatgcctgtaatcccagctactcgggaggctgaggcaggagaatcgcttgaacccgcgaggcagaggttgcagtgaggcgggatggagccactgcactccagcctgggcaataagagcaaaactccatctcaaaaaaaaaaaaaaaaaaaatttttttttttttttttgcagattatataggccagagcaggcatgccttctcttgctgtaaataaggtttataatacaatgtagcagaatacagccatgcttatgcctttacatggtgaccctggctgctttatcctttcccctgctcctgggagtgaactaggtgttcttttattgaggtgaaattcagataacataaaattggccaatttaaactgaacaagtcagtggcatttagtacatctgcaacactgaacaatcaccacccctatctagtttcaaactcttctttcctcactccaaaaggaaacccataccacttaagcagctgctccccatggccgcatgacatggtttggctctgtgtcctcacccaaatctcatgtcgaattgtaatccccacatgttgaaggaggggcctgttgggaggtgactgaatcatgggggtgaacttcccccatgctgttccaatcgagttctcacaagatctggtggtctgaaagcggagcacctccccctttgttctctcttcctcctgctccggccatgtaggacgtgccagctttccctttgtcttctgccacgattctaagcttcctgaggcctcgccgagccatgcttcctgtagagcctgtggaaccatgacccaatcaaaccccttttctttataatttacccagtctcgggtagtagttttttttttttttttgagacagagtttcactcttgttgcccaggctggagtgcaatggcgcgatcttggctcactgcaacctctgcctcctgggttcaagcaattctcctgcctcagcctccccagtaactgggattacaggcgtgtgccaccacacctgactaatttttgtatttttttagtagagacagggtttcactgttttggccaggctggtcttgaacttctgacctcaggtgatttgcccacctcggcctcccaaagtgctgggattacaggtgtgagccaccatgcctggccaaggccgtctcaggtagttctttacagcatgtgagaacggactaatacacccctctccctagttcctggcatcaccaatctgaattacggctccatggattcgtctgttctagatatttcataaaaatggaatcatacaatatgtggccttttgtgtccggcttctttcacttggcaggatgttttcaaggttcatccgtgttgttccatgtgtcagtattcattcctatttatggctgaataacattccattgtatggatatgccacattctgtttctgcagcaatggctgcttttgcactgtaactgcaatggtgaatagctgcaacacagatcacacggcctggcccacaaagcttactatctggccctttggtgacaaggttcgctgacccctagtttataccatctaccttcagaagtggcgattttccaaatcagcttgtattaatgatcactgaagcgctgtttagggaagaaaaatgctggacataaatgtctgtcattagaggactggttaaattacagcaaacacatactacgtaataccatgcagctcctcagaagaatcaggtaaatctgtacgtggtgataaagaagcatctctgggattaattaggctaaaaaagcaaaagcatgcaatgcatgtagtatatattcctttccccttaaaaaataacccataaataagtgcatatatacatatctgggtaacactttccccagaatcaaaagaaacgttcacttttcattttgtacctttctgcactatctgtaattcctaaccttaaatatgcatttccttattagcactgtcaataagtgttagctaaatgaggaaactatggtctgttttcttcttaataagtctgtttttagaagtaataatgaggaagcaatctaataaacgttattttttgttgtcgttgttttttgagacggagtctctctctctgtcacccaggctggaatgcagtggcacgatctcagctcactgcaacctctgcctcccgggttcaagcaatcctcctgcctcagcctcctgagtaactgggattacaggcatgcgccaccatgcccagctaatttttgtatttttagtagagatggcgtttcaccatgttgttaaggctggtctcaacctcctgaccttgtcatccgcccgcttcagcctcccaaagtgctgggattacaggtgagaaccaccgtgcccggccaaatgttatgtttttaaggaagaaaattcaaagcaaaatgctatgttgaaaactgacatgagttatgtctttttatgagctttcaattactttattttcttacccttgcaggtcagtgatcctccaaagataaaagaaaaacactgtgccacaggttagaattttttctgccagaaagctagacactgcaccagaccatctttaaagacgccgtccatatcagtcacgggctgagttgcaatcctagttttccgctgattattactgagaagcataccacatctgtcagccacaggacactgcaaatcttctactgccacagagttcagtatggcagtgacttaggcttcggcacacaagtcagccatgacaggttggtttgtagggtttatctacgcattctgatggtccctacacattttccagatgtgttgacctcataaaactgccacctaccccaggctgtgaaagaactgctccaaccatatttttcccacccctcaactctagcaacaccttgggttccctggctgggcgaccccctaagatatgaagctgggttggctgtcagtcctgagccctgacaagagaataacagcagggtggccgggcagccaggcatttttgcatccgcccagtgctgggaactgacgcattcctcgttccctggggcctaaggttctgcttggttttgggtccctgcaagattggggccctgcctactttctcaaccagtttatccttcaaccctctccctcaggccccaaaagttgctgctgaaggtccctgtcaacaggcaaacagtcaacccactacagacactcactcaccctgcctccaggccctctctctgcctggggcctcgtgttacacctgcctaaagtgcagcgcctggccttcctccccctgcctctggttaggatctccattctccctcgatcccctcttcttccactgtgacactctggtttccagatccttattcctcttccctccaggtcatgccctggcccattcttgatcaacttcgagttacagaatcagctctctcatacaagcattctgaacaggtcactggggtatggtagatacttgtagtatattttcttcaaaaagttacaaacagatttaactgaggaatcaatccaaaatcgagaatatcatctttcttggtgctgcctaggtacaaagcactttgtatatcttccgaggatgcaaagatatgacagtccccttcccttaaggagtttgaaatttagtagagaaaaaacaaattcagaaataactataaatcatccaaagcaaagaataccatgtaacacaagagaggttaaaagtgccagagtgtagaggatgaagagatcatctccaattggggaaactcaggaaaagattcatgaatgaggcagcacctgtggctgatactgatgaatgaccaggatttttatggggtaggacagaggccacagtttctgactaagaaaaagtatatttttcaaatcttctatattaaataatgagcaaatctggcctcttgtcaatatgttctttctaatcagctggctttttgtctgaaacactacattatatcacccaacactgtacagagaaagaatgccttctaggtagtcatcgttcaacaaaatctcagtaacgtcacaaaaatctcaatacttcagatttacaaaaatctcaataacttatcacacatgctcctgtccaggttcattcattttaatcatataatacatgatgatttatttgtatttataaattatgtatactgttaatatctgaatggtaaatgacatgattcttttgattgtcattaaaataaagaggtacacctgaagcaaggtgggggcactccacttaataattgcacttaatgataatcgctaccagctattgagctactgagcacgacacggactttaaatattatcactcaaaaggttttcatggtgaaaagcaaaccatgtaaaaaatgttcattacaatccatcatgatcaaaatttcaatgtgttaagatgttatcttcagtaatagttgcaaaataattgcggtacagcatttagttctttcttccagttaagtgacaggcaaactgtacagcttcacaggttctactaagcacggacgacaatctgaaatagtccactaatgtccctccaagctcagatccctagcacatattggagttagggacttcagcccaggccagagaaaagctcagtacacacatctaaaggcttggacgtctacagatgagccagtctcaatctctctcttgcacgcacgtatgcacgcgcacacacacacagctgaaacatggctccaaagtcccatccttcatcctataataactgtctctctcttctcaagtaggatcagccaaccactaaaaagcaccctgttaattagaacctagacaatctgtctttaatctgatacaatgcctaagtagcccaaaaatgctgaatttcaacgttttgaaggatttattctatgctaataaagaactgggggccaagtgtgggggctcacacctgtaatcttagcacttggggaagctgaggcaggaggactgcttaagtgtaagagctcaagacctgcccaaggccaggcacgatggctcacgcctgtaatcccaacacttcgggaggccaaggtgggtggatcacctgaggtcaggagtttgagaccagcctggccaacatggcgaaaccctgtctctactaaaaatacaaaaattagctgggcgtggtggtcggcacctgtggtcctagctacctgggaggctgaggcaggagaattgcttgaacctaggaggcagaggttgcagtgagccaagatcgtgccactgcactccagcctgggtcacaaagcaaaactccatcttgaaaacaataaataaataaaactaaaaactaaagacctgcctgggcaacacagtgagaccttgtctctagtaaaaatttaaaaaattagccaggcatggtggcacatgcctgtggtcttagctactcaggaggctgaggtgggaggatcgcttgagcctgggaggtagaggctgcagtgaccttatggttgaaccactgcactccagcctgggtgacagtgcgagactgtctcaaaaaataaagtaaaataaagaatgatggtggtaaaatttatcctctgaagattttcagaggttttacactgagcaaacaaaataattcaatataagttatatcttgtaagagacacacctagtattaccagtctatctcttactagatataacttatattacctagtattaccagtgtatctcttactagttaagagatagaaagatagtctgaaattcccattttaccactaattacctttgaatttctgtgatttttataactactttcagcttcccaaagttcacatttcctatttgctcggttggaagtaagagagttgctatctagaggcttctgggtattccccaatttgcaaagagaatgaattccaaaagtgtattcgtggcttagttgttcagaactcaaggatgcccaaatacatgttcccatagaaataacgttgtatatgtggcagacccgttcccaggtggcccatgagatctatcacaccatgtcacaggagtagcagtcttgatccagccacacctgatcactatgcacaacagtctgaacccgagtctgctgtgtgatgccaggaacacgcctccccagtgtggcaggcagtcacctgggcatcctgagacttgtgtgttgaaggagcaggacaaaaatccatgtcggtatttctgctataatgtgatatatacattcctgaaaaatctcacatcctacaaaatcacacttgaaaaataacgggatgaaaaaggctgttggggtagaccactaaatccctctgtaactctgtaaccagagcactaaccaaaagaataattaatacctagggagatgacttggacagcctaggcaagcagcttggctgtggctgcggctgcctcgagggatattaaacacacaaatgacagagtggcaactgttggctcacagacagagtggagttctgagccaggagctatgttaaggtggacacagagggaagatgcctgctgggagcccagagtcctagaaggctagcgggtgcctgtcctggagagaaagcgctgggtgcaggcactcatttttaattttcttaaaatagagttgaaaagcgtgtctgctgcctgtgaggttctttcctttcttgctgaaggctgtaactctactccggcaattcctgctcctctggccaaagaaaaactgcttctggatcaatctaacctccaggatatactgacatcattcctctgcttttcagttgagctgactcgtgctatggacccaagggctgtagcacacagaactgcactcctaggaccagtggctgctgactcctcagagttctcacctggttagagaaggccctttccaagtctcccatttctaaaaactctgaatcagagaacagggggtagtcatcctgtgagaggtaaattctcttgacatccatgacaattcaggcaagtcttttgtattctacttagtcaccagaaatgacttttgttttgttttgttttgttttgagatggagtctcactctgtctccagcctggtgggcagtggcgcgatctcggctcactgcaagctccgcctcccgggttcatgccattctcctgcctcagcctcccgagtagctgggactacaggtacccgccaccacgcccggctaattttttgtatttttagtagagacggggtttcaccgtgttagccaggatggtcttgatctcctgaccttgtgatccacccgccttggcctcccaaagtgctgggattacaggcgtaagccaccccgtccggcaaagaaatgattcttaatctctcttgaggtgtgttcaccctgagtggatcagtctgatttctggacaagccctgtctgatagaaatgtaatgtgaaccatgtctgtaattatgaaaaagtaaaaaggaacaatggcatattttatttaacccaatatagccaaatattaccatttcagtatgtaatcaatatagaaattattggcaagatattttgaatctttttttctggcaccatatcttccaagttcagtgttaccttgtacttacagtacatcttaattcagactagccacattataagagctcaatagctacaagtggcctgtggctactatagtggacaacaccggtctattcagaggctctgttgatagcaaagtgtcatatttctagagacacataattgaaagaaaatgcaaccaatgaggcacaaaacatgtttttcaagttcatagccccatatttcatgaaagggtacctttgacttggtcagtttcagtgcaaacatattaatccttaattacccagaagattcagttaaccagaacatcccaatcccttactatatactcagtggggtttttaaaacagttttattgagacataattcacctgccacaaatttacccatttaaactgtataattacatagtttttggaatgttatactattaattttttaaaattgttttgagatatatatatctaaaatggcaaaatggcacattttgttttatatattatatataaaatatataaatacattatttatatatttttattatatattttatatacatatatttatatataatatataataaatatttatatataacatatatttatatattataaatatataaatatatgtaaataggccaggcacggtggctcacacacctgtaatcccagcactttgggaggcctaggcaggcggatcatgaggtcaggagatcaagaccatcctggctaacacggtgaaaccccatctctactaaaggtacaaaaaattagccgggcgtggtggcgggcacctgtagtcccagctactcgggaggctgaggcaggagaatggcgtgaacccaggaggcggagcttgcagtgagctgagatcgcgtcactgcactccagcctgggcgacagtgcaagactccatctcaaaaaaatatatattatatattttatattatattatatattatatatattatattttatatattatatataacatatatattttatatattatatataacatatatattttatatattatatattatatatattatatataatatataatatatattatatatattatatattatatagaatatattatatataatatattatatattatatataatatatataatatatattatatagaatatattatatataatatatatattatatattatatagaatatattatatataatatatatattatatattatatattatatataatatattctatagaatatatatattctatataatatatatattctatataatatatatattctatataatatatatattttatatataaataaatataaatataaaatatatataatttatatataaaatataaaatatatataatttatatataaataaaatataaattatatataatttatatataaataaaatatatattatatataaaacaatttgccattttaaagtatataattctgtggcattaattacactaacagtgtggtataaccaccaccacttatctatttccaaaactttaaaattatctcaaacagcaactctaaccattatgtaataattccccatttccccctgcccctagcctcggtaacctctaatctactttctttctctgtgaatttgcctatcctagatattccatataagtgaaatcatacaatatttgtctttttgtatctggcttatttcactgaatgtcttccaggttcatatatgtaatcgcatatatcaaaacttcattctttttatggctgaataatagaccattttaagtacatactacaacttgtttacacattcatctgttgacggacagttgggctcagtggttttggcttttttttttttttttttgagacagagtctcgctctgttgcccaggatggagtgcagtggcgtgatcttggctcactgcaacctctgcctcccaggctcaagtgattctcctgcctcaacctcccaagtagctgggactacaggcgaccgccaccatgcctggctaattttttgtatttttagtagagacgggatttcaccatgttagccaggatggtctcaatctcctgacctcgtgatccacccgcctcggcctcccaaagtgctgggattacaggcgtgagccactgcccccggcctttggcttgttttttaataaatcatgagttgctgagcatctcattgggtagcaggggtttttttgttgttgttgttttggtttttttttagtagagatggggtttcaccatgttggccaggatggtctccatctcctgacctcgtgatccacctgccttggtctcccaaagtgctgggattacaggtgtaagccactgcgcccagcctttggcttgttttttaataaaccatgagttgctgagcatctcattgggtagtagcatttttgttgttgttgttttatttttctgtttttttttttagtagagatggggtatcaccatgttggccaggatggtctcgatctcctgacctcgtgatccacctgcctcggcctcccaaagtgctgggattacaggtgtgagccactgcgcctggcctttggctcattttttaataaattatgagttgctgagcatctcattgggtagcagggtttttgttgttgttgttgttgttgttttgttttttttgtttttttgttttttagtagagatggggtttcaccatgttggccaggatggtctcgatctcttgaccttgtgatccacctgcctcggcctctgaaagtgctgggattacaggcgtgagccaccgcggctggccaagggcagcaggtttaaaggaagagagaacacagtcatgacactggtgctgtggctgaattctagaaggtagtcctcttcccaattttactaactgagaaaagtaacaaggtaaggctcacttgtttaagaacagcaggttagcaacaacatagtgccaaacgttctgacattaacatcatggtgttaagaccacgagtgctgtactgtctccaaatacaggtcaaggctatgcttgcagagctttcccagaaacctcccttccttttcctttctgaagtcagagtgttcctaggacaacattttggttcataaaacattttgtaatgctgtgactatctcagcatacaggatacccctctcacttcaatctccttgttttctaataaaatcaaacatttcaaaaatggcattaatgtaatggatgaaagagttacacttcaccatcattttaagttaaaaagaagtatttgaaaaaataaattctgattctaatgctcgttcttgaaagtttgcttcaagcaggaaaacaactgcttttcagattctctttttcacctggcttttttttttaagttcttaagtaaaaataaaaaagttccaattgattttgtaagttttgtgatggtaaaacaagatgtggagcaaacatttcagaataccaaacagagttaattaattccagtataagctcctcacatacggccagagcttgcaagcagatgtgctggctaaatatctcaggtcaatcttagcacattattgaaagtaacctcccattcctcagaaaagtctggcctgcagcttacaaactagagcaaacaacttagacacatggaaaagtagaatttaacatctcccgatttccactctccatttatttccaaaccttccatctaaatcggaagaaaaaaaaaatgccctctagtcacacataggccacactaaagtattagccactaaaataaaagatgaggaagcaattttaaatgcagtcaccacaaatgtgttttgggaactttcaccttgtctctcataaactagaaagtgtacttcatgttccttttggtttcgaatgagcaaggcatttcaactattaacatttcatttccaccacgtgtctgtttcagagctagcagctggcctatttattttgctagctggtgatagaattaaatacagagtctttgaaaacatttacaagctttccctctaaccttctgtgtactttccaaattaggctactttgattgttattagctaaaggtttacgtactggaatactaacactgttaccttcagagtaaattgtttatagctcaggtgcagtttagaacattttcctccatggaatactcttgagattgaggagaagaaagttgaactggttcactctggatcaacaagtttcctttgtgagtcaaacaatattaaggccacacagatatggatgcagtcagggaaaccagttgtgaaaatagttctagtcctctacaaaaccacaggcttcctttgtgagctcccaaatgctttataatctcaaaatcaccatcgtcataatgcactcctaagatttattctttgacactagcgttttgatgtggaagacaaggcatacgcctggaccccaggccagtgtgggttcaaatcacgtctccttcacttatgatgagctagacggtcttaaccaaataacccaagtctttagtttcaaaatcagcaaaacggaaatagtaatttccacttcatagctttgtcgtgagcacttgcattgcacagatgctcaattagtggtttgggatgaaatcaaagatccttcatcactataagcttttctcaatctcttcggcccacaatatcactcatgaaaagcatccattcattctttcattcagtcaaaaactacctattggccctactggagataagaagttcctcctccatagattgtgatgatggtttcatggatgtacacctatctccaaactcatcatgttgtaggcattaaatattaccattttttgtatgtgggggaaaaaagaatgggaaaaaatgtggccccttctcttaaggaatacacagagtacttcagggggtcacagatattaaaacgggggaagggagggtgggaatccaaaagagtgaaaactctagctgctccacagagtattgtgaggacccagagaaatgggccaactcttcctaggaaagtgaggaagagtttaatggggaagatgatatttgaactacggttgtgtgtgtcttttaggtaagaaagatgctcttcttgagcatcataagcaaggagaacagcacagaagaaggtaaggagtggtgagatggattgctgtagtcagtgcagctacagaagagatgatgctgcctagggggtaaaacgggctttagtatgtcaggatcttttttttttgagacggaggctcactctatcgcctaggctggagtgcactggcgcaatctcggctcactgcaacctccgcctcccaggttcaagcaattctcctgcctcagcctcctgagtagctgggattacagacaggtgctaccatgcccggctaattttttgtatttttagtacagacagggtttcaccatattagccaggagggtctcgatctctggacctcgtgatccgccggcctcagcctcccaaagtgctgggattacaggcgtgagccactgcgcccagccagtatgtcaggatcttaaagttgctatttcatcctcaatgtgacaagaagccactagaggattttagcatgaaaacaacacaatcagatttgtttttaagaaactaattgcgttagcagaggggaagacagagtggaacactaaaggacttgtggcaggaaacccagctaggtatagccatagttccaaggcagagaagacagggtctgggatcaaagcaaattaaggcagcagaggtgggaagaaaaatgtgagagacagtttcagaggtgaaatcaactgaattcagtgactggctgcagatgtctaactgatatagggcaggcaggcttagcctgggagggttcttggcttcacccaggaaagaattcaagggtgagccagaggtgagcggcagtgtgcagcagaggtactgttccttgtagagcagggctaactcataggcagtgtgtccagagcagcagcatatgggctgttggctagctgtatttatatctacttttagttgcatgcaaatgaagaggtgggttatttagaccttttagaaaaggggtggggcatttctagatgcatagaagataactttcaggtcattcccatggcatgttgccacggcatttgtaaactgccatggcactgctgggagtgcctttatgttaatgagcagtgagggcaactggaggtcactttcatcaccatttgctggtttcagctggcttcttcactgcacgccctgttttgaccacatctttctccaatcagtgggttgtgactggtgctcagaaaacaagtcctgctgatctcctacctcataaccttgaaaataagttggagggtgacactaataaccaagataaagaacaaaaggaatggaacaggtttgtggggaaagatactgagccgtgttttagacatgttgcatttgaaggaccgttcaggtgaagatgctgagtaaagttggaaatatggatctaggaatgtagaaaagtacagattgaaacgttaacatctaaaaaaggctagagcacaggagattaggataagcattagccattatgaacaggagaggaccccaataagagcatgcagagtgagagagacccaaagacagaaccctgaagagtccaggattcaagtgatgttcacccatatacgtcagtttctgcttaacgatatgcatgctgactttcatcgttacttatctggattgtgaaaacatgccctgtttccccagacaaattaaaaacataaggctttatacccactgcttaaagagcacctagaaccataataggtaaatagaagatatatgtggaattgaaatagaggaaacttacatggagtagaagaaaacgagcgttcgattaaagagggcctttagtaacagcctaaggaattttaacttcatcctttagataataagaaaacaaccagagttttttgagcatcaaatcgtgtcacaagaacagtattttcaaaggtttaagtatatgaggtaacatatatgttaactatctccatttattcattctacaatgtatatatatttcaaacaatatattttacctaataataatttttgtcaatttaaaaaattttaaaaacaaaagagtggtatatggagggatgagagaaaaacagactctgcagggaaggaatccgttacagtctgactgtgggaatcaagccactggttctcaggcaagctacagccaaaagggatataatccatctagctaaatgaatgaaacaacatacgtgggtcctgaaatgtttttcttaaaatgtaccccaccttggctgggcgccgtggctcacgaggtcaggtgatcgagaccatcctgactaacacggtgaaaccccgtctctactaaaaatacaaaaaaaaaaaaaatagctgggagtggtgacgggcgcctgtagtcccagctacttggggggctgaggcaggagaatggcatgaacccgggaggcggagcttgcagtgagttgagatcgtgccactgcgctccagcttgggcgcaacagagcaagcctccatcgcaaaaaaaaaaaaaaagtaccctacctttgacttgccaaaagagagataaccataataaacccaaagactccatgaaaggcaagtcagaagtgggcacgtagaatggggaaagtacactagggtctctgggcatctaaaatgattctgattttgaaaaatatcaatacacaaaaatactggtgagggtaagatggccaacacgcttcggacagatcacagacactttgacctacttgggttttaatcattcaggataacaattacgaccacgatcaacataacatggtggatgatgaagagctggctgaaaacatctgaaagagctggctgaaaacatctgaaagagctgaaagatgtttggcctgtatcaatgtggcccagctctgggatgtagggatctaggcagatttacaaaataaaaagcagcattgtttgtctgctgcctcccaccatctgttcttgccccaggttagtggaatgaaacaaactctctgggcaagatattgactcacatttttcaaacgctgactcctggtttggatacagagctgaggtcagaattcttaggtccttttccagccaagctgattttaggacaggcaagcaatcacaaaatactcttctgtgcaataaatatgaaaatacttaacctccttagggtattatgaagcataaatcatgcctttaaaagcctgtgacaagctgaaatgaaaagcgttcaaagtggagaaatacaatgaaaccacgactataagcactcactgaattttgagcagacagttgtactattaatttaatgaggtttatggttttaaaagtattcatcaatagcaaatatcgcgttgcttaaatattccattactcgatcatctgtctaaatgcgctctggtctccaacattgattggcttgctcaaaatggctagtttctttctctcttttctttccccaccaaaagtactgcttaaaggagccattaacaagaggattcactcgtcagggctacaatgacttgcagctggaagatccacctacaaatatacatccattcataaggctgatacaacagctttcagggaggggatgtgcatgaaatggacacaagcgaagagtaacaatggcagggattatcttttaactggctcatgagtgaaaaaatgaaattgcagacgtctgacaactgtagctttttcagtcagtacaaattaaattataaacctacagctacacatttactctttatgagttgatttcatgttaggcctcaatagttacttattcctggtacaaacgtaaaccagcagttgtgccatttaagagattagttcaattaatactgtccctgctaggctaggccttatatctataagcaattcagtgtctggcttgctaattcatactctcactttgccttttctttgtcagtcaaagaaattaagctggagatctcaccaggccggccactttcccagtctcttagacgcctctgtttgcggccattgcagtgattccatgatgaatttcaatcattagaaagttcttcctaaggtaaaaagcagagctggaatcaactggtacttattctggcctttgaaataaggtataaaaagcccatttctcgctgggtgcggtgggctcatgcctgtaatcccagtactttgggaggccgaggtgggcagatcacgaggtcaggagtttgagaccagcctggccaacatggtgaaaccccaactctaaaaatacaaaaaattagccaggcatggtggcacacacctgttgtcccagctactcagaaggctgaggcagaagaattgcttgaacccgggaggcggaggttgcagtgagccgagattgtgccactgtactccagcctgggtgagagtgagactccatctcaaaaaaaaaaaaaaaaaaaggccatttctactgtaaaacatttgatcatctctcctctacaacacactacccccctcccccacccacctcttaaatatcgtataaatgcaagtgtgcgccaaggaccagcaactctggcatcgtctgagagctggtcagaagtgctgactctcaggtcccaccttggccctcctgaaccagtatctgtcttttaacaagatccccaggtaattcattggcacactaaggtttgggaaacacggctttagaccagtggttggtaaacattttctgcaatgggccaggtggtaaatattttaggttttgtaggccatacgtctctgttgcaactactcaaaactgctgttgcggtgcaaaagcaaccatacataacacacagtcaaacagccgggcgtggtggctcacgtctgtaatcccagcactttgggaggccgaggcaggtggatcacaaggtcaggagatcgagaccatcctggctaacacggtgaaacccccgtctctattaaaaatacaaaaaattagccgggcggtggtggtggcgcctgtagtcccagctactcaggaggctgaggcaggagaacagcatgaacccgggaggcggagcttgcagtgagctgagatcacgccactgcactccagcctaggtgacagagcgagactccatctcaaaaaaacaaaaaacaacaacaaaaaaaaccatagtcaaacaaacatggctggtttttgtttgttttgcttttacaaaaagttttatggacactaaggtttggatttcatataattttcatgtgtcacaaaatagcttttgattttttttcaaccatttaaaaatataaatgccattcttggctcatgacctgtacaaaaacgggataaaccatagcttgctgatcctagctctatactctggcacttcacatgatatcatttgctggtttcacctgggcctggtcccaattctagataaggtattccagttcattaatgcagcatgcataactgaatcaaacaaaacagatgaatttttaacagtactgagcagagcaagaccattatttctcatgatttgaacatagcatttgttttggtgaagaccaatgcctaacaaaacacttattttaatgtagcagcatacaatgtggctggacatttgtaaacaattaaaaaattgatatcagtttgcaaaatttacttatatcttcaatagtcatatcttctccacactataataactaattgttatgatcactactgtacttactgccatataattttttttttttttttgcggtggtgtgatcttggctcactgcaacctctgcctcccaggttcaagtgattctcctgcctcagcctcccgagcagctgggactacaggtgcgtgccaccatgcccagctaatttttgtctttttagtagagatggggtttcaccatgttggccaggatggtctcaatctgctgaccttgtgatctgcctgcctcggcctctcaaagtgctgggattacaggcgtgagtgagccactgcacctggccaaattttgcaattttttaatcaggaaagcaccatcaatactgcttcctggtggggtgaggaggaagtctggagctggaacacattcccacacattaccattttttccttttcaattctcaccccaaaagtacccccggcatatagggaaaataaaaagacgcatggcaaagggtattctgcaattaagttcctctccacatgggattgttcaaaccttggtcaggatggacaggggaaatttgcagcctaaatatagtggtggcataaagtaggtcatttccagaaccatggaaaataccactgggaaaagggcaaaaggaaggaagtcataaagaagagttgacaattatttctataatggtttccaatctggatactcccttacagcctatttaagaaacatggaatcggatgatttgaaacatatttcctaactctaaaatttggagatttgttattagtaccattacctacctagttatatgtgctcaaaggctgggaatcctctctgattcatcccttccacttggatttcccttcagatccatcccccaaacctgccgattcctcctttataatccctctcaaatgtgtcccctgcttttcattctcattgtcaccatcttagttaacacttcacccccaatttactgcagttatctccattggtcaatgacgtccatgatgtttcacattattgcccaatacaatcatagtgaatcaatgatttttttttttttttttgagacggagtctcgctctgtcacccagggtggagtgcagtggtgcgatctcggctcactgcaacctccgcctcctgggttcaagcgattctcccacctcagcctcctgagtagctgggattgcaggcgtggaccaccacgctcagctaatttttgtatttttagtagagacagggttttgccatgttggccaggctggtctcaaactcctgacctaaggtgatccacccgcctcggcctcccaaagtgctgggattacaggcgtgagccaccgcatccagcctgatttttttttaaaccacagttactgtcattttgaacagtcttcagtaatttcccaacacttgaaatgccggctccatatcctacaagcatttcagtttccccaaagctatcacccactcctccttcgcttcaccatggctggcctcctctccatctccagctcccaggggttgactccactcctgtgcctcatcctttctcacatgcttccttcatcacctccaaactggagttaacatttcaaactcaggccaaatgagaggcgtgaagatgtactcaaataattactaatcctgagtatgaaggggcaaatgctaagatgaatacaacataatgcaaaaagattaaaatgagacaggacctttagaaatttagtcaaatacggctgggcacggtggctcacacctgtaatcccagcactttgggaggccaaggcgggcggatcacgaggttgggagatcaaaaccatcctggccaacatgatgaaaccctgtctctactaaaaatacaaaaattagccgtgtgtggtggcatgcacctgtagtcccagctacttgggaggctgaggctggagaatcacttgaacccaggaggcagaggtggcagtgagccgatgttgcaccactgcactccaacctggcacagagcgagactccatctaaaaaaaaaaaaaaaagaaactgagtcaaatatccttatatcctttgaccttgttaatcacactcctgatcgtcctcattcttttctgactgctacttcacaacacccttcctgtaaataatggggctccccaaggcgctgccctaagacgctgagctcttctccatctatgctcagcaccatggcttttttttttttttttttttttgagacggagtctcgctctgtgccaaggctggagtgcagtggcgcgatctcagctcacggcaagctccgcctcccgggttcacaccattctcctgcctcagcctcccaagtagctgggactacaggcgcccaccaccacgcccggctaattttttgtatttttagtagagacggggtttcaccgtgttagccaggatggtctcaatctcctgacctcgtgatccgcccacctcggcctcccaaagtgctgggattacataccgcgcctggcaccatggctttgattaccatccacaggctgactctcagatctaaaattccagtttataggtctcccctgagctccagattcaaaagcagcatactatttctgacacacctaagctgagagcaccccacgtgtcttcgaactcagtgtcttctcactttaccgccacacacgtttttcttcctgtgtgccctatggcagtcaaggccattgtcatctatgcagctgcctgaggcagaacccaatcaatcactggtcctactacttttaaaacctcccctccatccatccacttctctccctatcttctcatcctaaccactccagtctaggccaacatcatgtcatgactgaactacttcaagccacctcctgactggtttccctgtctaccatcccaaccccgctcctatccatcatctacattactcccaagccatagtttctttcttttaagatggagtctcactctgtcacccaggctggagtgcagtgttgcagtctcagtgatctcagctcaccgcaacctccgcctcctgggttccagtgattctcctgcctcagcctctcaagtagctgggattataggcatgtgccaccacgcctggctaattttttgtattttttgtagagacggggtttcaccatgttggccaggctggtctcaaactcctgacctcatgggatttgcccaactcgacctcccaaagcgctgggattacaggaacaagccactgtgcccggcctgtatcttctttattgaaactttagtggtcaccttggagcaaaagaagtgaatagtggaggtcccaaattacagcactgaggggcaagcattgtctccaggtggtatagatgagtagcagtggtgtggtatattattagcagccagactcctaagaacgtgtgagatatcctcttgggactcattaaaacatttagagaggggagtcagtcaggtatggatgataatgttaatatggcctcagaggcatcaacgtaatgcatttatagtcaaaagctgatgaaatgtggagacattctggttatagattgaactaagataatctcatagataaaggggctacagggtgctatggagagttgctcagatgtttggaagatactagtcatcatggcagttaacatcaaagaagataatcatgcccttctgtaatgtgtcctccttgcaggttaccttcaaacacaggcttgggaatgtggaggatcatatatccaaaagggcaaccaccactattcttaggagttgctaatcttcacgtttggagctgaatgattaaatcaactactgaaagcagccatagggccttcaactcttttctctttcccagaacagaactagagtcactcattcattaagcatctacaatgtacctactatatgtaagggagagcacaaagatagaccacacacagtccgcatccccaaggaaatttaaattaagcaatgtgggacagtctgttgcgagttcatgtggtatgatattggagggtaccactaagctcacctaataactgcttcttaacaaagaaatcccttctagggctcccccgagccacagagccattccccttgagccatagagccacacagagccactcccttgagccacagaaccacagtcattgtccaactgtgcaataatctgaggccaaggtaatttccaaccctccttttccagagttctcttcttcctaactcatttatattatttctactggctcctctgtgggtctggaacccctactcttctctaaggagaaatgaggaaccccacctaccataggtgcaaaacattccaatgttcctttgtatttctctactaaatgacaactaaacagaagctgtttgtctggtgggctgacatgatcacaggcaaggcggaccatcagctcttattaccaaatacccaatatacacccttcctttttggcccttcctcaaagttttccactttgcctggcccttttcatgaataacttcctgtgtcatcatgtgacacgacgaatgatttctgtcatcgtgttcattcatacctatccagaacataccatagcactgtatcatacctagtttgacacaaagacctccctcacacttctatttcctgtccaccagtcctcatcccattctttattcacacacactttcgcacattcttctctctttctctctctctctcctttatagagacagagtcttgctatgttgtcccaggctggtctcaaactcctgcctcgagcggtcctcccactttggcctcccaaagcattgggattacaggcatgagccacccctccctgtctgttcttctcttaattacttcttcagctctaacaacgcaaagcgcatctgctagcccttggtttctggattatcctgcccctctctgccctagtgaatcttaagaaagttcacaatcagtacgacaaatcatgtgtgtcctgactagcgctgatttggtggaattatttccagtttagatctggtccttccttaattaataataataaacctcagttaaagttgtgtagcattttccatagcagtaacacaatgttaatttcatcttgagcttggagaagtcagctaaagtcctaaacctcaagatctttttatatataagggagaagtctccagagatggtgcatccatgagcacatcatctttactaaagaaaagcaaaatatatttatcttctatgtatgcacacaaacatgtattttttcttcctttttttagtgcaacttcctgacctctgaaaacaatttctttaggatactggctgtaaatatttgcacggattgttcaatagctggttgtgcaaagggagacaggctttttgtctttaccccggaaaagaattgaaacagactctttctttcaaaagttggcagagatatgttacagaggggtccagctcatttgtagaagcaaacatgttgccgtctaacacagattgatcaccagctgggaagcaagtcattccaccgtaggttcacaataacactggctctctgctgagctgctgaccactggtgacagattgatgtgtagttcgagtggagaagctagctaaagagaacttagggaagctgagcaggttgcaagtgtattattcatgcactctctgcccagaaaaataaagttccccacctttctgacctaagtttggagaaccgttagggactgagtttgctttgtgactttgaaggctgcttacagctttccagagcaacataaaaaatgaatacctattggcactccaatgaaatgccaaaatccacaaagagaacgaccaaggaacatttcttttttccttttcccactgcgagtgagaaagaagagacatgatatttcatgtcactgctaaagagtttgtttggtaaaaaacaaatgaaaaggtacagcttgttaacaccactcagaggtagacagtccagggtctcagaaagaagaatggcatgcccctgggtttcttttagaatgcgaagagtggtggccggggagggggggatggtgggggagggggttggggggtgggggtgagggctcacggaatgaagagctttaaaacaccacgcaagcggggaaggcatatttacttaagaaaactggtacctaagttgtaaatcggaataacagatcaagcaggtaccgtgttttataagtttgagtcattaaattttccaagattctgcatgcttttcaaaccataaaagacccacttccaaactattacccactttttaaaccatgaagatacattaagcacactactttttcaatagcagtttttttgcacatcttttctatcatctttccttaaagaatatacatttttttctttttttctctttttttttttttttgagacagagtcttgctctgtctcccaggctggagtgcagtggtgtgatctcagctcactgcaagctctgcctcccgggttcacgccattcccgactcggcctcccgagtagctgggactacaggcgcctgccaccacgcccggctgatttttttgtatttttagtagagacggggtttcaccatgttagccaggatggtctcgatctcctggccttgtgatctgccctcctcagcctcccaaagtgctgggattacaggcgtgagccactgtgcgtggcctccttaaaaaatattttaaacaaagacatttagcacaagaaaacagaataattacatgggggccagggactattttattcaccatggtgtcactaaagcctagaagaatgcctggcacatagtagatcctcactaaatatttgctgactgactattcattggaagccaacttagcaacactgtgctttattattctagctcagatttaatgataaaatttcatgagcattttcccacaactttcgaaaattattttaatgaagaaatacaaacataactgcaccatttctgctattaccaccacgtccacagttgaaactattagtgtgaagtgaaagctgaatataaagaagaaatttagcccaggggattaatttcttcaaggctggtgaggaggaggaagcaaactactgttttccttttcacgggagtgctacacgggttactatccacaaagatagaaaggaataaataagtagtagttaatgatgaggagaagcaacagtttttttggcagtagtacaaagccaggaaatatagcagtttccagagagttgcatgtgcttttcagtgaaaaggtttgagatagcacttcctaatgaaatgccaaaatccacaccaagaatgactgagtagcagtttttttccgttttcccactgagagtgagacagaagatccgtgatgtttcatgtcactgccaaaacagtttgttttgtaacaatgtatgaagagagacagcttattatgccacctgtattgcactatttgttagtattttaataggtaattaatcttgatttgataggatttaagatttctattttttggcacatatgctcaagctattatgttataaatctcaaacatttcagcaaatgtcatcctgattgttccctactgcatagaatacgatcagtgaaatattcaaggtcaagaacttggattctttacccaccgtattcaggaaaaccaatttattgttctgtctcagtaaagaggggtgatttctttggggcctatattatattggcagtcaatctagaaaacttataattacttttaagcaatggaggtttggtaagtgcgttaatctgttcctgaatttaaacacataccctttagctattactatgacaaaacttcagagttcaacattttaaattacaagaatgaagtgtgtgcacaatacgttagaatggtgcacaagagtttttaatataaaatcaagaacatgtctttgcatttgcctggggataaaatcttaggaagattttgaggagttgttcttttgttttttcttttttgagacagagtcttgctctgttgcccaggctgcagtgcagtgacgcaatctcagctcactgcaacctcggcctcccgagttcaagcaattcttctgcttcagccgccccagtagctgggattacaggcacctgccaccatacccagctaatttctgtatttttagtagagatggggtttcatcatgatggccaggctggtctcgaactcctgacctcaagtgatccaccagcctcagtctcccaaagtgctgggattacaggcgtgagccaccacacccggccttgagaagtttttaaagcaatcttcataccaaatggtcctggtttggcaaattaatgttctcatcaatttattggaataaaaaaattgaatgatgtttggcattaaaccaaatcattacagatcatttcaactgaactaagtttatgcattttctaaaatataagaatatggttggccaggtgcggtggcttaagcctgtaatcccagcactttgggaggccgaggcaggcagatcacgaggtcaggagttcaagaccagcttggccagcatcatcaaactgtctctactaaaaatacaaaaattagctgggcatggcggtgtgcgcctgtagtcccagctacttggaaggctgagacaggagaactgtttgaacccaggaggcagaggttgcagtgagccgagattgtgccattgcactccagcctgggcaacagaatgagactccatctcaaaaaaaaaaaaaaagtttgatcctcattattcatggattgcatatttatgaatttgcctacttgctaaaacttatttgtaacccccaagacaatatttgaggaactttcagagtcattcgtgaacatgcacagagaggcaaaaagtctgagtcgcccaacccgcacactcctaactgaggctgagcaaggcaacgccctgccttctcgtttcagctccacatactgcaaacaagtgtcctttcggcggtgtgtttagtctttcacatttctgttgttgcttgttgtgattctgccgtttaaaatggccccaagtgtactgctaaagtgccgtttggcgttcctaagcacaagaaggctgcaatgtgcgttacggagaaaatacatgtattcggtaagtttcattcaagctgttgcccaggagttcaatgttaacccactatctatctatacctatctatgtatataaaataatatgtccttaacagaaacacttagaagcagggtttcattaattggttgatgaaaatgctatgagcttgagggaccctaacgctgtatttcccctaagaacagtggttcagtatgcactaacttggtgttcacggtgactttacagaacatgagcgccacaaatgaatgaggactgactctaattattttcagaaatgaccttaatacaaaatttttgcttctcagagaaagacagatgtttttgcttttgaaaggtaagggtcagttctctacattattaaaaaaatatatattactgcaatcttttttaaaaagatacatagattaaaaaaatttctaaaatgacaataccaagtgctgacaagaataaggtgcaactgaaactctcatacaccactgatggaaatgcaaataatccagccaccttagaaacagttgatcagtttcttagaaaactaaacatatgcttatacaaaccagcaatcctactcctaggcaggattacccaagagaaataaaaacaattgttcacacaaaaatccaaacatacccatctgtagtggctttagtcaaaactgccacaaactgaaaacaactcaatgtccttccactggtaaataaacaaacaaattgccgggtgcggtggctcacacctataatcccagcactttgggaggccaaggcgagcggatcacgaggtcaggagatcgagaccaccctggcttacacggcgaaaccccgtctccactaaaaatacaaaaaattagccggacatggcggcgggcgcctgtagtcccagctactcgggcggctgaggcaggagaatggcgtgaaccccgggggacggagcctgcagtgagccgagatggagccactgcactccagcctgggcgacagagcgagactccgtctcaaaaataaataaacaaacaaacaaattgtggtacagctagacaataagctattccaccacaataaaaaggcacaaactacggatgtatgcaacaatgtgaataaatcttaaatgcattatgcttagtgaaagcagccagatacaaaaagctacaaacttcacaattctatttatattccattttggaaaaggcaaaacttgagggacagcaaacaaatcagtgatgcccaggggctgggagtgagaagagggtctacctgtaaaggggttgaatgagccaagcacaggtggcacacacctgtagtcccagtaacttgggaggctgaggctggagaatctcttgagcccaggagtttgaggccagcctgggaaacatagtgaggccccgtctcaaaaattaattaaaaaataaataaaggagaatgaaagaacctttgaaggtgatggacttgttttatatctcaagtatatatatcaaaactcattaaattgttcataaaaaaaagatgaaatttgctacatgtaactttttttttgagatggagtctcgctctgtcatccaggctagagtgcagtggtgcgatcttggcttacagcaacctctgcctcccaggctcaagtgattctgcctcagcctccctagtagctgggaaaacaggtatgcgccaccacgcccggctaatttttgtatttttagtagagatggggtttcaccatgttggccaggctggtctcaaactcctgacctcaagtaatctgcccgcctcggcctcccaaagtgctgggattacaggtgtgagccaccacgcctgaccttacatgtaaatttaactaaataaacctcacactaaaaaaggtagtaaaaaataataatgctgtaatgatagacattccttcaaattctccaagacccatatatacggatgtgtgtgtgttagagatagaatctccctatcttactcagactagcctcaaacgatcctccagcctcagcctccctagtagctgcgaagcatgcagctgcgcctgacttcctctaatttttaccgatgttcataggcacatttttatctagctataatataaattgatgatttgttttattttataaaaatctaattaattctgccattctagcaaagaccagcatgataatctggcaaggtaggactcattgatcaatttcaagtcagcacttttctccccattcacacagcagtatttcttaagaaggaattttatttctcggtggtattctcagtattttgtagacatacctgctcttaaccagcaatgcaggaagtccaaatgacatcctgaaacaaggcctcttttgcagccttcctccataagaggtcctgcctttttgtccagtaacacaaaaaagatttgccaagcatggactgtgttctgggccctgcgctcagtaccaggaacacaaaaatgaataagacagccttacttatatcacttcctcactctatcttaaagcaatggtgcttacacaaacttaagccctcaaatcttctggcatatatgttaaaattatctcctttgtttataccgtccctcccttccagcatttatcttgggaattattcactttttccagatctaatccacaccataatcccattaacaacttcttcaagctagacttggagtggtcagaacttgattccacatatatgtatctctctgtggagaaaaaacaggatcccataagtcaatgccatttcgtctcatctttccatgtcacactttgttactaagtgtgtgatctacggcgacagacatctcagttcgagaacttacacaaggcatcatctccacgtttaatgtaactttccaaagtaagcactaattccctttggaaaccatagtttttaaaatttttctaaataaaatggtacctctgatgtagctatgacccctgctagggttcgtggtgtctaatgaagtgaaaatattatatactttgcattcagtaaaagttcctattccaagagatataatttaactcctatgatatatatgtccaaattatttttataactttataaataaacccatctctaagttctcctttcaataaaaaatgaatatttaaagaaaaatagaaaaatacccaagttgctagatttttccaaaaatgattatttttgaatacttcataaacaaatgtgcaatttaaatatattcatatatacacaaaaatatacatatatacagagagagagagagagagagatggacaccatgaattcttagaaaacggaacaaaagtttcactgcttagaaaatttgagtttgatattttgcttcctctttcttatttggtttaatttgagctgcatctgatttatgtttttctcttaatccaattaaattaccttgatggtttcagttaaaacatggaaggatttattgcaatctctcttaatataaagtgcatgaattgtcctactggagtcaaataataatgtgtaactatgacatacattccaatgacaatttcaccattatgacctgagatatgactcaaactctagttacttagtaactataacttaatttagtaacttctttgacttttttttttctgatcatgttttcaccctggacactccaagtacctgacagcttcttggtggagcccatctcttatctaaaaatacctgaaacaattagctttattttccctgctttcaaacacaagagcacttatgagaaagaaaattgacatcggagaaaggtgggatgagagaaaaatctcttctatctttaatgaaattagttaccaaaaatagaaaaaaaaaaatctttgctcaactagaagttaaatgtgtgtttctatttccgaacactagttcttactcaactatgatacagcctgtgagaaggaattagtcctctacaacacactgccactctgaaaggttcaggtaggtggtaggaagtgcccagctttgggatggtgctgaacccgatgccgcagaagccaaatgaacacttggggcaaatggtcccccagcctggcagtagctttggctctcggtgtgacaaagcagaacagctaggggttctcaggtgtaggcgagcacctgaaacccttgaaaggttgtcacatgacgggtgttctcaatgtataaacttctacactgccttggttgttgatgattttaagattaaaaatctacttgggaagttggataacaaagtatcccagtaggatggcccttgtttttttttctttttagacagagtctcgctctgttgccaggctgcagtgctatagtgcagtggcgtgatctcggctcactgcaaccctgcctcccgggttcaagctattctcttgcctcaacctccccagtagctgggattacaggtgcccaccaccacgcccagctaatttttgtatttttagtagagacggggtttcatcatgttggccaagctggtcttgaactcctgacctcaactgatctgcccgcctcggcctcccaaagtgctgggattacaggcgtgagccaccgcgcctggccaggatgggccttcttttagatgtttctcatctttagtactcagtatggctagaaaatggtgtggggatccgaaaggttaatttcctatgactagaaactcactgaccctggttcatagggtaggttcatccaatccactgtaagcctccaggaaaatcaaggaagatcattatgaatcagctcagctgctactgtgatagtaatctcaccatcattatgtttaccccatggagaaaacactattgtaattaacaccaatttataatctaattgtgggacagatggtgaaggatacctaccatattcagatctgaattagacaggaaggtatgaactgtatacaaccttcaagagcactttatacctcctgtcactactcatctttttttttttttttttttttttgagatggggtctcactctgttgcccaggctggagtgcagtggtgtgatctcggctcactgcaacctctgcctcccgggttcaagcgattctcctgcctcagcctcccgagtagctgggatcacaggcatgtgccaccatgcccagctaatttttgtatttttagtagaggcagggtttcaccatgttggccaggctggtctcaaactcctgacctcaggtgatccacccacctcagcctctaaaagtgctgggattacaggtgtgagccaccgtacctggctacttgtctttcttatggaggatttttaataactatgtgttgagttaataaataaattgtgccatgagtctcttgctctcctaaggggacttatgggtaagagtctgtaaaagtcaccagtctggatggggaagcatggatggcaattgaagaagagggaaggcgaggctctgggaaaccgctctcacatggcttcagacactggtgcaaaggaagcgtttataagaaactatgtcataaagttaaagtggaatgactatattctaaatatgttttctacattatatatacatcattaaataaattgaatatcatatttgattatttcagctatagtcctaaaagtatacacagtagtccccgcttgtcctcagggatacattctaaggtccccagtggatgcctgaaacctcagatagtaccaaaccctttctcaatctgataaccaagagggctaccaaatgactcgtaggccgggagcacgtatggcatggagatgctggacacagggatgattcgtgtcccaggtggaacagagcaggatggcatgagatttcatcatgctacttagaacagggcataatttaaaacttatgggccgggctggccgggcgcggtggctcacgcctgtaatcccagcactctgggaggccgaggcgggcagatcacgaggtcaggagatcgagaccatcctggctaacacagtgaaaccccatctctactaaaaaaatacaaaaaattagccaggcctggtggcaggcgcctatagtcccagctactcgggaggctgaggcaggagaatggcgcaaacccgggaggcggagcttgcagtgagccaagatcgcgccactgcactccagcctgggcgacagagcgagactgtctcaaaaaaaaaaaaacaaaaaaacttatgaattgtttttcctgctattttccatttaatatattgggactgcagcagaccatgggtaactgaaaccacagaaagcgaaaccacatataagggggaactattgatttgggaaagaaactgttctagggggcagaggatggatcatcctctttggagacaaaaaaaattatcttacactcaggaatatattcaggtacaatgtttttacaacagtagattaaacagtttaaagtgggcacagtggctcatgcctgtaatcccagcgctttggaaggtcaaggcgggagcatcacttgaggtcaggagtttgagaccagcctgggcaagacagcaaaaccccgtctctacaaaaaattaaaaaattagccaggtgtggtggtgtgcacttgtagtcccaactacttggaaggctcaggtgggaggattgcttgaggttgcagtaagccatgatgacaccattgcactccagcctgggtgacagagcaagaccctgtctcttaaaaaacaaaacaaggctgggtgcggtggctcacgcctgtaatcctagcaatttgggaggccgaggtgggcggatcatgaggtcaggagattgaaaccatcctgcctaacacggtgaaaccccgtctctactaaaaatacaaaaaaattagccaggcatggtggcacgcgcctgtaatcccagctactcgggacactgaggcaggaaaatcgcttgaacccaggaggcggaggttgcagtgagccgagatcacgccactgcactccagcctgggcgacagagcgagactctgtctcaaaaatcaatcaataaataaaaacaaaacaaaataaaagaaaaatagtgaaggctttggtggctacaagaaaaggcacagcaaggaaaatattttggtatcttggtgtaaaaaaaagcacaaatgaaaatattacaatgcaataagaatttttaaaaaactgaataaaaacagtaagattttgactatggtatcaggaagggaagaaaaggagaaacttaaaatatggacaggaatacagacacttcagcaacagtcaatgtcctctgcagacagtacatacaatattattcacaaagtgggctaactctgtaacagtcttccagccaagagtctctgaaaattatttctaaaactttacaacttgctactataagggggaggtacgcaaccaataagtctaattaggattctgaccatttctcatatgcaaaggcatatcaacaaacccatctgcagtgtacagctcatcctcatctgggatctgggggcacaatttactctcccagcacaccctccctccctaacctgacgatccaactgtgtttcacccaggattcagatcctgggaggaatcctaactatcagggctgttaagcttttaaatacgccaccctcagagaaggccctcactagatgggtaggggctgggtgtcatgataagagaattcctattttcccacggaaatgaattactttttaaaaaaacccatttgctggtgaaagggaggagagggaggaagtgaggctaagcaagtgtatttggggggtggcagatgaagcgagtcttgtgggtctcaggacagtctttggaacagaaattacaaaaactaatttgaaacccagaggcagtgaagaaaaggcatggaaaccaaatgaaacaccatttgatctttggcctctctgatctgaaactgggctgggcctccagctgagttcactgaggccactgaacagctgtccggtgataaccactttcatagttgtcagcaacatttgcttcaagccagtaccagggctgttcccactctgtggagatggaaaaagagtctatgtttcccttcatttcttcctctgcttgagccatcctaaattaggaaatcatctggatttgtaaaaataatcacttcttggcatgttcacagaatctgctgaaatgttatttcagaaaagagactctgaatgcctggaggtcactataggaaatgaatctggcaatttgaaagtgcacctgctgaagttctaggccatctcagcattcaaataatttatccatctttccaaacatcttttgtgtcttttatttttaaaaaacaaaaaaaaagttctaagttattacacttactatgaatcggaaaacagccctgcttctttagatgtggattctggggtttttttctcctgcattttttcactattcagcaaacactcatttagagtccgccttagacacagaactctgctaagtacgtatgcatcttgcttaggacagctgtggctgcaagtagcagaaaatgagactcgaactggattaaacatcacagaaatgtgtctctcatggtaagaaatgcagggttgctctagagttggctaatgctgaggttctgcaaagtcatcaagcagccatcattctttccatctcgttactagtttcctactgctgctataaccaattcccacacacctagtgccttaaaacaatacaaagttatcatcttataggtccagaggtcagatgtctgacgtaggtctccgtgggttaaaatcaacgtgtcagaaaggctgtcttcctttctggaggctccaggagaatccatttccttgcctttccagcttctaggggctgcccacactccttggcttgtggccccttctatcttctaagccagcaatgactgctcgagtctctcacatcacatcactctaacactgactctcttgctccctcttccacatttaagaactctggtggttacactgggcccatcagagaatccaaaactctctctccatctcaaggccatacccttccttagcacatctgcaaagtctctggccacgtaaagtaacacatcttcagattacagagcctaggacatggatatctctagtgggggctataattctgcctaccataatctctgtgctcttccagcctcaatgagggctttgccctcaggctggctgttctcatgatcataaggtactaattagagaagtttcagatgccacatccagacatactttgtagaggaataaaaaaggtgagacacctctttctggtctctttctttctaggaagaaaactttagccagaggccctagagcagattttccttcatgtttaattggctgaaacgggttacctgcccattatcaatccaatttttgacaaggagaataggttcactgtgattggcataggataagaatttggaatggatgttggagagtcagccatcatattcactataatgtagcaaataccaagaagggcagaaagttactatttacagaatacttataactaaaggtccagtacttaaaccaatcttgctaagaaaaccaaggctcgtttgaattttactatgtattctagttatggttacctctgcatatactattatatatggaggagtaaatatgctggcttttaattttatttttttgagatggagtctcgctctgtcgtccaggctggagtgcagtggcgccatcttggctcactgcaagctccgcctcctgggctcacgccattctcctgccttaacctcccaagtagctgggactacaggcgaccactgccacgcctggctaattttttgtatttttagtagagatggggtttcaccgtgtcagccaggatggtgtcgatctcctgacttcgtgatccgcccgccttggcctcccaaagtgctgggattacaggcgtgagccaccgtgccctgccaatatgctggctcttaagcacaggagagttgagttgaaatctgttgttttctaccacattcttcaaaaacacatcaaataagtttttaaaataattcaaaagtaatcatgactttgagaagaccaatgcatgacttgctagaaaatatacgagaggttctaacttcgagtttgctctcgtgctcttgttcctcaaagaaatccagcactcccaatgcaatatgaagtatggatcagagaggctgcttagaggactgactgctcttccagatgacagtgtcatatgatgaacgaagctgaagccaaacagcagaggcctgaattatataggcgtatcggccagggtctgatcaggcgacagaaatcactccagttatttaatttttttttttttttttttgagacggagtctcactctgttgcccaggctggagtgcagtggtgcaatctcggctcactgcaagctccacctcccgggttcacgccattctcctgcctcaacctcctgagtagctgggactacaggcgcccaccaccacgcccggctaatgctttttgtattttttagtagagacagggtttcaccgtgttagccaggatggtctcgatctcctgacctagtgatccgcctgccttggcctcccaaagtgctcgaattacaggcgtgagccaccatgcccggcccactccagttattttaacagaaagaatttaaggcagagagagccattaacaagacatagagttgttaactaggtgagagggtaaaaacagaactctaaggtatcatgggagcagaagagataaaagcaagaggtgaaaattattaaaataaagagcctggacgagggcccccatggaagtgaactcgaaattctgaggaggaggaggtgctgctcaggtgacacaagtgtctccagggtacctgaagaggctgattgtgcaagtgttgaaaaacccgtggactgaattcagccagctgctgcctcagggaaagaactgctgctgccagggtgaagaagcgtatcttgtgtaccacagacgggaagctcacaggaagcaaatgggaaatacacatcacttccttgtatggagcctcgctctgtcgtccaggctggagtgcagtggcatgatctcggctcactgcaagctctgtctcccaggttcactccattctcctgctttaacctcccgagtagctgggactacaggcacccaccacgacgtccagctaattttttgtattttcagtagagatggggtttcaccatatcagccaggatggtctccatctcctgaccttgtgatccacctgcctcggcctcccgaagtgctcggattacaggagtgaaccaccacgcctggccaatatgctggctcttaagcacagaagagttgagctgaaatctgttgctttctaccacattcttcaaaaacacatcaaataagtttttttggcatctagaaggatgctgcagctttgcagcatctagaactcgctactggcagagccgaatagagaggcagctggcaagacagaaatgtggcttgcagaggccgagctccagcatcacacaggagggcacagaaggccatgtttggggttgagagacaatggcttcataaagggcacaacaagaaactatcctgtgataccagtagcaaagtctccttcttttgcagttgagtatacatctttgggaatgataaaggagatgaaggggcttcagagtgtatgaaagggttaaaaaaaactttcatagttaggaaatgcttatttagcttctgggaatgcaactgttccctcactccacaatcatatcacaatatttactagtaactcttggatgttactatcactcccattcctttctgggggaaggaggtagataagcacagtcatatttgtattttgaatatctttttaaaaaattactaaattcagccaggtgcagtggctcacgcttgtaagcccagctctttgggagtccgagacaggtggatcacctgaggtcaggaattcaagaccagcttggccaacatggcaaaaccccatctctactaaaagtataaaaattagctgggcctggtggtgggcgcctgtagtcccagctactcaggaggctgaggcaggagaatagcttgaacccgggaggtggaggttgcagtgagccgagatcgtgccactgcactccagcctgggagacaagagtgagactctgtctcaaaaaaaaaaaaaaacaaaacaaaactactaaattcacaacaacaacatatctttatcatgtagaaagacagtaaatatgtatatggtggttaaaagaacatattttgtcatcagactgatctgggttcaaattctggctttgacacttggtagctgtgtgcctttcgccaagttacttagattgcctcagcctcactttccccagctgttacatgggaataataataatactaacttcataaggtggttgggaagattaaattaattaccactataaaacttaacttggtcatcactgcttttttttttttttccctgtgagtctcaacagcctaggaaagaaaaatgtttccaacccctgctttggggaaaaatatttatagcctttccacagtattcttacctctgtgacagcactgagctcaacgtataagtttttaaataataatattcccaagtgagagttccttacaaccagaactgtatatttttcaccatgtacacagctcctgaaaaaatggttatcttccttgacagatccagacagtgaaccaatccaaaacacaagcagatacacagaaccccacagcgggaggggatggaggcaatccaggaggtcaacatggagaggagtggtttccagtggagggtaggaaggtgagagggtgggcaacagaattacctttttccaagggtgcacaccctccacctaccaccaccctagattctagctcagcttccttagaaaattatgaatacattgttcctttgggtgctagagatagagacagaagccaatataaagtcaagaagagatagtcttgactttctaggaagtgtggattcacagtaagcccaaagggaggctaaactattcaggctcagctgccaggagaaagtgtgaatttgcacagagaaagctggtgcttgtggtgggttagagcagcggtctccagccttttgggcaccagggaccagtttcatggaagacaatttttacatggactagtgggtggggggtgatttcaagatgattcaagcatattacatttatcgcgcactttatttctattattattattataatatataatgaaataattctacaactcaccatcatgtagactcagtgggagccctgagcttgttttcctacatctagatggtcccatctgggggtgatgggagacactgacagatcatcaggcattagattctcataaggagcatgcaacctagatttcccttgtatgtgcagttcacaatagggttcacgctcctatgagaatctaacgctgccgctcatctgacaggaggcggagctcaggcggtaatgcaagcaatggggaggggctataaatacagatgaagcttcagtcagttgcccgccgctcacctcctgctgtgcaacctggttcctagcaggccacgtaccagtactggtccatggccaggagttggggacccctgggttagagaatcaggggaacaaacatgacagtggctggttctatcggaggagaagcacaaataagtctctcactaagtcacacagaggccaagcgcatgagaccttcacctaaggaaacctgaggctgacaagaaaggcagaaaggagcccctggagtgatctaatgaagacaaactcactttgtggctttataagttctaagcaaaccaaggcagagatcatttgtgactaacctgagaagaaaatctcatttcaaccctgagttcttttctctttcaaaaatttccatcaggaggccgggtgcagtggctcacgcttgtaatccaagtactttgggaggccgaggtgggaggatcacttgaaaacaggagtttgagaccagcctggccaacgtggtgaaaccctgtctctactaaaagtacaaaaaattcgctgggcgtggtggcaggtgcctgtaatcccagctactcaggaggctgaggcacaagaattgcttgaacctggaaggtggaggttgcagtgagccgagatcacaccactgcactccagcctgggcaacagagcgaggctctgtctcaacaacgaaataatttccatcaggaaaaaagcatggggaataataaaacatccaatgaaaccctaattataatccttttaataaagtgaaactgtacagggaaggactgcttggggtatgttctggattcctctacactggggcagtatccattgaggaagagtgacagaacgactaaagaaatggactggccaaggggcccgccacacttcccagacaccagaagacagggactcagcatctaggccacagccttataaagtccaaggaataatattcatccaccctggcaggaaaggtaaaaagtaaagcaagagctccctggtcttctaagaagaggggaggggagtctcactgaggaagaatgtaaaagaatcctcatcccagaacacatccctatgcctagctggcctcatggtttacagcttgagcagattcacctctttattagctacgtgatttgaggctggtatttaattctctgagtctcagttttcccatctgtaaaatggtaatgttattaccgctcacagggacactatgagtattaaatacaataatttacgtaaatacaatactttatagtactttcctggaacagagtgagcacccaatacacagtaacaattatgtttgtttcgctatcacagaattactgataataacaggtatccctgcaatctattccattgagactatttttagtattaagttccttcctccaaatcaaaatacttttatttcacccattcaaagtcaaatatttacaggctgggtgcggtggctcacgcctgcactttgggaggctgaggcaggtggatcacttgaggtcaggagttggagaccagccaactcctggttgaacatggtgaaactccgtctctactaaaaatacaaaatttaggccaggcgcaatggctgatgcctgtaatcccagcactttgggaggccgagctgggcggatcacctgaggttgggagtttgagaccagcctgaccaacatggagaaaccccatctctacttaaaaatacaaaattagcagggtgtggtggcgcatgcctgtaatcccaactacttgggaggctgaggcaggagaattgcttgaacccgggaggcagaggttgcggtgagctgagattgcgccattgtactccagcctgggcaacaagagtgaaactccatctcaaaaaaaaaaaaaaaatttagctgggtgtggtggtgtgcacctgtagtcccagctactcaggaggctgaggcaagagaattgcttaaacctgggaggcaggggttgcagtgagccgtgatagggccactgcactccagcctgggtaacagagcaagactgtctcaaaaacaaaaacaaaaataaaagtcaaatatttatcatgagattgaaatattcttctttgagacaattaccatatatgctccacatcttcctaaatctgattcttaaacagcagcagctgaaagaggcaattattgtaaagagcagttgctttagaaagaaacatttttctcaggcacttctataaatagaaaggtgtggtgagggatgtaaattatgatctgcaattgtgatctttcaattatgacatgcaattatcttagaaattcagctacgataccaggcaaatgtttacacctatatcacaaatctgccgctaggtataatccttaaagtctcaaaattagctccatgcattacacagagtaggctgaataaatgattgcttagcaactttagcaaaatagcacaagaagggaagaaaagtactgaaacaggagatccaaccatgatcacgggtctctagtacttaaacactgagatttctgcagggctctatgtgctgaaaaatctcaagtatctcaagagtgtgtcataaatgaagagtgtcagaagtgagcagatcataaatgttcaaaacaagtgtgggagggacctagatgcagggactacatccggaatatacggtgccctctgatgccaatctcattgttttttttttttttttttgtgacggagtctcactctatcgtggaggctggagtgcagtggagcaatctcagctcactacaacctctgcctcctggattcaagaaattctcctgcctcagcctcccgagtagctgggattacaggcacctgccaccaggcctggctaaattttgtattttcagtagagacagggtttcaccatgttggccaggctggtctcgaactcctgacctcatgatctgcccgcctcggcctcccaaagtgctgggatcataggtgtgagccaccatgcccggcctcatcctcttatacacacactttgggtcacacctttgagctttttaggtttcaatgtattctccaccatgaagctattcagaattatccttctcccctaagtcatctaattttccctcctttctcaccaaaaacacttcctcagtaataggcagaggattattacttgaagttgctttttttttttaactgaggaaatgtcaggcatgttattttcagagtgatttaaacagctctagtgttatagctaaacagaaagaacaaagatgctaaaatattaatcatcctgcccagctgcccactgggagtagctgaaaatggcaacgtgctgctgtctcctggcttcatgtctacgttactgcctgtgcagctcacaaacactccctttcctgaacatatggagcaatctcaggaaggaatttgcctcagtgaaccctgactagccaatcaaaaccagacggttccaagttcagtgactaatatcagggatgaattgtgcgtggtgaaaaggaaattttgtgtgccggagaaatgtataccctgagatcagccatatcacaggtgtgcaggatcacctggagaaaatgaacttgagaaaaggcgagttcaaacatttcttcaagcagcacgcctgtcatcacagagtatgaaaaactgaacagcgctatgcggtatcggatcactcgaacaacgacgacaacaatagctgcctttagggaggacttccgggactgaagccagggcagccactgcactgagccctgcatatacgcgatcccatttagtttaatcctcacaaactgtaaggtaggtacaatcacctctggtctacatacaagggatgaggtttgagaagattaagtgaattgctcttccttgcacacctagaaaatggaggaagtgggtatctctgattccaaagcccttgtttttaaccaccatactattttagtattctttttttttttcagatggagtctcgctcttgttgcccaggctggagtgcactggcgcaatctcggctcactgcaacctctgcctcctgggttcaagtgattctcctgcctcagcctcccgagtagcagggattacaggtgcacgccaccacacccggctaatttttttgtatttttaatagagaaggggtttcaccctgttagccaggatggtctcgatctcctgacctcgtgatccgcctgccttggcctcccaaagtgctgggattacaggcttgagccatcacgcccagctattttagtattctttccttctttctcatgccctgatattcataggaaaggtaaaaagcttgtaaattagatggaagaaacattaaaacctaataggtattggctgtgtgggatgccttggaaaacatggtggactgtttccaaagagtggactaaattcattaatcgccctgggagataagtactacttccaagatgaaaggcatttttggctcttgagaaggcccaacatttacacattttaacacaggcatggaaataagcactggagagacatttgctagctcttcagaatccatacaaactgcaaaaactcaggaagagtgctacagatttctagccagtttcatcttaacaggtatagtgatattaaatccccaaattcatttccaatatcaaaagtgacataggcctgtgtccaatatgccctcttctcatcaaacttggcctggcagggttaccaggacagtggtgtggccaggcagctccatgagaacctggggaatctcaattcaaccaaccttcaccaaccacctccgaagcatgaggcattcttatgacaataacaatgcacacttactgagcgtttactatacactaggtggtgtgctaagtcctttacagcctttttttcttttgagatgaagtctggctcttgtcccccaggctggagggcagtggcgcgatcttggctcactgcaacctctacctcccaggttcaagtgattctcctgccttagcctcctgagtagctgggattacaggtgcctgtcaccacgcccggctaatttttgtatttttagtagagatggggttacaccatgttggccaggctggtctcgaactcctgatctcaggtgatccacccgcctcagcttcccaaagtgctgggattataggtgtgagccaccgtgcccggccttttacatgcttttaactcatttgatcctcacaacaaactctgtgaggtgggttcttatttttcctactttataaatgtgataactgaggcgtacagaagttaagtaatttgccaaatcctagaggcttccagagctctctgtcttaatcactaaggctatgctgtagggtctggagggtgaaagcagtacccagcttcaggactgcaacagtgttgcagaggatccagtctcccctgggttaaggaacagaatgaatatccatccactcccctccctgacaacaatgactgcagaaaacaagctaggaagacctctctcttccccttaaggagtgggaagcatgcttggttaattgagagaagagcatcctggagaaaggctcgctttggaaaaggaagaggaaacagggaagaaaagaacaccatgaaggtgaccaaaccatggcttccatgcactcttgcttcaccaaagtgcaggggaaaccctttcccctgaagagggcgttgtgctgcttaatccactctccggagtggctcggggcatggaagagaagcaaggagcaactccaggtggcaggggaccaaggttgcctgctctgaccctcccagttgttccaggcacgtccagggccttttatccagcacagcaactaccatctcccactatttttacaaatgttagtttgaaatggatcttgaagtagtgggagctataggacagattccagttgttttcaaacaagctgtaactgagtaacagtttttaatacagaaggtcctaaaatatacagctgccataataatacacatgtaactctaaaaggcataggagaaaagacacaatattacacattttaaatgtaacacagctatggttagaaatagcgtagaaacaatatagcgaggtttgttttattttgtttttggttttttttgagatggagttttgctcttgtcacccaggctggagtgcagtggcaccatctcggctcactgcaacctctgcctcacgggttcaagcaattctcctgcctcagcctcccaagtagctgggattacaggcgtgcaccaccgcacccggctaatttttgtatttttagtaaacacggggtttcaccatgttggccaggctggtctcaaactcctgacctcaagtgatccagccgcctcgacctcccaaagtgctgggattacaggtgtgagccactgcacccagcaatatagtggttttatctcaaggattaataaacatcttacgaaaatgttaggaatggggtgataacatccagagacttgtattctagttaactcagtccccatccgacccaggtgatttaatactccatacctaacaattttcaaatgcttaaaactggcagatcaatatcccacgtgtggcaggcacagagacgcaccacacagttcctctttcaagcaaggcctttctgcctcagctgctgggagtgctcttggcagacggtcttcaactgccagcctctcaagggcatagagctgccctgcccaaggacccggccttcccagggtgttccccatccaatgactgatcaaggctggggcatataagcccagcaatgtgaattcaacgtgggacaatcctgaaggccatttcggcacccgggcttcccagggggctgtcgtcaaagccagccgctccctctgctaatcctgctgcccagctccctcccacaaatgttgatcccatcagtgctcctcatacgcatcccgcatacaaaagcccctccgaggctgctccccagagaatccaacccgtgcctcaatgcctctatggagaagaaaaagaaattcaattttcaagggaagtggtacaggttaagccagatggttagaaaaattgctttcattgttatcttgggaattttcctcctccaacagatggttaaagctcaacctaggagaaggctgggcagctcagccaaggtggtcatttgcgtggttccaatcagataaaggagcacagaagaactctcagggaggcacactgagctacgtggtcagcctccaatctcctttgagcaaggtgagtgctgtcctgacccactttaaagccagctcattagatatattcccattcaaatctaagtctaagttcatgtctgtctctcatcagtctgtttcatctctctctctcatacacacacacacacacacacatctacccctaaagatgttccatgtctctttctcttcctttccatagaaaactgaggcctgattacagtggtattagtcagttacatgttcataagtgataaaagattaagaagaaataggatcaccttattaatgtacatcccaagtcgttgcttcaaggacaaactctccgtgagcccatcctaaatatatctcccataaacacaaccagttcttcttcctaaagctctctgtccatttctggcaagaaaaaagtaccagagaaaatcctgtttataaaacaaagcaaaacaaaaaatggctactcttgggctctttgattggctgacaaaagaaaatggtaaaatgagtcttcaccttatcgtcacccctagagatggccaagtttggaatgagtttagcaacatgaatcctacacgagctaggagtgaatccagaagcagagaggagggtcactcttggacacaggacctcaaattatcctgttcaaatgacccaagggagtacagaaacaccttggagggtctcctaaattcacctgttcatagatacaaaacgcttatcactgaaacatactctaaaccactagctgttaattcctcaggacataataaattttttttaattgtgcttgtggatttcaaactaaccaaattggttgacagaactgttctacctttgatgtcaattcagttccccaactactgtttgaaatggttaaaataaaaacaacaacaaaaataataaagagtccttatcactgcattcaaaatgctttctcaaagatttcaccctcctggcaggactgtctagatggaaagagaatgtcgtgtctcttcccagaataaaccgttgagaccacattaccttccagttcaagctcctttaaggatttgaaattacttgaaacaactactcagcagcttcagtctctttcttacgctgtctttccctgctcaagcacttggttctaatcagaccacttccttcctgctgctttggtttttattaccaaagttcttcagtccttttcaccaccccatatgctaaacaatttccactttgagaagcacattctcagagaactctgaggataagccaagctcagctaaagatcttcaataatgaatgaaactgtgaagagctacaatttgtcttaagcggctttcaccttctttctgtatctttttccttctaaagagcatgcatctacttttctcaggaattaagcattctcattctttcattgattctccaaacaggaaaagtaacatgataaataagtcatatttggtgtaggcctctatgcagaaaaagctaacacagcaggcctaactgcttttttcttttttctttttttgagacagagtctcactctgtctcccaggctggagtgcagtggcacaatctcggctcactgcaagctccgcctcccaggttcacaccattctcctgcctcagcctcctgagtagctgggactacaggtgcccgccaccatgcctggctaattttttgtattttttttttttagtagagatggggtttcactgtgttagccaggatggtctcaatctcctgacctcgtgatccacctgcctcggcctcccaaagtgctgggattacaggcgtgagccactgcatcctgctttttttttttttttttttttttgacagagtcttactctgtcacctaggctggaatgcagtggcgtgatcttggctcactgcaacctccgcctcccggggcgtgagccaccgcaccctgcttttttttttttttttttttgagacagtctcactctgtcgcctaggctggaatgcagtggcatgatcttggctcactgcaacctccgcctcccgggttcaagcaattctcctgcctcagcttcccgagtagctgggattacaggcgcccgccatcacacccagctaatttttatattttttattagagacagggtttcactatcttggccaggctggtctcgaactcctgacctcatgatccacctacctcggcctcccaaagtgctgggattacaggcatgagccaccgcgcccggccctaactgcttttcttaacaaggcactgctgccaaggttggcccttccctggctggcatcctggagcttggattttgggaaggacccgccattaactggtaagagtggcaatctgtgcctaagctgtatcaatgctctgtttcattaacacctggtttccttctgggagtctgggatgtgggtacatgccagacagggtgcctatgtgaccaagaccctcaaaaaaccccgggcactgagtctctaatgagccttcctggttggtaatatgtcgcacgtgctgtcacaactcatcgttggggtaattctgtgcaccctgtgggattccactgggagaggatgcttggaatcttgcacctggtttccccagcacttcaaccaggagccttttccctttgctgattttgctttgtatccttttgctatgataaatcataatcatgaggataactacagtccattcccgctattcacagtaattatgttccataaagtcaccatgaacactgaattagcaaatactcaactgatgttcctgagggagacatgtacctctatctgtacataccccacacagatcataatattaaatcctaaaaacaactcatcctggtagattccttttttttttttttttcaaaagaaaaaacaaagttctgaagtgttacataacttgcctgaggctgctccactaagaggagccagaggtgggatttaagcctgtctgtctggccccagagccagagtgtccactggtcatccctctctgaggccgaaacaaaaggcagggcatcaccttgttcaacctcggctgggaatgtgcttgtggggtgagtcaaaccttttgccactttatccacgtccatgagtaaatgcgagagtactgctagtattcacttgggggttttaagtacattttagtgggtaggtgagtataagctgaatcctttgagtcctcctagcaaaccactaaacctggaggttgtcttggggacccccaccgtagcctccaaggagagaccaagattccccttcctgcagaggcactgaggaggagaaacagtatgactagggccaaagtggcaagaggtagagcttccagagcaacctgctctttgcatctgtgattactttggctgttcctttgaggttctctttggcctctctttttggcttgcttttttgaagtcccttctccaattcagctgctacagctggatgggcctgtggtagcctccctcttggaggtcaaataggaacagcggtgaatgaagttcaggggaaaggaagccgggtgagtcacccaggccagctgtcccagggcctgaggagagatggccttttccttgacaagtgtttccacagcttttccttggaaaaccctcatccctttctagttagatggcttctcagcctggctgcgtggccagggtcaagaccagtatatgggcctagaagaaaaaagtcagggaggaactagggcagaagcagcaaaaggtccttgtgactcaaagctggccaaacccatcaccagagctaaagctagcagcaaagtcataggacaaacaccatgcatgtgtctcaggatctttttttctttttttttttttgagatggagttttgctcttgtcacccaggctggagtgcggtggcacaatctcagctcactgcaacctctgcctcagcatcctgagtagctgggactacaggtgcccaccaccacacctggctaatttttgtatttttttagtagagacggggtttcaccatgttggccaggctggtctcgaactcctgacctccagtgatctgcccgtcttggcctcccaaagtgctgggattacaggcatgagccaccgtgcccagccatgtctcaggatcttttctgcacagttagcagattcaaagactctggtttccttgctgtaatataataaaaatatagtcatcccttggtatcttgcgggattggttccaggaccaccccttccatatacaaaatccatggatgctcaagtcccatatataaaatggtgtagcatttacatataacctacacacatcctcccgtataactttaagtcatctctagattactcataatccctaatacaatggaaatgctatgtaatagatgttacgctatatggtttagagaatcgtgacaagaaaaaagtctgcacatgttcagtgcagattcaaccatccatttttaaaaaaaaaatttgattctcagttggttggattcatggatgcggaacccacagatacagagggccaagtatacatatgtttggtctttaccccaggttcctggcacagagcttcaaaaacctttggaatttcctgagtgctagacgtgtcttttgttattcatgatgagtctttttggactcctgctaatttctttggggaaattcatctatgaacacatcagataataactcacggtaggctcttagacaatttcaaagaaagggctagccataccaatggctagagggctggaactttcaggccaactcccaacccccagggaggggagggaggctggagatcaaggtcagtcaagtggctgatgatgtcatcgatcgtgcctatgtaaagaagtctccataaaaacccttgaacaaggttcagggagctgctggattggtgaacacatcagtgtgctggggcaggagttgggggacaaggagagggtgatacatggagagggtgatacatggagagggcatgggagctctgtaccaccaccccaacctctataccttgccctatatactgtgccttttccatttgactgtccccgagttggatccttttaataaaactgtaatagtaagtatagtgctttcctgagttcagtgagtcattctagtaagttatcaaatcctgaaggggggtcatgggaacccctcagtttttttctttctttttgagatggagtctcactctgtcacccagactggagtgcaatggcgcaatcttggctcactgcaacctccgcctcccgggttcaagtgattctcctgcctcagcctcccaagtagctgggactacaggtgccactaactgggtagccaacaattcaattctgacattacccagagttagcatcagactccacaggtttaagggcttgatcccacaagactgttctaacttcagataccagccattagtcctggggtatccccaagtactttagtccaactggctataaagcgaagggttcccagccaggcacagtggctcacgcctgtaatcccagcactttgggaggctgaagcgggcagatcatgaggtcaggagatcgagaccatcctggctaacagggtgaaaccctgtctctactaaaaatacaaaaaattagctgggcgtggtggtgcatgccagtaatcccagctactcgggaggctgaggcaggagaatcgcttgaatccaggaggcagaggttgcagtgagctgatatcatgccactgcactccagcctgggcgacagagcaagactctgtagcaaaaaacaaaaacaaacaaaaaaaacttgttttactgaagcctccagaacaccagctgtttcagcaaaatgatttctatagatactatgacctggtaaaaaaatgcaaaagagagagactttgagctccaaacagtagagaaagcacacatggttgcctccttcattccaaagagcacaatgaaatggcagtcaagctatttttgaaagaataaatccatggtggcactgaagacacgaagaagcgttatcaatgaagacatcattttggagattctcttcaagaatagagttgggactgtattgaccaataaaccaaaactgggggtggggaatgggtgaaatacagctggaaatacatcaggctgcagataagaagctctttctttttgacagaaccctggagaggctccaagcttagagtcaatggctattggcagccacagaatggcctacaaagaagtggttataaggcaggaatcagggcatctgagtggagagctgtctacagaacagctgagccagtctgcccacagccctgccctgtgtagactgcagtctgcagtacttgcccccagctggaacccccggaacagccttctctggagaggaaagtttgcctgggagtgcgcatggtgttggtgtccaggctagagaatgagtcaaagaagagcctctaggatagacacaggggtaaaaagaaataaaacatataaaagatgtcaccccaagattggagttctccttatgttattagttttgttatagcaaatggtcctgaatcggcttgtgccctcttttacctaaccatatatcctagaaagaaacctgccgactggcatatcttgcccatttacacagagtacacatcacagcctgtcttcccactcaagaaagaagcctttcgggtaaataaacttgcctaaagggccgcccgtggtggctcacgcctgtcatcccagcacttcgggaggtcaaggtcggcggatcacgaggtcaggagttcgagaccagcctgaccaacatggtgaaaccccatctctactaaaaatacaaaaatcagctgggtatggtggcacatgcttgtaatcccaactactcaggaggctgagacagaagaatcgtttgaagccggggggcggaggttgcagtgaggcgagatcgtgccactgcactccagcatgggcgacagagcgagactccgtctcagaaaacaaaacaaaacgaaacctacccaaatacaaagaaagcctattgcagctacctatacaaatcaatatggtccttcattcataaatatgaagaatcaatgaagaattagcagacgtgaggaaaagcccatagcatgtgtattagtttgtaaaggttgccataacaaagtactacagactagggagcttaaataacattaactttctcacaattcttgaggctagaagtccaaggtatagatgtgagcggaagttgtttcttcttttcttttttttttcttttttttttgagatagagtctcgttctgtcactcaggctggattgcagtggcacaatctcggctcactgcaacctccacctcccgggttcaagctattctcctggctcagcctcccaagtagctgggattagaggcacatgccaccacacccagctaatttttatatttttagtagagatggggtttcaccatgctggctaggctggtcttgaactcctgacctcaggtgacccgcctgcctcggcctcccaaagtgctgggattacaggtgtgagccaccgcacccagccagaggtcatttcttctgaggcctctttccttggcttgtcttctccgtgtcctcacgtggcctgccctctgcatgtgtctgtgtcccacgtgcctctttttcttttttttgtgagacagggtctcactctgttgcccaggctggagcacagtggtgcaatcatggcttactgcagtcttgacctcccgggctcaagtgatcttccgacctcagcctcctgagtagctggtactacaggtgtacaccaccacattaggctaatttttttattattattattatttcttgtagagatggggtctccctgtatttcccaggctggtctcaaactcctgggcctaagtaatccacctacctcgacttctcaaagtgctaggattacaggcacaaggcaccgtgcccagcttcaggttcctctgcttaaaaggataccaggcatattggattagggcccaccacagtggccccatttaaacctaattatctctgaagaccctatctctaaataaagtcacaatctgaagtagtagggggttagtacttcaacatttgaatttggggggtgacatataattcagcccatagcagcataaaagagaaagactaagatgaataaaccaaaacttacctagagaagaaacagaaataacaaaaggagcaaaaacactcaccattttttaaagttctaactagtgccattcaaaggattaaaaagtttacaaccttatatacacacttgtgtggaaaaaaaaagcaatcatgaacattaaaacctcttggtgtttaaaactatcattctcaaaattttaaaaatcagtgagaagagctgagtaataaaatggatacagcaattgtaacagcagtcagtaaaacatgttggtaaatgtaaataaaatactgactacagaaataaaagggggcttcggttgaaaacaaaacagaagatgaagagtttaaagggaagtttaagaattctaaacttgatttattccaagatatttatttgctttagactttgttagaaaaatgtaaacttaggtatgcatgttaaatatgtgggggtggctgtggcccaaggtgggtggcctgagtatcccattcttgggtggggaagggggaaattttcccataaagctgtcatttcccagcttctagctttatttggaaagcccactttcagctgcctgcaatgcgtaggccctataacctcaactcccatatccacacgggtgtggaaatgcaggtccctaagctacatatgtggtttggttatctctgagggccatgaggcttcactcactcactggtgtaggtaagtttcttcatttctggcacctggagaactccctttgttgctttcaagctcagctaagaatatgagaacagttttttttattttgttgagacggagtctagctctgtcgcccaggctggagtgcagtggtgcaatctcgcctcactacaacctctgcttcccgggttcaagtgattctcctacctcagcctcctgagtagctgggattacaggcgtgcaccatcacacccagctaatttttgtatttttagtagagacggggtttcgccatgttggccaggctggtctcgaactcctgacctcaggtgatctgccctccttggcctcccaaagtgctgggattacaggctccagccactgcgcccagccctgaaatgctatttgaaggccgacttacggtcttttgtatacatgcaaaggagaaacggtatacattagcatggagccctagtcctgtcccaaattactattagcataaatgtttcctgactgagactattgattgtgactaaaaaaacaaagtccttcctagaaaaatataaataccttatagttttcagggcctgtgaggttttcacactgtgaagccctctgcgtcctgtctcatgacccctccacaacttcatctgggtacatgattcttgtcacttgctgttttccagccacattatacatttatgcagaaatataaagccttttgatttctccagcttgcaaagttctctgtagcctctgagatctcacaggagatatccccgttttccctgcgactcttcactggccacctcctcatcagctcccttcggcccattcctgaagctgcagcagctgcctcctcaccatcccttccacagcctcctgtccttttccttgacagtacttattaaaatctgataaaataccttattttgagatgtatttgttgaatgtctccctcccgacactagagtgtaggaatgataaaggaagggacttttagttgttattgctgtttttcactatctaggggaccagtcacacatgcagctggtacttggtaaacacctgttgaatggataaacacccccttgccaatatggctatttcttctccccaaaagtggctaaactctctcagtttagatatgctattggctgtgggacaatgaaaaaatatatatacttaatatatagtataccatatataggccaggcgcggtggctcactcctgcaatcccagccctttgggaggctgaggtgggtggatcacctgaggtcaggagtttgagatcagcctggccaacatggcgaaaacccatctctactaaaaatacaaaaattagctgggcatggtggcacatgcctgtgatcccagctacttgggagtctgaggtaggagaatcgcttgaacccaggaagcagaggttgcagtgagctgagatcgtgccactgcactccagcctgggaatacatgttatagataaagtatgcataatatacatgtattatatatataaatatatattaagtatatattcatgtattttaaatttaagtatagatgtattttataaattatatataatatatataaattatatgcatgggagaattttatgtctccctgattttcagtaaattatatagacaaaattacagaatccataagtagcaaattaagtaattttacattgaaaccactgactctactttatagcatagggtgatggtcacaccgacaccacaagccctaacccccgcctcctgccagctctcctggccccctcctgccagctctcctggccccctcctgcccatgctctctagaccctgggtacactgactgactggccttctctcaaggttctcaaccatgttacgctcctttgcgtaaaggccctttgcctatgcccttccctctgtttgcaagggtcttccctttgcttttcatacaggtaactgctgtttatccttttcaatctgttcaaatatcattttcccaggaaaggcttttctaaccctcaaaccatgccagttcttctgtttcacattcgaataggtccctgtgttatcaccgtctctaactgtgtatctgtgcagtatctgtccagcagctgcctccctgatgagaacaaatactccaggaggggaaggagccgtgacaacagacatgacatgtatatgtggattctggcacagtgcttagcacataataggagttcaacatttgtttaacgaataaacaatttggagaatgtactgaggaaggaaatatattattttggatttaggaaaaataccttactatgtttaataacactttttcttattaggaaaagaaaaagtttatttaatctagattaaaggatagctacggagctagtcagtaaaatgttcaaacagatgtgtacaaatgtggacagcagaaaggtgagttgctgccactgctgctgattttgcacatcaacttccgggaagatcttagaaagtacaggtgactctctaggtcacagatcactaaatggaagtccttccaaaagatggaaagatggcatggggtaggggagaaggatgacctcataaactcattctggtccaaaattctctgagacgaagcaacttgcaagtttatttatgaatgaaatgcagacttgagaagccactccatgaatcctagcagccagccaaagtccgctgaatgaaatctcaataaagaaaacctgaattcagactaacacagccacgtagagaaaaccctttcctcatctgacatcaatgtgtgtctatactccacatttggagggggcaggtgttaggttcctatgccaatttctttctttctttctttcttttttttgaggtggagccttgctctgtcgcccaggctggagggtagtggcatgatctcagctcactgcaagctccgcctcctgggttcatgccattctcctgcctcagcctcccgagtagctggaactacaggcacccgccaccacacctggctaattttttgtatttttagtagagacaggtttcaccatgtaagccaggatggtctctatctcctgacctcgtgatccatctgccttggcctcccaaagtgctgggattataggcgtgaaccaccgtgcccggcctcctatgccaatttctaaaagactgcttgacccataaagtgcctcatgccaccaggaagtgcacccaaagtcctcagcatagctcttccgggttacagctctgggctgtggatgagcgtgtcttcctgctcacgttccacctgccaaagagtaacaggaactccttccacttcaaatcattccatatttcctttaaaggacagcggtttctaactgtcttgcttccttcaaaaggcaaacgtacttaaattctaggggtgtagcatcagacaacatcactcctgccatagccattacgttacacagctctgagctcacaggctggagggcattgtttcaatagatcttccaacccctcccctggtctaacatgtgctcttatcaccaggagggtcaagtgggaataggtcacatattaaaccacatggcatcatactaggatggaaccaaaaatgaagtatgctatagcaggggtcccccaccccaagccgcagaccaacaccagtccatggcctgttaggaaccgagccacacagcaggacgtgagcagcaggcaagtgagcattactgcctgagctccacctcccatcagatcagcagtggcattagattctcataggaggataaaccccatcgtgaactgtgcatgcgagggatctaggttgcacactccttacgacaatctgatgcctggtgatctgaggtttaacagtttcgtcctgaaactaccccccatcctggtccatggaaaaactgtcttccacaaaactggtccctggtgccaaaaaggttggggaccgctgttctatggcaacctagactttaacaaaaagaatcttctaagccaggcgtggtgggacatgcccatagtcccagctagttgggaggctcaggcaggaggatggcttcatcccaggagctccaggccacagtgtaccatgatcgagcctgtgaatagacactgcattccagcctgagcaacacagcaagaccctgtccctatttttttttaatcgtcttacagcaatgtttctcaaacttcagcatttcaaataccacctacagaattttttttttgcctcgttcatatttcatctgtactatttttctggcttatacaagttaaatgaataaagaaattttatattgccgagaaatcagttttcagatgctagccatttttatttctatcacacaatgaaatatacaactattaaaatacaagatctttctctgtatattatctaaaataaatttgcctagcatactttggggaattctgatatcagataatacatgaagaaattccttcaccaaactttcctcacatttcaccagtacatgattaattccattatcaaagtgctaaataaacagtttgagaggcatttgagaggcttctgatagtgacttgtgcaccagcaacgaaaacttctttctgtaaagtctgcttttaagaaatctctcacgcctgtaatcccagcactttgggaggccacagcaggcagatcacctgagacccggagttcgagaccagcctgaccaacatggagaaaccccgtctctactaaaaatacaaaaattagctgggtgtggtggcatgcacctgtaattgcagttacttgggaggctgaggcagaagaatgggttgaacccgggaggcggaggttatggtgagccgagatcgcgccactgcactacagcctgggtaacaagagcgaaactgcgtctcaaaaaacaaaacaaaacaaaaaagaaatctcttcaagagttcagaggagctgtagacacaaatgactataaacatttcttagcaaaagggtggctaacctcaattcaatgacaattcacaaaaagacaccatgattacttctattagattcctgttgctactctaacaaattatcacacactgagtagcctggaacaataggcatttactccctttagttctagagatcagaagtctgaaaccagtttcactggactgaaattgaggcgacccccgcagaagctctcaggaagaatccatttcctggctttattccagcttttagagcttcattccttgtacccttggctcatggctccgttctccacgttcagagtcagcagcgtagcatcctgcttcagtcactgcactgcttcaatcttccgtttcaaactccctctgcctcccctttgtaaggacgtttgggatcgcacttagggttcactgggataatccaggataatctacccaccgtggcaatctggactttgcacatctgcaaagtcccttttgccatttaaggtaacattcatagattccagggatcgggactaggatatctttgggggtcattattcagcctaccacgctgttcttctaaacttttaacatgaaaattcagctgagcagttctaagagccccttaccatggtaaatcactgatgtgtatgtgaaatctttatctgatccttttttggaggcgcagagtcgtattttatcctttaaggagcacagtcatattttctagcacgttcaaaggacacgctggtctcctcaattccaggactgactctacgaatacaattggttttccttatcactctggttcccggtgtgtcacacaaagcagagaggagatgcacgcctggtcccttgtgcctacactgtcagatctcaataatccagcatcttgggcacaggcagggtgggaatgggaagtacttttaggcaaaaataagagcctggccccctttggtaagatatctccgtatgtctgccagctcctacagtggggctgaattgctatttcatgagcaatagtgtcatcttcatcaatgccaaacaaacaaaatgctctcattcaatttagcaaccatgtagtaaacattttctacatgttcacttcaggtagctgtagtgatcttgatttctggaaaaacatgtaaaataacagtttctgaacccttattcatattcattaatttaacaaatatcatcagtcactatttgccatgtgagttagcactagtgatccaacaatgaatagaatagagtgcctcccttcaagggggttccagtgcggtggagaatacagacaagtaaatgtcaatcagtcagtgacggatgctatgactagggaaatacaggatcctaggggagcatgaaagaagggaagatttcttaagagaaaaggatgcccaacctaagctcaaaaaaaaaaaaaaaaaagtcagcagtagctaaagcaagatgtatgctgaggtgggggttggaggaggaagcagagagggaagaacagtaattggcaggagggggaaggtattccagccactgggaaaagtttaatgaaagtatcagagggccgggcatggtggctcacgcctgtaatcctagcactttggaaggctgaggtgggtagattgcctgagctcaggagttcgagaccagcctgggcaacatggtgaaaccctgtctctactaaaaatacaaaaaaaaaaaaaaaattagccgggcatggtggtgcgtgcccgtaatcccagctactcgggaggctgaggcacaagaatcacttgaacccgagaggtggaggttgccatgaggcgagatcgtgccattacactccagcctgggtgacagagcaagattctgtctcaaaaaaagagaaagtgtcagaggccaggcccagcattctggtgcaactgatgaacttgaagtgagtcagtatggtggggtgtgtaattctagtgacagggaatgcaatgactagatcattgagaactagtgtggactttatcaggaaggcattgggagggccacttaaaattaataatgtagctgggtatgatggcacatgcctgtggtcccggctactgaggaggctgaagcaggaagactgcttaagcccaggaattcaagtccagcctgagcaacatgccaagaccttgtcgcttagaaaaaaaattataataagatctgtgttctgaagacaacactgatacaaggcagagaaaggctgagaaggaaataagacacaaggcaaggtatcaggctattgcagtaatcgaggccaaggatgacagtggcccagaggtatgaacagactctagtgatctttaggaagcacagctgacaggacaggacaggactcacctcatgaggaaggagtaactgggcagatgaagaaggcattcatggagaggaaagcatagggcctggcttctatgacatatatacacatacctattctgcttcataaataaaatggaaataaccctcaaagggtaaaaaaatgtatgcctgctgttgttcaaatcagaaagaaaaacaataagtaaactagacagtatcacagaggaaaaactaggaaacttagaggattgatccaggagttctttgtttttgtttttttgttttttggttttttttttttgagacagagtcttgctctgtcacccaggctggagtgcagtggcgtgatctcagctcactgcaacctccacctcccaggttcaagtgattctcctgcctcagcctcccgagtagctgggactacaggcatgtgccaccacacccagctaatttttttatttttagtagagacggggtttcaccatattgaccaggctggtctcaaactcctgacctcaaatgatccacctaccttggcctcccaaagtactgggattacaggcataagccaccatgctcggacaatccgggagttctaaatctgaccagtaggagttgcagcaagagaaaatacagaaaaacagagggaaggaaatgacaaaagaatgtcccagaatggaatctctagattgtaagggatgccaagcatccaaaacagtgaatgaaaatgtacctactttaaggcatgctcataaataaaagatcctaacatgttccagagagaaggaaataactcacctataaaaaatcaagaatcgtgataatgaacggcctaaaagtaacaacactccagtggcaatgggtacagtacagtatgcaccaagatcttagattccaaacagcatttcccaataaaaggaaccagggatccttgaggaaacagcagattccagggataggatagagaaaaaggagagcctgggacattttatgcttccagaaagcaaggaattgctcatagattgtcagggaaacatccaaaaggattggtcaatttgggatatttgagcatcaaaagaatggcaaagacctgcacacaccagcagagatttgttcttggtgtgatgtcatccatcaaatcgtgcctctatgattctttgtgatgctgatctttgtgatgtgattctttgtggtggctcatgccaaaaggtctcagaacatcaattctgttcattttcttgttttggtgttctttttaaaaagctctgctgcgggtggtggctcaagcctgtagtcccaatactttgggaggctgaggtgggaggattgcttgagctcaggaattcaagaccactctgggcaacacagggcgaccggacccccatctctacaaaaaataagttaaaattagccaggtgctatggtgccggcctgtagtcccagatactcaggaggctgaggtgggaggatcacttgagcctgggagatggaggatgcagtgagacgtgactgtgccactacactccagcttgggcaacagagtgagaccagaaccacaactctgggttctggagaagtgctggtggtctgtcatgagccctttgtgccctcccacccatagaggccacctggaactaaagagcactagaatttgtggctgcatgaggggacgtcatccactcagtgttccacttgccaacgcccctagtcagtggccattagggtctgtcatcactgggattttcacttaactgctgatccatttcctcgcttggcttggtcactggcataggaacagggtaattactggggttggtcaggccctttttaattctctatgaggaaattagaaactgaattccaaaactgaagataattcgacctttcagctttgtggttatactctaagtacaacgtattttgttagtaagattttgatacttgattccaaaatgacctagcctattgttttcctcatttaatgaaaaccaaaattcagcaggccggtaaatcacatgcagatacttgcagccaatgtgctgcccttttccagcgcccctgactccctatcactcagatcacaataaaaatccagatggggctgcagccccattcttaacacctacagctatcatggccttttttcgctttaacaaaaggaataaaagctgatgatggtcttggcagggatatacttttttatcctcagagagtctcttttcctgtgactgaaaatggctgactctgccctatctccgaggagcaaatgttcacattagaaaaccaccagcatagctgccttctctccgggaggccaccacagagaaaaccaagtttgcactggcaacgaatggaaaaatacctcctatttgtatatgtacacatgtagccacccgggtatgagatggagatgaggacaggggaggtgtgggggaagcagcaaaagggataggggcaaaatgtgcgagtcgaaggacctctgactgtgactgtgatgctgtgtatatacacgtcgccacgtggatgcgcttctgtgcatgtgggggatttagacctgtaatgtgagcatataagaaccaatacaaagtacagcgctaaatacattgtctgcatattcaacaagggcactgcttctcaaatctggcagcaccttgaaatcatcaggggtggcttcaaaaactactgatgcttgggccccacccctggaggttgtgattcacttggtataaaattactgtggtaggctgggtgcagtggctcatgcctgtaatcccagcattttgagaggccgaggcgggtagatcacctgaggtcaggagtttgaaaacagcctggccaacagggtgaaacctcgtctccaccaaaaatacaaaattagctgggcatggtggcaggcgcctgtaatcccagctacttgggaggctgaatcaggagaatcgcttgaacccgggagatggaggttgcagtgagccgagatcgcaccactgcactccagcctgggcaacaagggcgaaactctgtcttaaaaaaaaaaaaattactgtggtagacagaacagtggctccctaaagatgtccagctcgtagtccctggtgtctgtgaatatgttaggttaaatggcaaacgagccattaagcttgtagatggaatatgggttgctcatcagctgacctcaacatgaggaggtgatcctggattatctgggtgggcccaatgtcatgacaagggtccttaaaagtagaagagggaggcagcagtcagaggtacaagtgatgccatatgagaggcactcaacctactgttgttgtctttgaagacggaggaaggggtcatgggccaaggaatgtagctggacctctcaaagctggaaaatcaaagatatgaattctcccctacatcctccagaaggaagagccaccctgcccatgccttagttttagcccagtgtgactcacatcaaacttctagcccacagaactgtaagacattaagagagaaagagagagagagagagagagagtgtgtgtgtgtgtgtgtgtgtgtgttttgagagtctctcgctcggtcacgtgtgtgtgtgtgtgtgtgttttgagacagagtctcgctcagtcacccaagctggagtgcagtggtgcaatctcagctcactgcaacccctgcctcctgggttcaagcgattctcctgcctcagcctcccaagtagctgggactacaggcgcctgccaccacgcccggctaatttttgtatgtttagtacaggtggggttttaccacgttggccaggctggtctcgaactcctgacctcaaatgatccatccacctcggcctcccaaagtgctgggattacaggcgtgagccactgcacccagccttgtgttgttttaagccactaaactggtggtaatttgttacaacagcaacagaaaactaacacacttcaacctgaggaagctaattttaaaaatcaaattaaaaaaaatgaaaacaacaacaaaaaagaaaactaacacaggtatggcctgggctcttggagttttaaaagcagcccaggtgattctaatatgcagcaaagtatgataaccactaaaccagacgaaagacaagataaagacgtgcggcttgattgccttatgctggacaaagaaacggtgctttcatatgggaacttagtaaatcatcccaccaaattatgcatgtaaagcaccatcacttgttagccatccacccgcagacactgcagcttacctgcacgtatatcacaacacatgatcatcagtttggtggctagagtcctctctagtctcacccatcgaataggctaaatgtccttgggatgaggaacaattgtacaccagataggcagattttctataaagcttactttcctttttttttttttttgagatggattgtcactctatcgcccaggctggagtgcagtggcacaatctcggctcactgcaacgtctgcctcccaggttgaagcgattctcctgcctcagcctcccgcgtagctgggattacacgcatacaacaccatgcctggctaattttttgtatctttagtagagacagggtttcaccatgctggccaggctggtctcaaactcctgacctcgtgatccacccgcctcagcctgccaaagtgctgtgattacaggaatgagccaccgtgcccggcctataaagcttactttcttatcaatactatcacttaaggaaggaactgaccaataactgaattatatgcaaatacataaattagcctgttcgtgttggtaccatcagggaaagaactaagttgtcctctctgtgctgaaactattagaattgtaaagagagaaggcttctccattggatttagtaatctatttatttatgatagatgataaacagatggaattgatttatgacagataaatggaacagcactgcaggaacaaattaactcattcttcccaaggatggagaatagaagtgtctgctgtaggattctgagaagtgcagccctctcttcaaagcaggtgttcgtctatccccagggcttcgatgcttgctcatacatgataacttttcttttttttgagacggagacttgctctgtcgcccaggctggagtgcaatggtacaatctcggctcaccacaacctccgcctcctgggttctagcaattctcctgcctcagcctcccgagtagctgtgactacaggtgtgggccaccacgcccagctaattttttgtatttttagtagagatgaggtctcatcatgttggccaggctggtctcctgaccttgtaatccgcctgcctcagcctcccaaagtgttggaattacaggtgtgagccaccgcacccacctgataacttttcttgaaagccattccatcgtgttattactaaaagctgaaaccttagatagaatactttacattttctttttctcttcctactttgtcttctttagagaggaagccagtttagcagcaaaagcagtcacgttagaatcagaagacctgagctggagtttagctctgtcactcataagcgatgtggtctcagggggccctgcagccactctgagttttgcctctcacacgaggagggtgccgccttcatgatgttgtgtggagatgaaatgaaatgacatagatgaaagggcttagcacatagtgggggctttccataaatgccagcttcactgccactcaacgactccacgctgtcacacgtcacctctacactgcagctgctcccatctcttctctttggctccgccctctccctgagctctggtaccctgtctcccactgtcaactggacatctcccgccggcatctctaattagacacatgcaaactggacttaccatctcacccaaaaaccagtgtctgctctcaagtttcccaacttcatccttaacgtaaaatcactggcaatcccgtgcccccgtatttcttccccctttctgcccctacaacccatccaggccctcctcaagccaagagccttgcagatgcctacacgtcttaaacactccccaatccaccctgcttgcagtttgcaaattcatctttttccaaccagacttgtcacatcaaaccctgaacaaagatcttcaaacccttttttgccctgaagcctggtacataggatcgaagaagagcaaactccaccgggtgtggggatgacaggaggcccacacagcctcagtgtacaaagtgctgagcaatttcatatcactgccacatagaagaaaagctcttgggatgaatggatcataaaacacagtattgttaaaagcagctactgagaactggaaaatttttcaccaaatttctttgcatagtatttaacaactatcatctaaatctgccacaacccccactccaatgcgttaaactgtaacaatcattgacattaaaccactttacatgttgtataatcttaaactcattcaacaaatgctcaagcctttagtatttatgtcaacggcaaatctggtcaatcccagacttattcttaccattttgttcatccaattcattcccaatttcctgccccatttgtttttggcgacttatgatagaggaaagggcatcaaggcctgcgtcctgttctgaaagaaaaaagaaaaataattaactagaaactagaagaaaacaacttaaagtccataagtatacccaggcatataacacaagttgacatataaatcagtcaggaaaaaaaagagaaaagagttaacattattggaacaaaatttaaaaactaaacacctacctgacaccttaaactaaaacgatttccaaaagaattaagattttaaatatgaaaaacaaagtaagatttggaaacatgaacatttaaactttctgatacttaatatataaagagcatgtacaaatcaataagaaaaagactgaatatcccaattttttaaatcagcagaggatacaggcaagaacttcacaataaaaaagaaaataaagttttaacatcgctactaatttttttaaaaatacaaataaaaaactactttttttggcttatcagatgtataaggattaaaaagaatgacaatacctaaggttaattaaattgtgacgatctagaagctcccaagtactatgtaataggtgaataagttttactgacggccgtatttctcaagtgtagactgtgcccacctttttacctgccaattctaagtctaggaatgtatgtaagaaaatattcagatagcatgtaatgatggatatacaaggatattccctgaaacatttgtttcttgtgccagatatcaacttagtgcctctcagcaacaaattccctctttttggctgctctatgaagatgaaccagctgggcacagtggctcatgcctgttatcccagccactttgggaagccaaggcaggaggttcacttgaagccaggagttcaaaaccatcctgcatcaaaaagtaagatctcacctctagaaaattttctttaaaaaattagccaggcagccagtcgcggtggctcacgcctgtaatcccagcactttgagaggccaaggcgggtggatcacgaggtcaggagatcgagaccatcctggctaacaaagtgaaaccccgtctctactaaaaatacaaaaaaaaattagctgggcctggtggcagacacctgtaggcccagctactggggaggctgaggcaggagaatggtgtgaacccaggaagcggagattgcagtgagctgagattgcgccaatgcactccagcctgggtgacagagtgagactccgtctcaaaaaaaaaaaaaaaattagctaggcacgatggcatgtacctgtagtgtcagctacttgggaggctgaggtgagaggattggttgatcatccaggagttcgaggctgcagtgagccatgatcacgccactgcaccccagcctgggtgatagagagaggctctgtctctaaataaaaaataatttgaaaattttttaaaaaagaaaatgaaccaaggctgcttgaatactttttcctttgtcagagtttttgcttcctggctccagcctgcaatcttggcaggctccttcagcaactgcaactccttcagtgcctggccccttcagtgcacagtggccagcaatacccagaaccagcaacttctcccagcacaccccctcctcgggcaggtttataacaagagcgcctccagggaggttcttccccatgaagagtttcccccagcatcccagagggcagatctccaggaggttctgacagcagggcaccacgggggcttctgtgaaattcagggaccctcagctgagccttctcttagccctaggggcgtgggctcctccctggacattctgtctcagcctgagacttggtgattgcaccttatccctgctagttctgttttgagagttcttttgacctcttgttagctaatccctcgttactctaatccctgttaaaattaataatttacattcaactttccctgtcaaatttctctctcctgatcagacccatagtgatatacttataatagtgaaaaattagaaagtacctaaatgcccaaacacagagatgtttataaatttatagtatatccacatagtaaaacactgtatagccactgaaaatcatattgtttatctatattttgatgttgaaagaagttcatatgttttgtttttttttgttttgtttttttgttgttgttgttgtttttgagatggagtctcactctgtcgcccaggctggagtgcagtggcgcgatctcggctcactgcaagctccacctcccgggttcacgccattctcctgcctcagcctcccgagtagctgggactacaggcgcccgccaccacgcccggctaattttttgtgtttttaatagagacggggtttcaccgtgttagccaggatggtctcgagctcctgacctcgtgatccgcccgcctcggcctcccaaagtgctgggattacaggcgtgagccaccgcccccggcccccatgatatgttcttaagtaaaaaagcaggaagctgggcgcagtggctcacgcctgtaatcccagcactttagggggctgaagcgggcagatcacttaagcccaggagtttgagaccagactgggcaacactgtctgtctctactaaaaatacaaacattatctgggtgtggtggcgcatgcctatagtcccagctactcggaggtggatggatcacttgagcatgggaggcagaggtcacagtgagccgagatggcgccactgcactccagcctgggtaacagagtgagaacctgtctcaaaaaaaaaaaaaaaaaaaaaaaaaagatacaaaacaaagtatagtacaacagcttttgttttaaaaatgaaaatgtattactttgaaactttttgcaaatttaaagagcaaagttagtttttgaaaatttaaagaaaaaggtgagttaaactcaagttactcacgatcctttctttaaaatttaatatgtatattttgaactgggggtctcggtcatgtctttgtaaaaattttcttcctctaatttcaggtgctttgagaacactgtgaagctgagtgtaatgactcttgttcaccacggaacacgccgcatgaaggtaacattgtacccctcgcagcttcatttgtctacagggtttttgaaatgactgtttcacataaaggcttatctacaaaagcaaaaatcacaaaggtcttactcgaggtcgcattaacatttacttatattttttccaagtctttttatggaattaaatcatcaaacttagctctttaattcatctggaatttatttaaactaacggtgtgaggtaacaacccctttgtgacattgtttgacacactgtactttttttaactatacaaatgacctgccgtctttagggatcattcacaaggaccattttatagtaaaatcactttataatgaggtcctcttggtctttaataacaacctcttggatggcctccaagataaatccatcctcaaccaagtgctcctataggatgactgatgttatagtaaaattctaaatgcatctgatgaataatctatatatataggactgagggttgagtgtcaacgtggattaaaagataaaaccatttaaaaataggaaaggcaattcctccacagtttccattaggaaaagagtcattaaactcctaaaattgctttatctagtagagacatagattatgaatgaaaaatacactaattacactctttaatctcaaacttgactcattatctgatttagcaacctgatgatcatctaatgcacatgagaaagagaactaaaagttctgttcccctctaataatttgtataagcttagcaattctctccacatctttaagtgctgcagtaaattttcattacacaatccaaagacacagaagattcagataatcgagatgctgtagaggtaataataatcacattcataacctgggcttccccaagtcctgaagaggcatttctaaggggaaggtggtatggctatcttagagacaatgatcaaaacacaatgctgctgactgcaaaaatataaataatcaagaaccatgcatgggcatggtggtgtgcgcctgtagtctcagctattcgggaggctaaggcaggaggactgcttgagcccagaagttcaagtccagccaggggcaatatagcaagactcctgtctcaaaaagaaaaaaagaagaagaaaccataccatgcagtttctttttctttctctttttttttttttttttgagacagagtttcgctcttgtcgcccaggctggagtacaatggcatgatctcggctcactgtaacctccaccttccaagttcaagcaattctcctgtctccgcctccccagtggctgggattacaggcatccaccacaatgtccagctaatttttgtatttttagtagagacgaggttttgccatgttggccaggctggtctcgaactcctgacctcaggtgatccagctgcctcggcctcccaaagtgctgggattacaggcgtgagccaccacacccagccaccatgtactttcttaccaacaaaactaccatcatgtcataactgccaaaatctgccctactctttcacataacccaagtcatgatgatatcacaagagggcaattgtaacataccacactctatcagtcattattctattttacaatgatttgaatttttaaaaatggatggatcattgttacagatagaataatatcccccatgtttaagatgtccatatcctaatccccagaaactatgaatatgttcccttacatggcaaaagggactttgcagatgtgattaaggttaaaaatctgagacgggggattagcctggattatccaggtggatccagtataatcatatgagtcctgaaaagcagagaacctttcccagctgccatcagagggagtatgaagaagggtcagagagagataacttactggctttgaagacgaaagaagagatgtgggagccctctagaagctacaaaaagtaagggaacgaattctccagaatgagcctccagaaaagaatcaagctaactgcttgatctgagccctgtgggacctgcattggactactcacctacagaactgtaagatcataaatgtgttttaagtcactaagtttgtgctaatttattaaagcagcaatagaaaactaatacaatcattttttaaaaatccccttgaaaccattaggtgtttggatatttcctatctgtagacattcagaaatgcaagatctggatagtgggaaactaaagggcaaatgcagtttcaatgaagaaactgcatagaagaaaaaggaagagttggaaaaagaacctgtatattaaagaaacttaagagacataactagttgcaatgtatgggccatatttagatcctgaattgaactacctaaaagaaaacatcacagcacaatcagggaaacttgaatgctgagtatttgattagattcaggaaatattgttaacttcttaaggatgataatggcatgtgactatagttttccaaaacagtatttatcttttccaaacatatttcagatatatattctcaaatatccactgatgaaatgatacgatgtctgggatttgctcccaaaataacctaggggctgggtaggatgggtaggttacgggatggcatatacatgtgaacagattggctatgggttgacaatcactgaggctggaggatgagtaggacaaagtcattatctgacactctctactattacacgtttgaaattttccatagtaaaaagttatcaatattttaacaatacaacagagggacatccctaagagctgcaactacagtccctggattgagtacaagatccagaccccaatgactgtcttcttttcctgtgtctttgacatacatgagacttcttctttttctatgtctttgccccagatctgagcccagctagtggcacggagcaccaacatatttaaatcaaggactgaaatgtacaacacttgtttaaatcaatgaatgaccacagagggagggccctctaggtttacaaaagaaaggaatacagtctctgctagacagaaagactcctggccaatactagagagccctctgagtttacacagtcaaaaaagtagttgatgttgtgttgtccagtgcccacagagaagcaatgaacctttcacatttaacatacagaaggagctctccctcaataaaggaaggtaggaatgaaagagaagaaaatcaggtcacccaggtgcagtggctcacgcctgtaatcctagcactttgggagcctgaggtggggggggatcatctgaggtcaggagttcgagaccagcctggccaacatggcaaaatcctgtctctactaaaaatacaaatattagccagatgcagtggcatgcacctgtagtcccagctacttgggaggctgaggctggagaatcacttgaacccaggagatggaggttgtattgagttgagatcgcaccactgcactccagcctgggtgacagagtgagacaccatctcaaaaaaaaaaaacaaaagaaaagaaaaattaggtcaagctagataaaaagttaatcactatgttagaagactcagagcaagtttaagaatagatgtttttatttttgttttaagattttaggaaaggaatccttctagtctaggtgacagctacaagaaagggtatcttcaaagaaagttttctgtgaagctgtgactgcaagggttcaaaggttagctactaagattccccagtgtgaaatggagtctggctagccaccttctacagccccatttcacatgcaaacaccaagagacctaagaacgcagaaatctagaacgattgcacaatttcctgctagagtctagaaagaacatctatagaaaattcataagactagatgaagctgatgaagaaaccccatcaagaaagacctcctgggtgaaggtggaatgacacttcatacttctccaaggtctgcgatcccactcagggacaagggtgtataataaccaaagcattttgaaacaagaaacaagtacccttgttccttctatctcagggatctttgaggcaattaagtgattgtcatcacccacccatcttctgcctaatgcccatttcatgcttcaaattacagctgaaggggcacagaagccaaattggctaatttgttacgatgaggcttcacttctaggttaggcaaggaaggcattccctgcccttcagtctatgttctaccagtaaactgtaattttgggatgattttcaaagtttctaagggtcagctagagtgcagaatggctaagggattccacgggctaaaggaagtcagaaatgaccttttgtggctctttattttcatttaatgcaggacctggcaaggacgcaaacaaagccatagcaacttcagcacattgtcaagattcttgaggcagagaaaaggctaataagggttctgtgtgaagattacttccattttttgtatttgtccttgaaaaacagctcgctagcaaagaggaatatggcatttctttctttctttttcttgaagcagtcttgccctgtcgccaggctggagtgtagtagcacaatctcggctcactgcaacctccgcctcccgagttcaagccattctcctgcctcagcctcccgagtagctgggactacaggcgcccgccacggacgcccagctaatttttgtatttttagtagagatggggtttcaccatgttggccaggatggtctcgatctcttgaccttgtgatgtgcttgcctctgcctcccaaagtgctgggattaccggcgtgagccaccacgcccagccggaacatagcatttcaaaacacaaaggtaagagcagtggagagaaactgacctgcaacctgcgctgccgctccccgcaaactccacccacaccccacaggccagcaggcttcccaagggtgagaatcttcataaggaagctctgttttggagactgtgacaaacactttgaggagcatcctctcacactgacctaaagcaacccctgaaaatagcaccttctccgggacgagcatactcttcccgactgaaaacagcttttcttggcaaaatgcaacaatgccagaaaatgcatgagtattagctataaggtgctccattcaggaaatgtgagtcctgaagagcgaatggttgtgctgcatgtaaagctgtgttgtttttcatttttttcactttcctccaaatatggtaatgggtgaagtatgtaaaactgaagatgtaagagagtcacggtgtttcactgactcaataatttcactgtgaaaagggaattcgaaatagaatcagatttctgcttctgcccaagatggactgacaggcaccagacttccttctggactgaaacaactggaaaaacaaaacaaaacagggtaaatatacgaaacaacagttttaagacatggacatcaggaaatgaagggcagtgatccctgagagacgggaaacaaatgaggtgagttctaagactgccccggattactacctcataagagttcccaagccatggtgtggggatgggagaacacaggtggaacccagcattttcctcgagttgagaaaagtcccaagaggccatggtggttagaggatgtagggcacaggaccagagaggactgcagagagtactctgtagatctgcacaggggccactttgagtctcgagctgagtgtcattcagaaattagtgactttggcaaggctgcatgatccaagatcaatatacaaagatcaactgtattttgatatacaagcaacaattagaaattgatattttaaaaatgctacttagaataaaagatatgaaggccgggcgtgctggctcacgcctgtaataccagcactttgggaggccgaggcgggcagatcacgaggtcaggagattgagaccatcctggctaacatggtgaaaccctgtctctatttaaaaaaatacaaaaaattagccgcgcgtggtggcgggcacctgtagtcccagctacttgggaggctgaggcagaagaatgtcgtgaacccaggaggcagagcttgcagggagccaagatctcgctactgcactccagcctgggtcacagagtgagactgtctcaaaaaataaaataaaataaaagatatgaactatttagggataaataggataaaagatatataagacacgtatagcaaaaactaaaaggcattgctgagagaatttgagactcaatagtgttaaaatatcaattctcctcaaactaatctaaaaattcaatgtaatcccaatcaaatgcccaggaagctttcttttgtaaaattaaaaacagattctagaattcacatggaaatgcaaaagacctagaatatccaataaaattgtaaaaataaacgaagctggatgacctgtactatcttacttaatgacccatcataaaggtaaaataattaatacagtgaggcattggtataaagataaacaaatagaccaatggaaaagaacagagagtacaacagaaataggcccatacgcgcagcagctcacatctgtaatcccagcactttgggaggccgaggtgggtgggtcacctgaggtcaggagtttgagaccagcctggccaacatggagaaaccccatctctactaaaaatacaaaaattagctgggcatggtggtacatgcctgtaatcccagctactcaggaggctgaggcaggagaatcgcttgaacctgggagacggaggatgcagtaagccaggatcacgccactgcactccagcctgggcaacagtctcaaaaaaataaacaggccaggcacggtggctcacgcctgtaatcccagcactttgggaggccgaggcaggcggatcacgaggtcaggagatcgaaaccagcatggctaacacggtgaaaccccatctctaaaatacaaaaaattagccaggcatggtggtgggtgcttgtagtcccagctactcgggaggctgaggcaggagaatagcgtgaacctgagaggtggagcttgcagtgagcagagattgcgtcactgcactccagcctgggcgacagagcaagactctgtctcaaaaaacaaacaaacaaaccaaacatgatgagctgtcacctcacacctgtcagaatggctatgatcaaaaagaaaaaagataacaagtgttggcaagaatgtggagaaaagcgaatccctgcacactgttggtggggatgtaaatttactgcaaccattatggaaaacagtatggaggttcttcaaaaaattaaaagtgatactagcaatcccactgctgggatttgtaggcaaagaaagccaggcaaataccatatgatctcatttatatgcagaatctgaaaaagatgaacagagaagcagagagcagaggagtggttacccagccctggggtttgggggagagatgaggagatgtgggtcacagaatacaaaatttcagttagacagaaagaataagctcaaaagatcgactgtacaacagggtaactaatatacttaaaaattgctaagagagtagattttaagtgttctcaccataaataaatatgcatgtgagcttatacataagttaattagattgatttgcccattctactatgtatacatattttgaaacaacacattgcaaaccataaatataatttttacttgcaaattaaaaattgttttaaatttaaaaagtcaaacagctactatatgactcactcattccacttgtaggtatttaccccagaaaaaatgcaaatttacgtccatacaaagtcttatacatgaatgctaatagcagctttctttgtaacagtcaaaaactgaaaaccacccaaatattaatcaacaggtgaatggatacacagattgtggtaaatccatacaatggaatacaaatctataatataagagtgaaatgcaggccgggcgcggtggctcatgcctgtaatcccagcactttgggaggccgagtcgagtggatcgcttgaggtcaggagttcgagaccagcctggccagcatggtgaaaccccatctctactaaaaatacaaaaaaaattagctgggcatgatggcgggcgcccgtaatcccagccactcgggaagctgaggcaggagaattgcttgaacccaggaggtggaggttgtggtgagctgagatcgtaccactgcactccagtctaggcagcaaagccagactctgtctcaaaaaaaaaaaaaaaaaaaaaagagtgaaatactgatacacataaccagttcaatgaatcttaaaataattatgcttagacaaagaagccagagccccttcttccccaaaaggtacatactgtatagttctatttatataaaattatagaaaatggaaactaatttatagtgacagaaagaagttcagcagttgtctgggcatggcagggaggaacaataggaagaattacaaagaggcatgaagaaaacttttgggaataacaattaggttcattatttttattgcagtgatggtttcacaggcatatacatatgtcaaagcttatcaaatcatatacttcaaacatgggccatttatgatcatatcaactacatctcaataaagctgactttagatttattttctcctcctcctcctccctcttcctttttattcattaatttttttaaagatgggattttactatgttgcctaggctggtgtcaaactcctacactcaagccatcctgctgccttggcctcccaaagtgtcaggagtacaggcatgtgccaccaggcctggcaataaagctgattttaaaaagcagaattagaaagaataatgtatctgtacatactgacattttaaaaagtccataacacatactaagtggttttttcttttttttcctttgagatggagtctcactctgttgcacaggctggagtgcagtgacatgctatatcggctcactgcaacctctgcctcctgggttcaagcgattctcctgcctcagcctcctgagtagctaggactacaggtgcgtgccaccacacccagctaattttttatttttagtagagacggcgtttcaccatgttggccaggctggtctcgaactcctgatctcaggtgatcctcctgcctcagcctcccaaagtgctgggattacaggcgtgagccaccacacccagccgacacatactaagttttaaaaaggtgtggaattatatatatatatggagagagctaaatatctcatgattccatttatgtaaaataagtatatttatattgaatatatgtatgtgaatgtatacaaaaggtctaaggaaatacatattaatctgtttccagtttgagattggagaaacaatatggagggctttcatcttatacattcctatgttgtttacactttgtataacaatcatgcatacttctgaaattttaaaaatataagaaagtttaaaaaaaaaaagttaaaaagccacagggcaaaagataaaaaagaaaagccaaactgacatattttataatttaaaaaataaaatggagtcttgtgtttggagactaattcccagtcgtgaagctaaagtaaagagcataagcatcaaatttgcttggacttagattcagatctgctctctctgctcttgcccaatggaaaatcaccacttccatgagccaccgagatgagtgacagcaactgtctattcctcaggtatcctgaggcacacaccaaaagctttaaaagaccagcagttttcactccaattttcaatggggatgaggaacaaacaaggctccagtagaaaatctggtggccgggcacggtggctcacacctgtaatcccagcactttgggaggccaaggtgggaagatcatgaggtcaggagatcaagaccatcctggctaacagggtgaaaccctgtctgtactaaaaatacaaaaaattagccgggcatggtggcacgcacctgtagtcccagcttctcgggaggctgaggcaggagaatcgtttgaacccgggaggtggaggttgcagtgagccaagatcacgccactgcactccagcctaggcgacatagcaagactccgtctcaaaaaaaaaaaaaaaaaaattctggcaaggtttctgagcccacactcctcaggatatttagtaccttggataattttctgctgctgttgccggatttcatcaaaacccaagcctctggtctcctctggctcctcaaagagccaagggttgggtgctcctcgcttagcctcttcactcatcaggctggacctaaagaacaatattaaatgcatgatatatctcaaaacatgcagctcaaatgcaaattactcccacaagtgcagaggtggccagccttgaatgctttgaaaattcaattcaaacacaatttattgcatcattagtttatgccaggaactgtattcagtgctggacgagatacaaggatgaataaggcacaagcttggtcctcagaattacagcctgttatagagatgatgggagaacataatatttgtactaatcctccaagagatgtttgagttaataatcctaaaagaagttggtaataaatgaggttcttaaatttcaaaaacagaaggccgaacagcggcctttttattaggacaaagtttgtctcagaggctacgtgaccccaaaggtacaaatattatttctcaagcagacacaatgttgcgactacagattacaatgttgttgttgttttaaaaaaagaccatataatttcccattaaagggtatttggagccgggcgcagtggctcatgtgtgtaatcccagccctctgggaggctgaggcgggcagatcacctgaagtcaggagttccagaccagcccgtccaacatgatgaaaccctgtctctaataaacacaaaaaaaattagccgggcttggcggcagacatctgtaatcccagctacttgggaggctgaggcaggaaaatcgcttgaacctgagaggcggaggttgcagtgagccaagatggcgccactgcactgcagcctgggtagcggagcaagactctgtctcaaaaaaaaaaaaaaaaaaaggagtatttggttgctcagagacagaaacacatgcagggtttcaataccaattttgtgactataatgtagcattcataacagaataaacacattctgatttgtcaatcttaaccttactccctctaataatccatgtgccctttctgcacgagaccagttggtctcgctgtctaaggaacaggaaacacatgatttccacctcagtccccatgttttcaggatttttctcctctcaagtagctcctctcctctccccacctgtctgcattctgtccaagctgagaagatcatcttgtccaggacacgaccttctgaccaattcaacaaagagatgaacattagactcatctttagagctctcaacagattcatgaaaaatcatagaataaatgatgggtgggacatcagcaagatgactgattagagtcagctggtgctcacccgctcccccccccccccacccacctttcttaggaaaggactaaggcaatgaataaacagctaagatttgacttcagtgtgggaaagtgctgaactgcagtggggaagtggagaggcccctgtggtgactgaaagtctaggagggcagcatgaaggcccccagcctctgtggccccatctcttccaccaggactgaggaggcctggacatatgaaggccttctccctgtgaggaaaaggtaagcgggagattcccacctgcccccactgccactgcaaacacctacagtccttattacaggaggatcccccagtccttgcaagttctgagcccagtttggagagctgctgggaattcgtacagttgcactgccccagattaggagcattccccactccccacccactccatgagccaagttactacagcatggcgccatctttagaccacagctccctctggagtgtgccttcctcttggggccagtagccactgcacctttccagcactgggactccattttcatgccaccaaagctacacaggtggctgaactccacaacccagggctcgggaatggctgtgactctggtcctgcaatgaagggaaaccaccctctgcactttcagccacagaaacagtcccacccagggcaaacccactcttgagccaaccaaactgctgcataccctcctgcaagcagaaggccctgagcaactgacaggctagcagagtgactacgctcctgcatcccggatctatgaaacagtcgggcagtgcagccccctacagacatgcccccggcctgcccaaaggccccacacctcaatcagggcctgagaaacaaccctgcaggctgcccctggcagacatacccccaggccagccaagtagccatgtgtccatatctcaggcctgaaaaacagcccatgggtcacccctagcggcaactcccctaggccagccgagcagccttgtgttcatatcccgggtctgagaagcaactcctcaggccactcctggcagacatgcccccggggccatcaagcagacttatgcccacctctcatgcctgagaaatagccctgtaggctgtccccagcaggcattccccacaggagagctgagcagcagtgtgcccatgtcccaaacctgagaaacagcccaacaggccacctctggcaggcatactcccagactggccaagcaaccaagcaactgtgccctcagccagagtaagggcaccaaccccaaccccagcaagtgagaccccaagttggacaacccaccatgtgaacgcatgcatcgctgacctgacaaatagcccggtgaacacatccctggcaaagtcatgccaccaccaccacaaagcctctcagctgaggccactgagacactcacaaatgtcactggcatggattacagttaaagaaactacacaaaaactacactactatgcccacctggaaccaaagccaatgcatcccactgaaccaacaccccaagatccattcatacaaatatttctttccctgcaaaacctaccacataaaattggaagaggcaattattccaccagatgcatagacatcaacatagggatacatcgaacatgaaaaagcaaggaaacatgacacctccaaaggaatacaataattcctgtgtaatagaccccaatgatagagaaatatacaaaatgacagaaaaagaattcaaaatagtaatcttacagtgagatacaagataatagagctagacaatttgatgaaatcaggaaaacaattcatgacttgaacaagaaattcaacaagaagataaataccataaaaaagaacaaaacaggtatcctggagtggaagaattcaatgaataagtaaataagtacaagctagagctttaccaaaagactagaccaagcagaattttatttatttatttttttggagacaggttcttactctgtcacccaggctggagtgcagtggcattatctcagctcactgcaacctccacctcctgggctcaagtgattctccctcctcagtcctcctgagtagctgggactacaggggcatgccatcacatccagctaatttttgtattttttggtagagatggggtttcaccatgttagccaggttggtatcgaactcctaatctcaagtgatctgcccgccttggcctcccaaagtgccaggattacaggtgtgagccaccatgcgtggctgaatttttgaacttgaagacagatcttgtgaaataacacagaaagatggggggaagaaaaagtaaaatggaatgaagaaagcctacagaattcatgggacactattaagtgaacaaatattcacactgtaggtgttccagaaagagaaaagaagggcaaatgtacagaaaacattgaatgaaatagtagctgaaaacttcccaagtcttgggagcttccagatccaggaagctaaaagaatcccaaatagattccattcaaacaggacccctcttaggcacattagagtcaaattatcaaaagtcaaagacaaagaattctaaaaacagcaagagaaggactggatgtggtggctcatgcctgttatcccagtactttgggaggccgaggctggcagatcacgatgtcaggagttcaagaccagcctggccaacatggtgaaactctgtctctactaaaaatacaaaaaaattagctgggcatggtggcaggtgcctgtaatcccagctactcaggaggcagaggcaggagaatcacttgaacctgggaggcggaggttgcagtgagctgagaccacgctactgcactccagcctgggcaacagagcaagactccatctcaaaaacaaacaaacaacaatgacaaaaagaaaccagcaagagaaaagcatcaaatcacctatgagggagttcccattagactaatagcagatttctcagcagaaatcttaccaaccaagagagaataggattttatgttcaaagtactaaaagaaaaaaaaaatctgccaaccaagaatattacatgcagcaaagatatcctccagaaatgaaagagaaataaaatctttcacagacaagcaaaaacgaaggtaatccatcaccactagaccagtcttacaagaagtgctcaagggagtattacatctggaagtgaaaagatcataacagccattataaaaacatgtgacactataaaactcactggtagagccaatatacaaaggaaaaagagaaagaaatcaagccttatcacttcagaacactacccaaccacaaaaataaacagtaagaggaagtaaggaacaaaggatatagaaaacagccagaaaacaataaaatgacaagataagtcctcacctattaataataaccttgaatgtaagtgaattaaatatctcattaaaagacatagactggataactagattaaaaaaaaaaaaacaagactagactcaactatatgctgcatagaagaaactcacctgacctacagacacacatagactgaaagcaaaggtatggaaaaagatattctacgcaaacaaaaaccaaaagcaagcaggagtagctgtacttatatcagacaaaacagacttcaagtcaaaagttgtgaaattagacaaagaaggacattacataataataaagggatcaattcaacaagagaatgtaacaactgtaaatatatacacattcaataccagagcactcagatatataaagcaaacattattagctctaaagggagagatagactcaaatagagtaatagctggagattctaacatctcactctcagcattggacagatcattcagacagaaaatcaacaaagaaacatcatatttaaactacaccacagaacaaacagacctaacagatatttatggaacatttcacccaacagctacagaatatacattcttgtcaacagcacatagaacatggactgaccatatgttaggacacaaaacaagtctcaaaaatttttttagaaattgaaatcataccaagtatcctatttaaccacagtggaaaatatcaataacatgaggaacatgcaaaatgatacaaacacatggaaattaaacaacatgctcttgaacagccagtgagtgaaggacaaaattaagaatggaattttaaaattccttgaagtaaatgaaaatagaggcacaacataccgaaacctatgggacacagcaaaagtagtactatgaggcaagtgtataacaataaatgcctacaataaaaaactagaaagatttcaaataccctaacaatgtatctcaaggaaactaggaaaacaagaataaaccaaacccaaaattagtaaaggaaagaaataataaagatcagaggagaaataaatgaaattgaaataaaaaatgtatttaaaaaatcaacaaaataaaagttggttttgtgtaaagataaaattgagataccattagctagactaagaaaaaaagagagatgactcaaacaaataaaatcaggcaagaaaaaggagacatgacaatggatgccacagaaatacaaagaatcattacaggatactacaaacaactctacaccaataaattaaaaaacctagaggaaatggataaattcctggacacatacaacctatcaagattgaaccaagaagaaatttttttaaaacctgaacagaccaataacaagtaatgagattgaatcaataatataatctgccaacaaagaaaagtccaggactgaatggctttcatactgaattctaccaaacctttaaagaaaaatgcataccaattcttctcaaactattccaaaaaattgaagtgagggtattctacctaactcatgctaagaggccagaataaccctgatatcaaaagcagacaagaatacaacagaaaaagaaaagttcaggccaatatccctgataaatatacacacaaaaatcctcaatactagcaaatgaaatccaacaatacatcaaaaagataatataccatgatcaagtggaatttatccaatgaatgcaggaatggttcaacatacacaaatcaataaatgtgatatatcacatcaactataaaggacaaaacccacatgataatctgaatagatgcagaaaaaaatttgataaaattcaacatctcaattaaaaactctcaataaactaggtatagaaggaaagtacctcaacacaataaaggccatatatgacaaacccacagctaacatcatacagaaaaggtgaaagctttgcctctgagaactagaagacaaggatgcccactctcatcactcttactcaacacagtactggaagtcttagccatggtaatcagacaagagaaagtaataaatggcattaaaattggaaaggagaaagtcaaattgtttctgtttgcagaaaacatgatcttatagagagaaaagcctaaagactaccaaaaaaaaacctctcagaactgataaacaaatttagtaaagttgcagaatacaaaatcaacatacaaaaatcagtaagtggtgtttctataaataatgaactagttgaaaaagaaatcaagaagacaatctcatttacaatagcaatccccccgccaaaattacctaggaataaatttaaccaaggaggtgaaagatctctaaaagaaaaactacaaaacactgatgaaagaaattgaagaggatacagacaaaggcaaagttatttcatgctcatggattggaagaattaatattgttaaaatgactatactacccaaagcaatctacagattcaatgcaatctctatcaaaataccaataacattcttcacagcaatagaaaaaaatcttaaaaatctgcatggaaccacaaaagaccctgaagagacaagcgatcctaagcaaaaagaacaaagctggaggcatcacactaccagacttcaaaatataccacaaagctgtagtaatgtactacaatgctgtttttatgatactgacataaaaacaaacacacagaccaatggaacagaatagagaacccagaaattaatccatgtatctagagccaactgatctttttttttttttccgaggcagagtctcactctataacccagctggagtgcagtgatgcaatcttgagtcactgcaacctgtgcctcccaggctcaagtgagcctcccacctcagtctcctgagtagttgggattacaggcacacgccaccacactcagataatttttgtagagacggggtttcaccatgttgcccaggctggcctcaaactccaatctgcccacctcagcctcccaaaatgctgggatcacagatgtgaacccagccaagcctactcatttttaacagaggtgccaagaatactcactgggggaagacagtctcttcaataaatggtgttgggaaactgaatatgcacatgcataagaatgaacctggacacccatctatcaccctaaggaaaaaatcaactcaaaatgattcaaagacctaaatgtaaaacccaaaaccataaaagtaccaggcaaaaacaaggaaaacacttcaggatgttgatctgggaaaagattttatgagtcagacctcacaagcacaggcaacaaaagcaaaaagaaacgaatgagattacaacaaactaaaaagcttctgcacagcaaaggaaacagtcaatagagtgaaaagacaatctataggagaaaatatttgcaaactgtttatccaacagaggattaatatgcaaaatatgtaaggaactcaaaatatctcaatggcaaaaatcataataataattggatggaaaaatgggcaaatgagctaggcatggtggcatgcacctatagtcccagctactcaggctgaggtgggaggattacttaagcctggataacatagtgagactctatttccaaaaaaaaaaaaaaaaaaaaagatacacaaaatatgtgaaagacagacaaatgatctgaccagacatttctcaaaaaatgacacacaaatgcgccaacaaatatatacaaattgctcagcattactaatcgtcagggaactgcaaatccaaatcacaatgaggtatcatctcattccacttagaatggctatcatcaaaaacacaaaataaatgcttgtgaggatgttgtgaaacaggaactcttatacacagatggtggaaatgtaaactagtacagccactatggagagcagtatgggggttccccaaaaaactataactagagctaccatatgatccagcaatccccctactgggcacttatccaaaggaaagaaaatcagtattttgaagagatatccacacccacatgtttactgcagcactattcacagtaggcaaaatatggaatcaacctatccaacaacagatgaatggataaagaaagtgtggtatacatacacaacggaatacaatttagccataaaaaagaataaaatcctgccattcacagcaacatggatggagctggaggacgttattatattaagtaaaataagccaggaacagaaagctaaacactgcatgttcttactcatacgcagaagctaaaaacaaaagttgatctcatagaagtaaaaagtagaacagagcacaccagaaactggggagagtagggagaagggggagagcaagagatttgttaagggacacacaattatagttggacaggaggaataagtttgagtgttctattcaccactgtaggatgactacagttaacaataaagtctccagtagctagaaggacgatatagaatgttcccaacacaaagaaatgaaaaatgtttgagattatgaatgtgctaattatcctgactggctcattatatattacatgtatgaaaacatcactatgtaccccataaatatgtataattattatatgtcaattaaaacaaaatgataggctgggtgcggtggctcacacctgtaatcccagcactttgggaggccaacgcaggtggatcacctgaggtcaggagttccagaccagcccggccaacatggtaaaaccctgtctctactaaaaacacaaaaattagctaggcatggtggcgggcgcctgtaatcccagctacttgggaggctgaggcaggaagaattgcttgaactcaggaggcggatgttgcagtgagccaagattgcgccactgcactccaacctgggcaacaaagtgaggctccatctcaaaaacaaaacaaaaacaaacaaaaaacaaaatgatgacaatgatgttacaatagcaataacaacagttaacatgcagtaagcatttgccctgtacagacacggctccaggtgatttatatatattcactcatatctccattatttataattcttctagccttgttcacatctcccatatcatccagaaacaattgctaccctattatttaaccttttatatagataaggtgcatatccactagacagaaggcagaaactgaaaatcacccttcgctgtacacacgctgtcccacaatatggagtgaacagctaatagcatatcacctactggcaacatatgaacagaaagtagctggaggattcaataatttttcattccaaaaacatttacttcgtagttattatatagtcggcattgctctcattaatgggcatgaagaaaaaatagaatatagacaaatggaccaaaatctccacccatacaaagcatagattcttgttatcggtgctgtttgcattctggtgggatgaaacaatgtgtaaaatgtgtgcaaactgtctaatgtcgtacttggaagatgttaactactatcataataccaattattgcatttttttacacagaaggcactaaaaaattttaaataaatctgtatatcacaaaagctatattaatttcacttttagtttagaactttaaagcctttggaagactatttcatgtagcaagagacaaacccaggcaaaactggaagaaaatttttgattccttagactaagattttaagcacagagttggtctcaagtatactaattagcatgccaaacagaagtatgactttcttccactttactaaaacgacaggtgtgtttctttgaagtctttctctctctctctctctctcattcattcattcatccattcatttatttgaaacagggtctcactctgtcacccaggcgggagtgcagtggtacaatcatctctcaccacacccttgacctccagagctcaagggatcctcccacctcagcctcctgagtagctgggactacaggtgcgtgcctctgcacctggctaattatttttattatttgtagagatggggtctcgctatgttgcccaagttagtcttgaactccagggctcaaacaagcctcccaccttggcctcccaaaatgctgggattacaggcatgagccactgtgcccagctggaagccttactttatgccattggcaccaaatagccaagatgtcaagattttggatttcttctctataataattattcaatttcacgtaccttcgaagaagggggaagaatgcaataggaaagggaaggaaagaagaaaattcacattcaaagcctatcccaactctcatatcatcttgcaagagccacttttcaaatcaggaattacacaggatttgtccatggtttactgcaaatgcaagtgggtcagaggtatgtaaagatactttgaaagtgcattagtaaccagctatgaccatcaaaatgagtatattgcccctgaggtgttattgctcctctgaacttaatgttggaaccagtcactggtagctcctgtgagccctagtgcatgcttttaaaaagctgttattcaaggggaaaaaatgtaaaaatatttttttcacaatctcaaaaatgacacattagaaccacagtcatatatatatatatatatatatatatatatatatatatatatatagacacctgttagaaaataaacacctgttagaaaataaaagtgacaatatgggcacaatttaatactaatatcaaacatacatcaccacagacatatatagaaaggatttcccagggttatctgattcccaaggctgaactgtctaactccacttctctctggtttgtttggtgtttctactttcctgatgccccaaacctatgaggaaatccagcaatttcactcactgaccttcactcagaaaagcaggtaagatcatgagatcataggtatccctggatgtacacccgattctcttttcatttggttttatgttcaatttaacatttggggtggtgcctattattactgttctaggtactaggaaaatacgaaaaataatatgaaaacataattcttgctttcaaggagtttataatcaaattgaaatgagaaactcaccaacatgaagcacactagttaaaataagagagcatctagctttgtatccctcctgggcaattccaaaaacctcttcagctctggttttctcacccataaaacaagcaaactaagtgggccaatggttttcaaccttctttctggcccaacacttgaggatatgatacccttgttattagtgacattggggagtaagtggggaagactcatcttggtgggagaaagcagatattctttttaatcctgcaaaagatgatttcctattgttgcaaattgtgaattagattttttcaatctcctctcaaatgttgtctcctcagagaggtttccctgactcctccatctaaaataacatctgtctctgtcactccttcaccccactcctccttatcttgcttaatttttctttatagcactgaagtcaccagccattatgcatttgtttgttttctgtctcccacgctagactataagctccacaagggcagggactaggtcttatcactccatcctttatcacattatggctggcataatggacactgaaagaaaaacatggaattaattattttttcagcaaaacccataaataaatgaatgaaatcaataaggagagttgtcaggaaattacagtatcacacattggtgctataatatgttttgtgatttcaaaggcatttcacaaacattatctcatgtgaatcgcacacagccctgtgtgtaagtcagcacaggtattactgacaagaaaactaaggcagagacatccagtggcttcctcagggccacccacctagtggcagagctaagggttcagcccacatcttgtgattcttaacccaaggcatttcctttctaccacttcagaggtttcataaaggtaaggaggttgagcacagtagttcacacctgtaatcccagcactttggaaggccaaggcaggaggactgtttgagcccaagagttcaagaccagcctgggcaacaaagcaagacccctattgtaaaaaaaaaaaaaaaaaaaaaaaggcaaagagacttaaggcagccttgaagaatgcgtgaggtttagtgaagaaaggaagagatggtaaggcattccaagaaaaggcaaaaacacgaatgagtctccaggaccaggaatgtgtaccacataaacatgtgtgatgtaagagtggagagtgggcaaaatttgggggggctagatttagaattaattccgaggtaggtagctacagtgaccctccatttgttctaataacttatcctcctattatcccaggatctcataattttaactttctactagttcttctccatcctataaatcctcaagcaatgactttctctcctatttgcagccaaacttccatgaagaataacctatgctcaccaactccacttcctgacccccgttcactcctcaacccactgcaagccaacttctacccctgcacgaccaaaatcttctcactcacagcctcctcactgccaaacactcttcccaggtcttaccagacccctcctccaggccttaccagacccctcttccaggcctcatgtgtcacagctaagcttattatccccctttccatgaatcctctcctctcttggcttcctccacaccactctctcccactgacagctccttctctataatttgcaggtacctcttcccccatctgcctctgaaatgtgggttccttgggaattcgacttagatctgctcctctcacggtattgtgtttctctgggcaagtctatctgtgctaggggcttcaggctgtaggaacagatgctagcagccaggcgtggtggctcatgcctgtaatcccagcactttgggaggccgaggcgggtagatcacgaggttaggagttcaagaccagcctggccaacatggtgaaaccccgtctctactaaaaatacaaaaaattagctgggcgtagtggtgggcgcctgcaatcccagctactcgggaggctgaggcaggagaatcgcctgaacccggaaggcagaggttacagtggagccgagatcgtgccactgcactccagcctgggcggcagagcgagactccgtctcaaaaaaaaaaaaaaaagaataaatgctagcaatgcttaaagacattcattctatgcccagcacatatgaaatcagacacattcccttgagtcattatggtggtgaattctgaactaggggtggggagggacgtgctctccttcctagcaggacaataccagaatctggagggtttggggggagtagcacacaaatagttaaaaagaaaccccacatataaaaacattcaggcaaagcacgtcctcccaccccttacctgattgaaaatcacggtgctaaacagacttacaaatttgtctctacccataatatctccctacaggttctttatctgcatttgtgtcttttcatttaaaaatctccaactgggtattcctccccaaactcaacatatccaaaatcaaattcatgactctcaccccataagctgcttcttctcgtacgctctctattttggtgagcagcatcactgtattcccaagtcatccaagccatttttttttttttggtctcccttctaaccacatctcatcaacaaacaaggcctccctcagagatggttctcacatccaagccctgactgccctccccattggtactgccttggctcagacacccatcacctctcatgtacaacatggttacagccttctgatcggtctccttgtccccagttaccctcattcaaatcatcctacactctgctgcaagaattattgttcttaaaacagagatctcaccctatcacttccctattcaaaaacttccctgactccccagaagctacaacatggctacgatctctctacgacatcatctcctcaacatccccgcttccacaccctacttcggccctccagactgctccccaccgctcagacaaaggcaaaactttcacactctcatgtttttgcatgagtctggagtgtccccacccccaccccctttgtccatctggcaaaattctattcattcccctaaggttcaactcaaatgtcaattctgctgcttaggctttcctgatccctagccccatcccccttcccttgaatcaatcactcgctggtattcccatggtgctatgttcacaacctctaacgtggcatttatcaagcgggattgtagttagttatttactcatctgtctcccttcctaaattatgagctctgtgagggaagaggccacatgacagttatgtttatatccccaggaccaaaacacagagcctcggaatatgccagagcataagcattcagtaaatgtttatgaaccagaactaggaaaaccattgaggtttttaagctctctttcttaaaaacaaaatgagagaagcatttaacatttttatcttgaaatgttttttaaaaatcaagcaaagcaaaacttaatcaactgctacctgccttcaagacttcagcagcaaagactgatactgtttgagcagatggagagaattacttgaaagggaatttggtcagtaaaacaccttgtagctcagcctcacttttggaaatgacaagtaagaggcatttttcctctgcaaaggaaattaaagaaaggaaatgctaaatactatgcttctgagcttagaacagacttgaatttttttaataaatgatttctatccatattatttcaagatgaaacttttcaaataaatgaaacttatcaaataaatgccacatcagtaaatacgttagatatcttgtcttatcaagatttaaccaaaaagtttcacaatcacttctaaagacataaaatgatttcattttcatcccccaaagaaaatgatgtacattatttaaattatgataatatcgggggggtgcacagacaatccatgtctttctacagacaaatgaagttgaagcttgttagagttcataggaagggcgttcttatcaactgaatacagaattgaaatagcagtgaattccaagaagtagctttctttagcctttcttagcgtttcaaaaagatgtcaaagtgactatataaaatgtttgttttgtctggaaaaaatatcagtgtttgggcattcacagaccacagggaggtttgcagttaggatgagggaagatatttctggggtgtgagtgagctgagtctgcaaagcttcgtaactagacttgcctatagatttgaaaacactcctatgatataaaagggtaattcctttttcagaactttttttggtagttcctttctgtgaatataaagatgcacagaggctcaaatttcaattagaaatagattctttgacagaaattctttagagacgaagtctggcaacaatacgcagactggattacacggaagagaggctgcagtcagagaggcaggccaaaaggccagtgtggtaatttaggtgggaggtaacaggagtctggacaagggaagtgacaagagggaacagagagaaagggacaattaacatagtggctcaagggaaattccacaagtgttgatgaatagactggatatagggaataaagattgccaaacctatgtgacttgaagaaattgacacgacttcaggaaaaggaaattttttcattacctttcaattttcaacacagcacttaataacaatcccagagttaaactggtccttcaagagatcatgattatgtaggaatatctgtagccatatttactaaactgttaacatctttcagtccaatactctgtcctactcttttctgtatcccatccacccttccatccatccatccatctgacaaacactgaatatcttctatgtatcaggcactaatctagtgacttgtaagtgaacaagagagacataaatacctgacctcatggagctaatactcaagggacaataaatgcctaacattgtgccgactgcaaagttgatactcaaaatattttttgttcaaattgaataatctccattgagtattagtccagaacaaataagaatcagaacaaggaaaatatcttccttacataatatccaaggaaatttcactatagcacctttaaaatctattacaatcaaatattgttctaatttaaaagcaatcctattttttcctattcattgcttgccaaatttaccaataaaaagttttaacactaaatgaaaaccttgatgaaacagttcacagaagaatagaaatacagggtagaaaaggccatcatttttttgggtctccaactcaaatttcaaaaccccagggcactgctcctgagagtcacacaggccatcttaagcaaaaaacaaaaccaaaaggaacacttctgtaccttaaatgtttgcaaatcatggtaccttaaaagtagaagaggggcaaaaaggggtgatacacaaaaaacaagaattccaagtaaaagatgaatgagctgctctaccatatttatggtgactgagagccatctgctggttacagtttagttacaacagtccaggagggccaactattgcaggcagcttctctattacatgatgcatgcaacatgcttagaaacacaatgcactggttctcactcctgtgaggaagcttaaaaaagtttcctatcggccgggcacggtggctcacgcctataatcccagcactttgggaggctgaggcaggtggatcacgaggtcaggagatagagaccatccaggctaacacggtgaaactccgtctctactaaaaatccaaaaaaaaaaaaaaaaaaaaaattatctgggcatgtggcgggtgcctgtagtcccagctactcaggaggctgaggcaggagaatggcgtgaacccaggaggcggagcttgcagtgagccgagatcgcgccactgcactccagcctgggcgaaagagcgagactccatctcaaaaaaaaaaagttgatatcatacaagcagtgagtaggatagtggttaccagaggctgggaagggcaagaggttgggggaaggaaaggttggttaagggagacagggaacagctggatggcagaagtgagttctggtgttctgtggcatactaaggtgaatacagcaaatgataatttacagttttttgaatagctagaagagaggattatgaatgttatcaacacaaagaaatgatacaggtttgaggttatgggtatgctaattaccctgatttgatcattacacattatatacatgtatcaaaatatcacactgtaagccaggctcggtggctctcacctgtaatcccagcactttgggaggccgaggcaggtggatcacaaggtcaagagatcgagaccatcctggctaacacagtgaaaccccatctctactaaaaatacaaaaaattagccaggcatggtggcatgtgcctgtagtcccagctacttgggaggctgaggcaggagaatcactcgaacccaggaggcagaggttgcagtgagccgagattgcaccactgcactccagcctgggcaacagagcgagactccatctcaaaaaaaaaaaaaaaaatcacactgtaccccataaatatgtacacttatatgtcaattaaatatatatgtacatatatatatacacacacacacatatatatatttaaagagaaacaaatgcgcaaaagtcaacagaacttatataatatgagggagttggtgttcctagagccatgcctttttgacaccatctgcaataacaactctccatcttcttccagttggttcttcacaaccaaacacagttatgataaatccgttgagtgtccagtcaagatgagcaatctacatttgctttaggcattcggcatacctaatgatttccatctttgtctcaacattactgttttcactttactgtacttgtttccattctcactcattttataaagtaaaggtaaaatgcaataaaatattcaaccaattgtgcaaatcaatactgttctatgaacaaagatgtgagttcagtgaaacaaaattatcagctggcaagcagtgccaccatcaataatattaatagaaatgtgtgtttggcagctgatatacaaaaatccaaattaggcattaaaaggccatttaagagtgtcaatgaataatgcttatgcattcaagatgcacaaaagccaaggaccacctacatcgtccatttttcacctcagtgaccttactgtttattataccaattcatctaactcatgtctaaagacaacaaattttgagatggacacccacattttcaattctggcatcttttccctctggaatgtgtaagctccctcgggtaacttttatgcaaccagttgggtgccaatgtgcggactgatatggaaattactgttctaaaaagacaggattcaagaagatacacaaggaggaaaaacaacacatgatgtacaaatttctacccacttgcggtatcaatttctgtctcagtcctttcaggctgctataaccaaatacctcagactgggcaatttataaacaacagaaatttactgctcacagttctggaggccaggaagtccaagagcatggcataagcagatacggtgtctggtgaggactttttctctgctccatgggtggtgccttctacatgttctcatatgtccaaaggggcaaggaagctcccttcaatcttttttttataagggcactaatcccattcttgagggcagagtcctcatgacttacttccccgaaggtcccacctcttaatactatcacactggagattaggttctaacatatgaatcttgggaggacactactattcagaccatggcaaagggtgtcaatgaataatgcataccattcaagacatacaaaagtcaaggactgcctacatagccatcacttccacctcaataaccttgatttgctattattacaccaattcatctacttcatatctaagaaagcaaattatcaagatggacacctattttgatttgttttgttttgttttgtttttgtttgtttgagatggggtctcactctgttttttttttttgagatggggtgtcactctgtcacccaggctggagtgcagtggcacaatcttgacttactgcaacctcggcctcctgggctcaagcaattctcccacctcagcctccctagtagctaggactacaggcatgcaccaccatgtctggctaattttttgtattttgggtagagatggggtttcaccatgttgcccaagctggtttcgaactcctgacctcaagtgatccacccaccttgacctcccaaagcactgggattacaggcgtgagccactgcgcctggccaacacccacgcttttaactatgtcatcctttccctctgtgagcagggcccaggaatgtataagctccctcaggtgacttttatgcaatcagctgggcaccaatgtgcagactggtatagaaactaccacccttgaaaaagcaggattcaagaaagtacgcaagacagaaaacacatggtataaatacatggtcttctcagcctccccccactgcccacattgatttctccattttctcttttctttttttttttttgagacggagtctcactccgttgcccaggctggagtgcaatggcatgatctcggctcactgcaagctccacctcctgggttcacaccattctcctgcctcagcctcctgagtagctgggactacaggcgcccgccaccacacccagctaattttttgtatttttagtagagacggggtttcaccgtgttagccaggatggtctcgatctcctgacctcatgatctacccgcctcagcctcccaaagtgctgggattacaagcgtgagccaccgtgcccggcccagatttctccattttctaatctcccagatcatttatggctcatatcacacaaagtggcatttcactatacactatcatgtatggtccagagttgttttgtgcaagatagaaagacatccccacatggcctgctatctctgtactcccttctgctaagacggtgagtgctatcgttcattaatgtctatagaacactttccagtttacaaagagcctccacatagatttatctcatttgaacttcacaacagtttgaggaatcatggttaccttcattttcctgacaatgatgtgtagttaaaactcaaaccctggttgtctaataccaaatcctttgctccttccacagaatgacacaaggcaaacttagcaatatgccacacttgaacacctggtggaatactgtccctacgaacagggtaatactgtccctgcaagtgtgaaagacgaagtattcaaagccagtgggaaaggaatacatgagggcccctgaaagggaatcatggtaagatttcaaaagtacgagagacaaagcccaagggacaaaacccagggcaaaggatgagaggacctgggttctagttctctctcttccattgattcaccatgggcacaacgacttctctaagaatcagtctcctcatttgtaaaccaaaaaagtaatcgcttgagttataacaccgtatcagaaagaaaaaagtcaaacacacatgggagcgttgaggcctaagaccgcccccacccgccactccacatgcatcctacatgcacgtcctggaaccaacactcatgtatgcttaggggtgactgtaatatatcaaaaattgctcggtaaacagagaagagaaagagggagaaataacttttattttcaacaaacaagaacaggctttttaatttcttaaaaatttttacttaaagaaaacacaagttggaaacattttttaaaattaacaggctcacgcctgtaatcccagcactttggggggccgatatgggctgatcaagaggtcaggaaatcaagaacagcctggccaacatggtgaaaccctgtctctactaaaaatacaaaaattagccaggtgtggtggtgcgtgcctgtaatcccagctactcgggaggctgaggcaggagaatcgctgggaggtggaggttgcggtgagctgacatcacgccattgtactctgccctgggcaacaagagcaaaactccatctcaaaaaaacaaaaacaaaaaaaaagtaacgtaatgaggccaagcatagttcacacatctgtaatcccagcattttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccacagtccggcctgggcgacagagcgagactccgtctcaaaaaaaaaaaaaaaaaagaggctgaggcaggaggattgcttgagcccaggagttagaatccagcctgggcaacagagagagaccctgtctctacaaaataaaaatatattagccaggcatggtggcatgtgcctgtggtcccagctacttgagaggctgagttgtgaggatcacttgagcccaggagttgcaggctgcagtgagctgtgatctcaccactgcactccagcctgggtgacagagcgagaccctgtctcaaaaaaattaaaattaaaattaacataatgaactaaaatacagcgtgattaggtaattctactttcttcttcccgtttattcagaaactggagttttccttctttttcaattctcaaatgatttttttaaagacttaaaattaatacatgcaggggcaaagaatgtttttattttccataccaaaagtcacaactataccagtagttaagggctgcaattcaaaagaagataccattttttacccatcagagcaacaaaacaaaatccatcaagttctgtaacgcccactgacagctaaggtttaaggaaaggggccctcacacagattgctgaagggaatgtaaatgccacaacttttaagaaaaagacatggtggtacctattacatctttaacactcataccttttgtcccagtaaccccactttgaggactctattgctaaagaaatagaagccatggtctttaagaatatttactgcagcactcgttgtaatggcaaaaaactaaacaacccaacgtccatcaaatggggagtggctggaaaaatgcctgcatatttatattgtggaatacaactgacgaatttgtcagacacatcaacttggaggaatgtccaaatttaagtgaagaaaagtaaaattacagaggaaaatgtatagtacagttctgttttctttaaaaataggaaaggaaaactttttttaggtatgtatgtttgtaaatttatagttgtataagcatagataaatgtggggaagggaaactccaaacagccaatcctggttacttgaggagaaaggcactggaggggcagaaagggagagagagtatgaacttttgagttacacattggtatgttttgacttttttgacacggactctcgctctgtcgccaggctggagtgcagtggcgcaatcttggctcacagcaacctccgcctcccgagttcaagcgattctccggccttagcctcctgagtagctgggattacaggcgcgtgccaccatgcccggctaatttttgtatttttagtagagatgtatttagtagagagtagagaccatgttgtccaggctggtctcgatctcctgacctcgtgatccgcctgcctcaacctcccaaagtgctgggattacaggcgtgagccactgcgcctggcttttttgacttgttataatgtgcatgtatcatgtggattgcctattttaaacccaattacagggtcatttccccatgatggaagcagggagggaatacggaaagggaagaaaataggaaaacaaagatctacaaaataaatgacaacttaagtagaaactattagaaagaggtattaaaagcatccctcttcgttaaaaaaaaaattaagaataggagataaaaactaaaatcaagaaatgccaaaatcatgcatatttttccagagggaaagagaaatacaagagaaaaatatgaaagaaaaaggcaagaaaagaaggcgaaagagagagaaagaaacaagaataaatgaagtggggatcgggcagaacctacagagtcattacgggggaaatataaaaatgacaaactggcttacagggacatggagggaagagggaaaccgttacagaaagaactggagggtgatataattcctttcctaaagttaagcagtattaataccagcaatcttaacattctgtcttaactttatagggagaaaaaccctaacttttcaaaatctagcaactgggatgggctaagtttgcccttctgttgacttacatctccatcttgtggtctgttcaggacatagctcttagagagagagagagagagagagagagtgtgtgggtgcgcacacgcatgtgtgtgtatctgtatgcatatgcatgcaaatatatgcaaatatgtatgtatataaatataaccatatctactcacatgtgtaatacatgtacatgtagtatataaatgcacatatttgcacttattctttaattcaagtagaacttacaaacagaaaaatccccagtgtacagctcaaagatgattcacaaagtgaatacccacagttaaccactacccacagcaagaaaaagagtattaccagaaccccaggagccctgtcatatacccttctagtcactacttcccccaaagggaaccgctttcgtgatttataacactgtaagtctcacctttataggagtggcatcatatagcatgaactgtgtaaactcttctgtctgacatgatgtctgagatccatccatagtgtggtgtacagttgtagattgttaattctcatttgctgtgtgacatcattgtatgaatatgccatcatgtatttattcattatactatagatgttcattggattatttccaggtgagactactaagaaaagcactgtaaacagagacgcctgtagtctcaactactctggagactgaggtgggagaatcgcgtgagcccaggaccttgaggttacagtgtactatgattccatcagtgaatagccactctactccagcctgggcaacgtagcaagaccctgtctctaaaaaacaaaacaaaacaaaaaatagcactgctaggccgggcgcagtggctcacgcctgtaatcccagcactttgggaggctaaggcgggcggttcatgaggtcaggagatcgagaccatcctggctaacacagtgaaaccccgtttctactaaaaaaatacaaaaaaaattagccaggtgcagtgacgggcgcctgtagtcccagcaactcgggaggctgaggcaggagaatggtgggaacccgggaggtggggcttgcagtgagccgagatcgcgccactgcaccccagcctgggagacagagtgagactccgtctcaaaaaaaaaaaaaaaaaacagcactgctataaacattcttgtacgtgccttttgtatagttccatttcagcaaatacagttttccatttcagcaaatatggttttccaaagagattgtacaatttacagtcccagcagtagtatatgagaactatagctgctccacatcctagcaacacttgacatgtctgtcattttaattttagccattcttgtagtataatgacattgtgacttgactttgcatttacttgatgactagtgaagttgaacaccttttcttacattcatcaaccattgaatatcctcttgtgaaattcaagtcttttgcctatgtttttctaacaggttgcttgcctttttcttgacttatagggattcttcatatatccaagatacatttcctatgtcaaatattaatatatgccctgcaaatacagattttcattctgtgacttgtctttcaatcattgtggtatcttttgataaaaagaattttttgttttaatgaaatccaacttatcacttgtttcctttatggttagtatgttttgtggcctgtttaagaaatctttggctatcccaagatcataaaaatgttctcctgttttcttctaaaagctctctggttcaacccttcacatttagatctataatccttttggaattatttcttatgtagggtgatagcagaggccaagattcatttttttccatgtggatatccagttgacataatgccatttattgaaaagattacctctgtcataaatcaggtgacaatatatgtgttagactgcttctgaaccctctcttttgttccacgggtttatctgcctatccttgtgctaacaccacactacagctttgtggtgagtctggataactggtcatgtgagtcctctggcctttttgttcttaaaaattgtctcagcttttcttatctctttgcattaaccatataaacagtggctgtaatcagcttctcaagtggcaaaacggaaacaaaaatctggctggggactgtaagtgggtttgctctaaatctataaatcaatcttgagggaactgatgactttacaatattgagtctcccaatctctgaacaaggcacagagactgaagagatctgagcatggtaagaccccaccccgacttactcaaagtttcactttccagagtttcagttacccacactccgaaaatattatagacaataagatattttgagagagagagagagagaccacattctcataacttccattacagtattaaactttaccatgggtatatattcacaagtaaaaatatagcatatacagggctcagtactacccaagctttcaggaatccactgagggtcttagaatgtgtcctctgcccttaagcaggggactactctttatttatctcttcagctttacttaatttccctaaataatgttttatagttttcagtgtagaagtctcatacatctttcattttacttatttctacagatttcatgtttttttttttaaagtactatgacagcagccttaaaattttttcatttgatttttctttgttgtctagcttttaaaaccttctgaggagagaaactaccaggttgctactgctaaccacgtgtggacaggctgtgcttcattttctttcacatggtaatggctggatacctttcttgacttgatcaatgacatggagttgcaatgaccatttgttcagatctcaaggtctctggttttctttgctccatcagtcatccaaagagataatctttctttacatttagtctctatttggaagtcaggctgttaatagagcttcctttcctatcccatggtgagggaaaaaaaaaaaaatccggactaagtagctacagagatctcttctggcgataatcagtcttgtgagaacatacataacctaaaaacttcgaatagctactctgtcaagttcgaaggtagtttcaagatacttaagagtattactttaagccttctacttcgtcatctccaagatacactgttaagtaaaaaagatgacgtgcagtaaagaatgcatattatattataattcctgtttttttaaaaaacacaaacaagttggaatagagactggggatatgggcccgtgcatgtatccttggatacgtgtagaatccttctggaagggcacacacacagaaaactgttaaaagtggctgcttctggggaagaaaatgggaaactgtaggtgagaagtagaaagagcctgaattttcattgattacaattttgtacagtttaacaatgtaacaaattactttaaaaataaatttatatttaaaaaacattcttcaaaaacaaatattcattcccataaaccactggaatggtcaacattttgacctaacactatcaaccaaaccgactcttccaccaagaagagtcccaaaaaatacctcatcatatgacatatctagtttctctctccaagaaaaacatggtcactgtacacattatatggctggtatcagaccattagttaagcgtattaccctaaacattctgcttcatcgtcttcaatatatactgtgaagcaaaaaaaagatgatgcagcataaagactggaaaaaaatgtgctaaggcaacatatattccaaattttttttatcagttcctacttcaaatactccctttgtcattctatcagtccttgcaccaaattatctattaacatttcaccagaatgtgtagaaaaagtcagaagctactacttctcaaaatagaattaaacaagaattaacaaaatatatacaagattatctgtctgcagaagaaaccagctctatgaaactgtatcaatgtgtcacgttaaaattgcttgcaggctggtcacgatggctcacgccttgtaatgccacggctttcggtggccgaggcaggtggatcaccggagttcaggagttcaagaccagcctggccaacatggtcaaaccccgtctctaataaaaatacaaaaatgagctgggcagggtgatatgtgcctgtagtcccagctacttgggagctgaggcaggagaatcactggaacctcggaggcagaggctgcagtgagccaagatcgtgccactgctccagcctgggtgacagagtgagactccatctcgaaacaaaacaaaacaaaaaaaccgcttgcacttcaaaagtacttctcctaagcctcttcaggaagacaagtgataggtgtaaacatcccagcttctttaaaaagtgaattgaagacttaaagtaatgactaaggttcacttgagcctaaataaaacaacccaaaaggccagcgagtgactaactctctgggatttcaataaaaggagaagtgacaagaaagaaggttcttaatgaggtcaaagaattgaaccttgagtctctggttcttcaagaaacttcaagaacagcgttgctattgcttagggagttgcagagaagggttgatacagacactacaacttgcctacccaacatcagtatgtctcatcttccttgttatcagaacctcaattttgttcagggctccactgctcagagaccataacctcatcctcattttcagctcaagaatatctccctcctgaactaacctagtcaaccacagcaaccccattctcccatcgtttttggtataacatgatcatgtgatacaatagtctatttctattttgagccagagtcaattaggcagcttccaggaagcatttcattgctctttaaaaagaaataactgaaaaatacaaaaaaagccaagataaaaaaatgctaaaagctattagagaattaagaaaatggctttaatattaataacggacattaattattgatagttttcatataaacaacaacaatagaaaagtacaatttaaaaaacctggatttaaaacagcaaccaaaaagattaaaaaaaaaacaaataaatttgaccaaaaacatgttagacttttgtgaagaagacgttactgaaagacctgaaaaatgccttggagaaacaaacaaacaaacaaacaaacaaacaaatcccacaatcttggatgagaaaattcaacattgtaaaggatttcaagatttaacacaatcccaattgtttttaaaagttgttctctcttttggaattacattagctgattctagaattcatgttaaaaaataagcaaaactcggccaggcgtggtggctcacacctataatcccagcactttgggaggccgagctaggcggatcatgaggtcaagagattgagaccatcctgccaacatggtgaaactccgtctcttctaaaaatacaaaaattagctgggcatggtggtgcgcacctgtaatcccagctacttgggaggctgaggcaggaaaattgcttgaacccaggaggcggaggttgcagtcagccgagattgcgccactgcactccagcctggcgacacagtgagattctgtctcaaaaaaaaaaggcaaaactcttaaaaagaagtttaatggcagatttgtcctatcacatattaaaacttaaagtatccatattttagaaaatgtggtactagcacataagtagacagaaggaccaatggaacacattacaaagtccagaaatagatcaaaatacatatgggaacgtattctatgataatgcagcatcttacatctgaagatgagaagatgaactactaagtaaaaaatatcgtcagtcacaaaaatagaatagagccaagtaggaaaaacgtaggattcatactcttcaccaattaaattccaaatggatcaaagatttaacagttataaaaccacagaagtaccagaaaaaagcacaggagaatttctttataaccttggttcactatagttatatataataattacataaaactctactaagatattactatataaaactctctttatatgttagtctggagtaggatacaaaagtttaacaactttctttgggaaagactgttggaaaacaggcactcacctaaattgctggcacaagtctagaggggttctaccccgctagaaaataacttgtgaaatgctattgaaattacaaacgcacataccctctgacccagccatcctacttttttttttttttttttttttttttgagacggagtcttgctctgtcacccaggctggagtgcagtggcgcaatctcggctcactgcaagctccaccttccgggttcacaccattctcctgcctcagcctcctgagtagctgggactacaggcacccgccaccacgcctggctaattttttgtatttttagtagagacggggtttcaccgtgttagccaggatggtctcaatctcctgacctcatgatctgcccgccttggcctcccaaagtgctgggattacaggcgtgagccatcgtgcccatcctccagccatcctacttctaagaactcacctagagatatactttcacatatgcaaaatccctctactatatttttgtaatagaaaaagactgaaaacaatactcgcatatatataagagcctagttaaatgacagtaaatgcatacaatgaaatattataaggctacaaaaactaatgacaaaaccttacgtcacgattgggaaaatctccaagatattcgatcaggtgacaaaagaatgttgcagaatgctatgtatgatatgttaccatgtgtgtaaaagatggagggagataatatattcctatttgctggtatgtgcttaagagaaccctagaaggatatgccaaaaattattgagagtaattacttatgttgaggagaaggagacatagtgggaagatttttcactgaatcctgttcaatgctttgcagatttcttagccatatgaattatattacttatgcaaaacacattctcctttctcttctattgttatgcttggagtgtggctgggaactgctgtagctattctgagaccacgagaggagtcactcggaagggaaagccgacatcgagtatcgggagatgaagggaaatgaagagacagcaactacccgaagccctgacggcatcactgggctgtcaatcaaccctctcacttctctaacttgcaacttacttcacgggatgtttttccctatttaagccattttgagcagggtaatctgttatatgtggttgagagcagccaactgctatactagtctagagagctaaacccaggcacccccttaacaatcgtcagtcagagtgggtcaggacaataagcacaacctgcttttccagactcctttgtcctcctccctgaatgctgaagaaacaaccttcccttctggtgttcatcacacttctacacacccatctgcactaattccactgtgctgtgatctgtctttgtatacatttccccttcctgagtaaactctgaactctgcaagaatgggcttattattatttttttttttttgagatggggtttcactcttgttgcccaagctggagtgcagtggcacgatctcagctcactgcaacctccaccttctggtttcaagagattctcctgcctcagcctcccgaatagctgggattacaagcgcccgccaccatgcccggctaattttttttattatttttagtagagacggggtttcaccatgttggccaggctggtctcaaacccctgacctcgtgatccacccccgccctggcctcccaaagcgctgggattacaggcatgagccaccgcatccagccaagaacgggcattataaatgacaaactaatccccccatgggcacctcttagcccaccttgcgtggcttcagtaacttctgattctaatcgttgctcaagaagaaagcagcaaggctgcaccaaagctatttgtctttccatcaaactacccaaaataattagcgaggcagagacaaagctgcatgcttcaccaggccctcctcttgagtatacagaaagactacatcccccagccgccctcagagctaggttggagccacgtgactagttatggccaaggggctgagtgtgtgaaacttgcaggccaaggcatagaagacagatgtgagttctccacaccctcattcttctccagtcacagggaacacgcacgccttgtgtcatgagagcacagcccagagatggaagcaacctgaagctcggagtcacctttacgtgacagactttacacgaggcaggcaaaaaagctttcatgtattaaaagtgtgacattcgcaggtttgttaacacagtctatcacgtcctggctcaatctttctgtcaacaaacatgtgctgaatcaacaacacacctgctgtatacccaactctgggctggatgttacggaagatacagaaaagtgcatgaagacgctcattcattgagcaattacttattaaaaattgtgctaggctttggtctctgtccttgaggtatttaaaatatagatcaagagacaaaatatacacttgcaaaagagaaaagcagttaagtattaaccatacagtctccctagctaaatcagcttcctattaatatgctctcaaaatacaatctatttttttgaacttattttactgattgtatgattctttatttcatgtctgtctctctccctggactgtacatggctcaactgcaaaaagtaggtgcttttgtagttttggttttaccactacactcccagtatcagtgtatagcacatagtaggcactcaataaagatctacttaatgaaggaaggtttgctttaccacatttttacttccttacctatttttcattaaactagcaggaaactgtaatattcttgactgtacttagtaactccttggggttcaactgcccctacactcacgtagaggacaaagcaaatctgtactgatttcagcacacccttgcacatcagaaaagctaggacgtcactgtatttcagggacatacataaaagagagaagggggtttatgatatggatgtatattccttagcaacttccttcttctagaagagtaggttggtcacgtggtaacaacattaagcaatgtgaagtataaatcaatgattctttaggaaatctaagtactatgggacataaatcatccttcttgtaaatcaacatttaaattgaaataaaacattcaacggtttcaaatggggaggagcatttttaatgttagaatttaatgtaaatttttcttttgcccatcttggctaccgatatactgatatgaaatacacattggaaatatcatgttttgtcagtagtgcaagagaaaagcctatctctaaaattaaatttaaaaatctgcactctgagaaaacgtagacgtttcattatcatcttcttttgattttagcaattggtctgcttgttaatatatccttcttgacatacaactaccacctcaaactctaaacaacttcctattccctataatcctctacagagttggtggtgtgaagattaaagcttagccaattagccacccactgcagctgagttaatcacataatctttgagatggtcacagagcagtggagtatgcaatggttttggtttttttttttctctttacaggcaaagatttaactaattgtgagatttagcaatgctctcgaatataaagggcgggagggttttaaatcagaagctgtgtcactgctttatgagacagggcttatcttcttctaagagacactgttgcacagagacttctttaacaagtttccaaataccctaaattagtcaaccattgcttatttagaccaaggcttactgctttagaataatgaccagtaatccgtaaggtaaaactaagattctgtcacatgacagctatacattcaattatgtgattgccacattaatgtctgtttaaaggaaatgctaatccaaactgaagtttgaccattcttgactctccttaataaggccacatatgaggaagaagagaaaagagggaaaagagggatggaaaggccctcgggaatgagggatggggaagaaagagaggaaaagagcgttgtgcaaagtaaatgaaaaagagggaaacagaggtaggggctctaggaagggaggctcaccaggttccaagcgagtcctggtagggtaaacagatcttgtggcattgctgccagttactagggaaatgttgattagcagattaaccccagttctctaacagtaaatgtgttgtggtcatggtctagcattcctgacaaaatgtgccatagtgagcacgtctataacatttcaaagttctgacaaggctttctggccaccatgcttctggaagtcatgaattaagggaaagacacctaccctccactcacaaagtgacaaagcaacccaactgaccccccccaccccaaaaccaagaactacagaagcaaagaaaaatgctggaggaatccagagattagagaagcaaacgaaaatgttggaggagcctagaactaggaattaactgtagagaggactaaggaaatctctgcaagtcattggagatactacagaaaccaactggcagagaaaggaatgagtttctccaaagatagatagagctgagcgttccctaagagttggtattagaaatgactaggcaactgacaatcaggagggaaggggatacaatcgaattgtaattgaacatgtcatataatgaacaagtcatgtttacaactgaattaaagtccttggaaggctaggtccaacaagagaactattaggtatgagaagttggggaaagaaggggaggtctcaaggatggggattaggagtaaagaaggcaaaaataatactcttacataggcaggtgaaggaaatcaaacaacagcaactctgacctcaaatctaagaaaatccacttccagcagtccacttcagctttagcattcactcctccatacacttcttgctggtcctcgataggtccacatggtgccatcttccctgactagttggagcaacgctagctagctgggtatttgttctcatggcccttgagcagatttcccggggacttttctacatagcttatgagagtgcttttgtctagtatgaattttcttattgatcagacttctctggaatgtctacaggacttgcactttttggacaagcatatgcggacatgttcccgttacggtgttgggtctaaagcaatcctagcccaacaaggaatcaccaatggaagtgaatgagaaattcaccttccaggccaccgacatcattctccttcctctctgtatctgcaatgattttctttcttcatggtgctcaatgtccagtcgccacattggtttcccgctcttggccagactccatgtcatccagaacggaccatcattgtgtgttatgtccacgtctaccttctccaaatcactccacaggagtcatttctccttgacagtacttacattatttttaaacagaattcttctagaaccttattctgaaccatcctagacttctggtcctgaacagaaaagatacaccaatctctatgttgcccttggtttcatcttgagagcatgtaaataagtctggccagtaactttatttcaaccctcagggattcagttacctttgcttgacagtgtctccccagtatgatctctgtccccatgccactcagccattcaccaacacaccaacaagcaacagctttagtccaccacatggatcagccttatgggcatgaagagcagaaggcagtcccagtggcaggacccaagaggtcctcagaaggcctccatccaaaaaaaccacctgacactaacctgccaaattccctaaacattcccatcaactaattcactgtggtttcaatcctagggtttaaggaggtttcggtgaaaatacctccagaagacaagacattggcagccgttgattccactgctagaattaacatgagattgttcactaataagacaataggcagcaagctgggcacggagggaagcagacacggaacaaatgagatgtggaagaggagaatggagggcagaggaccaggtgcagcgtatgatggggtcagacagaccacgtccttctagagcaatcagggggcagggcacgagggacagaagatctccgaagcaatgaggcagcctgagttccctcctagccggatggagacacaatgctccagtaataacatcttgtatttataaaggtcttagagtttacaaagcctgtctcatagcaatcacttcatctggtcctaacaacaacgaaaaatgggcagcacatgtatccccagtctaaggtcaatgacttcaaagcccacatgactgacagactagaaagctacagaactgggtccttctaacacctcatccagctctttttatggtgcaatggttacaagttcagagctaaaatccaagttctatgactgattagctttagaatcttgaaccctctgagcctgtttctcttctgcaaaatggggcattataaagagctcctgagcaaatgcacataaagagcttagcacagtgcctaccatataaaaaacaaatagcagacataagctataggtctcatgactagtacactgtgacatagagcagtcgttctaaccctgccacctactaaaaccacccggtagtctccccagccttactgctgcccaggcctcacccaagactatgaatcagactctgcaagtacatggtctaaacatttgtatttttttttttttttccattctctcttgggtgattctgatgcaaagtgccacgattaagaataaatgacacaggccaggtgtagtggctcatggctgtaatcccagcgttttgggaggctgaggcaggcagatcacctgaggtcaggagttcaagaccagcctggccaacatggtaaaacctcatctctaccaaacatacaaaattagccaggcgtggtagtgcgtgcctgtgatcccagctactcgggaggctgaggcaggagaatcacttgaactcgggaggcggaggttgcagcgagctgaaattgtgccactgcactcaagcctgggtgacacagcaaaactccgtctcaaaaacaaaacaaacaaaaacaacaacaaaaaaacaagggccgggagctgtggctcacgcctgtaatcccagcactttgggaggccgaggcaggcagatcacgaggtcaggaaatcgagaccatcctagctaacatggtgaaaccctgtctctactaaaaatacaaaaaattagccgggcatggtggcgggcgcctgtagtcccagctactcgggaggctgaggcaggagagtggtgtgaacctgggaggcggagcttgcagtgagccaagattgcgccactgcactccagcctgggcgacagagcaagactccatctcaaaaaataaataaataaataaataaataaataaataaggaataaatgatacaaagcagttatttcttaaattgtaatgtgcattcaaatcacctgatgatcttgttagaatgcaagttttaattctgtagtttggggttcgggttggaaaattctgagtttgtaacacactgccaggtgatgctgatgctgcttatcagcaagtcacactgtaaaggacacagagatgatcagagaagaggggtgacaaaggcaggcaagcggggaccaaaaactaacaaaacaaacaaggacctggtgggaagacttcagaggtcctcagcctaaattcctaggttggccccttcagcatcattaagtggcacaattaatgagaagcaaagagcagagtctggtgcaaaacatgctcttctcaaatgggaaccatgactattcatcacgactgcctcatcactaccaagcagaatagtctgaatgttttgtcctctttctgaccatcatctgtctacatgaccactattcctccatgaaacaagctccccgtcctacctatgtccttattaatttcttgactaaaaagactctgccttcagtgtaaagccccttctagaagacagttttttggtttttttttttgagacggagtcttgctctgtcgcccaggctggagtgcagtggcgtgatctcggctcactgcaacctccacctcccaggttcaagcaattctcctgcctcagcctcctgagtagctgggactacaggtgcccgccaccacaacggctacttttttgttgttgttgttgtattttagtagagatggcatttcaccttgttgcccaggctggtctcaaactcctgagctcaggcaatccacccaccttggcctcccaaagtgctaggcttacaggcgtgagccactgcacccaggcgacagtactttcttttcacctttgattcctttgctcacctgttctctttgaccaacctggaccaccaccttcatccacatacttcacccctgtaccctgggactgaatatgccagggaaatattgggaaccacagtagattggcccagcacaggcttctatcttcatttaaaccctgcccaggagactgccaacagagtatcacccctccctaactgactcttaggttcatttcttcacagaagcaacttaacatttcatctaccttcctgtatttcacagtttcttcatggaaccttggatcgccgctcctgagaagactggaacccacaggaaaatcagtttcattttcttcagcttgttctaggcagttgtttgcaatctgggttgtatattagaatcacctgagacctccctgcccctctgcccctccaccgcaatcccactctggttcacctgtcagaggtggagtctgacaatgcacggctagggtccaaaaccactgcccttgggaagccacactattcctaactggaaaccaactagaaacaagctcctctccacgataaatgcatcaaccctagcgtggaagatgaggagaggcgggtttccacccaagctcattgccttctgtgatggttcccacgatgaagctaaggaagttctagaaacagggggaggccaattctaaagaggtagcaatttacggttcatcaacctcagccttggaaagcccgacccgtcctccaggtcttccagcagaaccgggctcagagcagctgtcagctctttgaagtgtgaatcactcactggcgaagaatggggaggaggatccaactcctttgcctctgtgagccccggaccagtcttattaggactcatgttctcaatatgccaattaaaaaaaaaaacaaaaaactgctttgcccacacagagaagtagtgacctcaggagtttagaaggcagttaacaaagcagaaaactcaaccaaagaatgccaaagaaatgttctgacttcacccacagtctcccttagtatgttccacccaagatgggattcagctgaacatacctggtttactaaacccagaaaattaacgaaaactggccgggcgcagtggctcacacctgtaatcccagcactttgggaggccaaggcgggcggatcacgaggtcaggagatcgagaccatcctgactaatacggtgaaaccccatctctactaaaaatacaaaaaattagtcgggcacggtggcggtgggcgcctgtaatcccaactacttgggaggctgaggcagtagaatggtggaaacctgggaggtggagcttgcagagagccaagatcacgccactgcactccagcctgggtgacagagcgagactctgtctcaaacaaacaaacaaaaattaacgaaaactaaattgagtagaaaattatagtcaaacaccataaatgaatagaatagattttgattaattcctaaagtaagccattcaggaaacagctgtagtatctgcaaagaagtcttcgcccaccaagtaatccctgtaaataaaaacatcctacctgattagatctggttcggcaccctcattcttaaaggatgccagaagtagtctctctcgagttacaagatcatccaagaggttctgtcttcggtccccttcaagctgtgttctgcagatatcttgttaaggttcaatggtgaataaatgacctcgttttaactattacattattaagttagctcttcaagtcagttgtggcttttacagactgtaatcactactacccagaagggatgcgcaccactcttgcgtttttcctgctctgaccttcaccttcaccaggccgtcaggtaaaggaccttggcaggaccatcgcagaggcacttataaacactgacgtggatcatgacacaagtttttcattgagaaatataccaggtaaatattactttcctccccgtgaccaaacttatttacttatttttgagacagagtctcgctctgtcgcccaggctggagtgcaatggcgcgatctcggcccactgcaacctctgcctcccgggttcaagcagttctcctgcctcagcctcccgagtagctgggcttacagacgtgcaccaccacaaccggctaagttttgtatttttattagagacgggtttttgccatgctggccaggctggtctcgaactcatgacctcaggtgatctgcctgccttggcctcccaaagtgctggaattacaaggcgtgagtcaccacgcccagccccagtgaccaaatttaaatgacttctcctgccaatggtgcaacctggctcagtgattccttaggttttgagttatatgtgtgtgtcagtgttccagggcattttcctacatattaataccctaagatgctctgtttaaaaaagtgggggcgctgggggagagaagttctctatattgctctctttcttccatgttaatatctattaacacacctaggatatttataaagtgctactttatgcaacagatttgctctataaattgttaccatcagttcactatttaaatacattgcatgatttgtaaagaaaattacaaagagaatcattttaatgtgtgaatctagcaaacacgctagactaggagccccagaggcagagttgtagccctattccactatctatgctcttgaaccagttatttcaccttttgggatctctctttctttatatgtaacactaaatagtctctaacatcttttccacaacaattcataagtgatggttaaaaaaaaaaaaccaaacaaccatccttctgggaaatgtagtctttggaaagaaacctacaattcaccaataggtggacgagaatgcggcgcgtgcgcatgaagcaaaaagggaagtggcgtctgtcaacaaccggcgccacttcccttggactaagtacaaagttttatatactagctttcttgatgcaaactacaaaagtggttttttttttttttttttttttttggagacggagccttgttctgtctacaggctggagtgcagtggcgcgatctcggctcactgcaacctccgccacccgggttcaagcgattctcctgcctcagcctcctgagtagctgggactacaggcacgtgccaccacgcgcagctaattttttgtatttttggtagagacaggttttcaccatgttggccaggatggtctcgatctcttgacctcatgatccgttcacctcagcctcccaaagtgctgggattacaggtgtgagccagtgcgcccagacacaagtttttgtttgtttgtttttaggctgaactgtgtctatgtgtgtggtatgttaagaaacacagaagggctggacgcggtggctcaacgcctgtaatcccagcactctgggaggctgaagtgggcggatcacaaggtcaagagatggaaaccatcctggcaaacacggtaaaaccccgtctctactaaaaatataaaaactagccaggcgtggtggcgtgcgcctgtagtcccagctactcgggaggctgaggcaggaaaatcgcttgaacccgggaggcggaggttgcagtgagccgagatcgcgccactgcgctccagcctggtgaaagagcgagactctgtctcaaaaaaaaaaaaaaaaaaaagaaaaaagaaacacagtaaaggatatgtttggaaacaacttctgccataaaatgaatgagtggagaaagctaacaaacacttttaaaatatatctggccaggtgtggtggcttacgcctgtaatcccagcaggtcaaggcaggtggatcacgaggtcaggagttcgagaccagcctgaccaatatggtgaaaccccatctctactaaaaacacaaaaattagctgggcatggtggcgcacaatcgcagctacgcaggaggctgaggcaggagaatcacttgaacccgggaggcggaggttgcagtgagccgagactgtgccactgcactccagcctgggtgacagagcaagactccgtctcaaaaaaaaaaaagaaaaaagaaaagaaaagaaaagaaatacacactaaaacaagataccacttccacctatcagattaggaaactgagaagacagttttggaaagggacaaggaaccagacactctcatacattctttccttttcttttcttttcttttttttttttttgttttgttttgttaagatggagtcttgctctatcatcccaggctgaaatgcagtgttgcaaccttggctcactgcaacctccactacctgggttcaagcaattctcctctcagctccccaagtagcagggattacaggtgtccaccaccacacccagctaatttttgtgggtttttttgagagacaggatttcaccatgttggccaggctggtctcaaactcctaatctaaagtgaccctcctgcctcccaaagtgctgggattacaagcatgagccacttcacctgaccttatacattctttctttattattattattattttttgagacagtgtctccctctgtcgcccagcctggagtgcagtggcatgatcttggctcactgcaacctccagctccagagtttaagcaattctcctgcctcagcctcccaagtagctgggattacatgcacatgccaccatgcccagctaatttttgtgttttcagtagagatggggtttcaccatgttgtccaggctggtctcgaactcctgacctcaagtgatccacccacctcggcctcccaaagtgctgggattacaggcatgagccaccatacccggccacctcatacattcttgataggaatgcaaacaggttcaaccaactgctagactgccttctaaatacctaacaaaatataaaaggtacagtctttcaacagacatttcttcctcagatacagtcctacaaggacttagaagcaaggatgtccactgaaccattatttataatagccacattggaaatatcaataagtaactagtgtatgtaaacaatggaatgttttgcagccttaaaaaaagaataggaaagctgtttagggggctgataatgataattaacatttttgagcacttactaagtgtttacatgaattatttgacatggaataatctacaaaatataacattaaaccaaaggaggggaaaaaaacagcagcagcaaggagctaaacagtgagtagtgtgctcccactttgttaaaaaaaaatcctaactatatatgtgtgtatatacacacagaaaatttctgatatataaacattgcctctaaggaaggacaactgaggattaagggtataagagagactgatgtttcactgaatattgtttcctaatgtttgtctctatcatctgctaattaataaaaacacaagcttcagaaccatatgtataatataatccctttatagtcaaaggaattttatgtttacatatgcatatatttcaagcctagaaaagtctgagatactagctaccaaccattaacacttaactataaagaatgagatgagacaggatagaataaggaagagaaagaggagtcattggtaataactaatgagaaatgtatcagtagaaagtataatattttttgtaataaaaacaataaaggtacattttaaaatcagcagatactagttacagatttaaacttacgtcaagaaggagctaacaaagaacatcagtttcagaaacagtaaaacttgatgactatgttttgtagatgagtaaccaaagaacagaaacccacacagttgatgctagaagaggccttaaagatcccagttctcttgttttgctgaccagaaattaagggtgagcatggctaagtcacttgcctgggttaacagccatgctaggtgacagctctttcaaccctagctcatggcttttccaccaaacattctgcagacttctccaccttgagatgctgacttaactttgccacttcttagaatcctgataaaaacaatactgggagtacgaattcagaatattcccagagactctgtaaatctggaaaacaatccaattaggaacatgctgcctctttgttttatattttaatctacggagagaacagagcataaggagatggggaggagggagatggaatgagaataaattgattaatgaaccatctgcatagcacccttgctatgtaagggttgttattagtaagaggtcaaaggatcatccaggaaacaatctatacagcatgtatgtggacaggtgcgtagcagttgggtaaagtagggtagtggggaaacagtgtgcctgagtgatgctaaggacaagtagaaagtaggacacacaggccaagcgcggtggctcaagcctgtaatcccagcactttggaaggctgaggcaggcggatcatgaggtcaggagttcgagaccagcctggacaacacggtgaaaccccatctgtactaaaaaaatacaaaaattagctgggtgtggtggcacacgcctgtagtcccagctactcaggaggctgaggcaggagaatcgctggaacccgggaggcagaggttgcagtgagccaagatcgtgccactgcactccagcctgggcaacaaagtgagactccatctcaaaaaaaaaaaaaagtagtacagcacacagtcagtggccagtgctggggaacctcctcttccaccaacctggtgaatagccaaggaagaagataagagaacagacagataaagaaaaggaagagaagagctaactatcatagtactttgtccttggctatgctgattgtacatgtaattatagccaattcatggatatgtaaggttgtaaataaaactggatcccctgtagtcccagctactcgggaggctaaggcaggagaatggcgtgaacccgggaggtggagcttgcagtgagccaagatcgtgccactgcactcgagcctgggtgacacagcgagactccatctcaaaaaataaataaataaaaataaaaataaaactggatcctgatttcatattactgatacctactaccagcatgcataagtccagcttctctgctgtagcctggtgagcatttgaaccacagatggagcggggtaaatatgcaactggatccacaggtcacccaatcccactccagctcctggattttctcttatatttggtagaaggcttaagaatttaggctgggcacagtcgctcacacctgtaatcccagcactttgggatgttgaggtgggtgaatcacctgaggtcaggagtttgagaccagcctggccaacatggcaaaaccccatctctaccaaaaacacaaaaattagccaggtgtagtggtgcacacctgtaatcccaggtacttgggaggctggggtaggagaatcgcttgaacctgtgaggcggtggttgcagtgagctgagatcgcaccattgtgctccagactgggcaacaagagtgaaactccgtctcaaaaaaaaatagaatttaggtaagccttattttgtgaaagagctgctctggcgaaggaagaagtttgcagataattaattctccatgccaaaaaagaagaactgcaagggaacagtttaaggttctagaggtcaaaagacttttctggctttctttttttaagtcaacaaactctaataaatatttatgatgtaccaggccaagtccttaccttcctcaaagcactgatcacattttgcaagtactattttaataccatcattgtttgtgagttttgacataaccatcatgcatgattaaaaactccacaaagaaaggatgacctgtaaattctcaatggtagctgaaatctttacaataatgataaaataatcaatagcagctaatcctcaaggaggacttagtatatgtgaagcaccctgtatgcatataatctcatccttacacaacaatcctttacgccaggtggacttctagcatcccattccacaaatgaggcacaaagaggttaagtaacttccccaggggtgttggtaaccaccttttattcaacacccaccattatggggggctagtcctgtgaagaaaaaagattttcttcaacttgtacaataacctggcaaagtatgattattcctacattacagataatgaaactaaggtccagaaaagctgaactgctgtttggccttggtaagtggcagagctggtcttcaatctcagttctgtctgctttcagagccgatgttgttcccacgataccaatggcacctagacattcaggtttcgtggaccagtaatatgtccaaaaaaactaggggggggtgtaacttatatagaattaccaattatacattttgccaggtatggatgttcaagaaaaaaaaaaagaaacaaaactatctacttttactatcatggtgaaaaagcaaggagattttaacaccaaaaactagaaagaaccatgtaacagttctgtataaatcagaaaacaggcttgatatggtggctcacaccagtaatccaaacattttgcaggccaaggtggaggatcgcttgagactagaagttcgagaccagcctgggcaacatggcgagaccccatctctacaaaaaattagctgggcatggtggcatacacctggacccctagctacttgggaggctgaggcaggaggatctcttgaggccaggaatttgaggctgcactgagctaggattttgccactgccccccatcctaggcaacacagtgagatcctgtctttaaaaagtcagaaaaaaagttcttataaatcaaaaaacttctgctacacaaacactatcttcttcttatttttctcatgttaccaagtatcagtgaaaaccaatagacagggacagtgtttgaaaaccacttcacctccactgtagctaccaggggttacctgtaaaatctgttcagtcagcctctccacaaccacatccattggggtttgttatgtagtaatcaccacatctgtctatgcacttatctatctacttacctatctttgtttttccaaaaaatagagtagagaaaatttatttatagatttttcttttttttttttttttgagacggagtctcgctcttttgcccagactggagtgcagtggcgcgatctcggctcactgcaagctccgcatcccgggttcacgccattctcctgcctcagcctcccgagtagctgggactacaggcgcccgccaccacgcccggctaattttttttgtatttttagtagagacggggtttcaccatgttagccaggatggtctcgatctcctgacctcgtgatccgcacgcctcggcctcccaaagtgcctgggatgagaaaatttatttatagatttttaaaacttatttccaaaggccttctcccaagacaccaaagtactttttgacatcaaacccctctgtaaagagattttctttattctctttaaaataagtaaaggtgctgcctcctgtgaaatgccaacaaaaggataagtttcatgtgaagccaactctaagaagatggtactaagtatctttagtactatctggaatttcatatgcagcctcccacagcataaccctcttctcagctggtaagacaattatagttcctatctcaaagaaacactgtgaacagatgttaaggtctttcagaaatttaaactctctgactgcaagacttcggtttattaattgcacgctaatggattcaaaagcacagaacttccattttaacttgacttttattcttgccaggagaaaaatactttttcaggagagagcataacatctcatgccttaattccatgaatttcattgtttagaaagcatttgcacaggacttttctggcaactcctagtgttctttggacaagttcacaagtgtagaaaggcatcaatttattaagtatcataaattctcaactatccagcacagtaaggaaatgtggtattcaaatattcacattaaaaaagtcaccaaacattaattatgcctcaaaaaaaggattaaaaagtcactccattggtgatttatgaacaaacatttttctcaacatcataaagtatacctaataaaccacaatgaacactgtttaatcttcggatggttaagacggttcttgaagatttgtattataaacaagatttgtcttggcagtccagtaacacaacaattcatagagaattctagttgaagacatgccaggtgacagctgactgtattatttctactaaagtataattcagcttttaaacaattcacgttggggccacacagcctgtgtttgaacctggctcttccatttcctagttgtggggtcctgggtaatgactaaagctctccaagaatcctctcctcagtgtagaaaactcctctgctggggccgggcacagtggctcatgcctgtaatctcagcactttgggagaccaaagcgggtgcatcatgaggtcaggagttcgagaccagcttagacaacatgatgaaaccccgtctctactaaaaatataaaaattagccgggcatggtggcacatgcctgtaatcccagctactcgggaggctgaggcaggagaatcgcttgaacttgggaagcggaggttgcggtgagccgagattgtgccactgaactctagcctgggtgacagagcgagactctgtctaaaacaaacaaacaaacaaaaacaaaaaacaaacaaaccaacaaacctcctctgctggaattccgggttatctctccaacttcatcagtgactttcggtgtaaagtttaacttggcctcagtatctttctttgtaaagaagagaaggaagcaccaaaaaaatctaataatatgagattattaggactcatagattgctatctatcttaaatctggaagataactgccagagaattattttaaatgtttgggaagaagaaggaggttaggggaagggaagatgggaggaacagaaggagaattaaaaagaggccttcataatatacaagctacctcctttcccttacatcaaaagtggcctccgtggccaggcgcagtggctcacgcctgtaatcccagcactttgggaggctgaggagggtggatcacctgaggtcaggagttcaagaccagcctggccaacatagtgaaaccttgtctctactaaaaatacaaaaattatctgggcgcagtggcgtgtgcctgtaatcccagctactcaggaggttgaggcaggaaaatcgcttgaacccaggaggtggaggttgcagtgagctgagatcgtgccactgcactccagtctgggcgacagagcaagactccatctcaaaaaaaaaaaaaaaaaaaaagttggcctccctgaaaataaacaggtttatgagcgccctcatggggtggattagctaaatgccatccctagtactggctgcaggttgttacagtagaaatagatcaattatttgaaaaaataaatagaattttaaagaaagttgttgtattccagttgaatttttgatgtctcctggtaaattctaaattatccacattaagacccctaaatatttttgtaatgttttaaataactcttgttcagtgtttttgatgcttactgcttaattcagtaatttgggaagtaattctgggacgaccacaaaaccaaaaatctgcaagatttcaacagatggtcagactgtaagcatttaggagaacaaagtcaattataactgtggtattcttagtactctctaataactagcagaaattattattaatagaaaaaagtaaaagctcttaatttgtatatttttcttgccctatagggttagcacataaataaggtgactaataatgttaccttaatggaagcaaatgcatattatatcatgaaacaatatgtagttacctttctaatatatgtgttttaggtaacactaacatgaatttacacaccttgccatgtgtagacttcccagtgcttagtaccgaaagcagaggaaacagtcctgcccatctgaaactactaaaaatacaaaaattgggccgggcgcggtggctcacgcctgtaatcccaccactttgggaggctgaggcgggcggattacgaggtcaggagttcgagaccatcctagctaacatggtgaaaccccgtctctactaaaaatacaaaaaattagccaggcgaggtggcaggcacctgtagtcccagctacttgggaggtggaggcaggagaatggcatgaacccgggaggcagagcttgcagtgagctgagatcgcaccgctgcactccagcctgggcaacagagcaagactccgtctcaaaaaaaaaaaaaaaaattagctgggcacaatggtgcagtgagtatattaggacttgttgatttgggtaaaataaaaaccctttatatgatagaccaactgtgctgtaacaaattacaccagatggaaggtaaagtatctcagaatattccaattgcgttaaaaataaggctgtaattgtttgaaattaaacttttatttgaaaccttagtggatccgtaattgaatgtctagaaaaccatgcaactaagccaactttcctggtgatataaaggtgttacaatgggggaaaatattttttagaacactttccatttttttatctaaaaagctgtattcctgtatttccttatatttaaaatctggcaatatccattccctgaaataccaaaaattgggtctttggcatgacctactgacaatttagagaaatgatgagagaagaccagtttcaggtaagttttcaaaccaatatacacttgggtgtaaaaagttagtgtaggtaacaagtcacgtatattttcctaaattgatcagattatgaatttctctttttttattatttgagacagggtcacactctgttgcccaagctggagtgctttggcacgatctcggctcactgcaacctccgcctcccaggttcaagtgattctcctgcctcaacctcctgagtagctgggagtacaggcgtgcaccaccacgcccagctaatttttatattttcagtagagatggggtttcaccatgttgaccaggctggtctcgaactcctggcctcaagtgcttggcctcccaaagtgctgggattataggcgtgaaccattgcacctggcccagattatgaatttctaaaatatatatatatatatatatatatatatatatatatatatatatacacatacatatatatatatatatattttaacacttggtaggaggttaagatgatggcataacttgcttcaagaagtcccatcccaccccttcccctcacactcccatactagaggcagtgtctgtgcctctggaggaaaaataaggcacatctcaaatctacataaacacggggcaggtggtgagaggagagatgtatggtttctactggtattgcccactccgaaaataaatggatcattaaaaactctggaaactcccagaagcggaatcacagcttaggatgatcatggaagttttcctgttggagcagtagctagccatggtcaaggcggtctagacagagagcagtgtggggctccgtaaataccgcactgacggaaaacattagcttcctgaactgtacaggttatacccaaataagttaattccctcggtaggtcttgctttgccagcatattcactgtaaaacatgtaacagacacttaaaatagaaatcaagattacaggcaatattttggaaaccaggtcttcctcaagctgtgggaaaatctgggtggcccagattccttcctttcttaaaatacgactgcttttcctcccactctagaaaagaggtggaaatgtttacatggatacatctgatgtgttgacacagctcttagcaataagtccttcaaaagggcgatcttttccttcaggttctgcaacaaagctctgattgtcacggtaagctgaaaagaaaagaacacatcctaagtattctagtccagaatgtagaatccacaaaattacatcacgtaaacactacttcacgggctatgatgcaaccaagcaagggctggaagagatagatactcagcccctcacgacaaactcagggctggaaggaggctcagtggtgccctggcccagctgccaacctacagcttgtacccgctccacaacctggccaagtggtgagccaagccagactggaaccccgatactgactagaaactgtcagtgtgctctcaccatcagctgaatcctgtcacctgagcttctaccccattgatcctatgtatctaccttggaaccacgcaggaaattgtgttccccgagtcttcatttgagagcaaaaacccacagttctctgaaccaggcttcaaacgacaaagcatggagtcccattaccatccccaccaggctctctgaacaactggtaaaatttataacccaatgaaacgttttacggcaatgtgttctttttatgcaagaggaatgctaaccacacatgactcttttcccaggagggtgcgcattttctccaatcatcctacaggaaatttttgtccgtgactctaacctgttacattaaaggatggagaagagggcgagaagagagtctctcaggaatttggaaatgtgaaaaaactgcctgtgtaagttaaaacatattcaaccacggatgaaatcagacatatgttaaaaacacagaataccacaggtttcctttgctaccttgtcaaaagcagcaattatataactcaagcggactccctccttggatttgcagaatcacaccaaggaaaaccagccagtgtgtcagagactggcccagactgcacacatccagcagccctccaaggcaccagcagccaagaaaagtctaacctgaactatccccatacccctgggaaccaaggaacaatcacctacaatgttgtggggaaacaccaaggaaagcagatctctctacactcaaagagaaaagagcggccgggcgcggtggctcacgcctgtaatcccagcactttgggaggccgaggagggtggatcacaaggtcaggagatccagacgacggtgaaaccccgtctctactaaaaatacaaaaaattagctgggcgcggtggcgggcgcctgtagtcccagctacgcgggaggctgaggcaggagaacggcgtgaaccctggaggcggagcttgcagtgagccgagatcgcgccactgcactccagcctgggcgacagagcgagactccgtctcaaaaaaaaaaaaaagataaaagggcaaaacaagcaaacaaaaaggcgccacacacaccaggcctacgaagaggagtccacaaaatcaaagacaaaagcatttgggagatgaaagacggagtatgtagccattaaaaattatggctcaaatctctatttgttcacatagaaagatatccatcacagcttatgaaaaaaacatcaagtcataaaataaaatatcacccaaacagagaaaaaacaacccaggaactaaatacaaacattgaaaccatgaaagcaccatggttctatctaagtagtgggattttctaatattttataagaaaatgatcacttttgtaatcaggaaaaaatgtcattatcataattaaagacactttctagagcacaaaaaaagatggaaagcctaattcacattttaagctaccataacctgggtaacaagcactgacagagataaccacatgtcaatcttacttaggaattataaatgtaaaaatcttttcaaaaaatattagcaaagcaaattcagaattacattaaaaaggaccatatactatcaacaagtagaaattattctagtaatttaagaacagtttgatgttagaaaaatctagtaataaagctcatggtgttaataattaaaaacagaataaacatatgattagtacagtacaggggaaattataaacaaaagaaacacaaaaaagaaagaaaaactaagaatagaacactactgccttaactacaatattatttaactttgctctagaagttctaaccaatacaataagaaaaattaaagaaaaatacaaggactacaaggaaagatgagattattattatttgcagattgataatagtctacttggaagagttaagagaatcaactgaaagattattattattttatatatatatatatatatatatatattttttttttttttttttttgagacagagtcttgctctgttgcccaggctggagtgcaatggagtgatctcagctcactacaacctccgcctcccgttttaagcgagtctcctgcctcagcctcctgagtagctgggactacaggcacccaccaccatgcccagctaatttttgtatttttagtagagacagagtttcaccatattggtcaggctggtctcgaactcctgacctcaggtgatccacccacctcagcctcccaaaatgctgggattacaggcatgagccaccgcgcccagactgaaagattattaaaaacagtagaggccgggctgaaagactattaaaaacagtagaggccaggtgtggtggctcacacctgtaatcacagcactttgggaggcagaggtgggagaatcacgaggtcaggagttcaaaaccagcctggccaacatggtgaaaccctgtcactactaaaaatacaaaaattagctgggcatggtggtgcgcacctgtaatctcagttactggggaggctgaggcaggagaatggcttgaacccaggaagcggaggttgcagtgagcaaagatgatgccactgtattccagcctgggcgacagagcaagactccatctcaaaaaaaaaaaaaaaaaacggtagaagaattcaatatggtcattagtcataaagtgaaaaaaaatcaagggcattcctaaatttaagtaatacctagggagagttttttaaattgttattttaaaacttcattaacaataccaacaaaatctaaaaaatatctagcacagtgcctggcacatagttaactgtgcaataaatactgctgaagaaacaaaaggaaacgctcaatattgtgaaaatgtaagttttccccaatttaaatctataaacatacatgtctacttgaaattccatttggaattcttttattgcagaagaggtgataattaaggcacagcacagtttggtttttttttttttaaatgaagttttagaaaattactctgacagaaggataaatgaaggaaaataaaaaccatgaatatgtataatgttcataggggccttaatcagatataaagtgattacaaaaaactacaatagctgatgctggcaatcaccaacagcttcagtagtgcaacataacaaatggcccagaaacaatgtagctgtataaaaatccagtgaattaaatatgaactatttcatatgagggaaagaaattcataatttaacaaatggggaaaaaataaaattagatagctatgacacaccaaagtaaacaccaagtatttcaaagatttacacacacaaaacaaaataacagaaaaaaagcttaaggaaaatttacataattaagtatttataaaacctctgcatgtaaaaggcctttttaagcatgatatcccctcccccgttagaaaagatcaccaacaaacatgctgataatttcaaataaaatttaaaaaccggtacatgttttacaatgtcacttacaaaatcaagttaatagagaaagcatttatactaaatataccagatcaaagcttaatatagttaacatatataaaaagaaaactttgaaattaagaaacaaggctgagcacggtgggtcacgcttgtaatcccagcactttgggaggccaaggcaggaggatctcttgagaccaagagtttgagaccagcctagccaacatggtgaaacctcatctctactaaaaatacaataattagccaggcgtggtggcgggtgcctgtaatcccagctacttgggacgctgtggcaggagaatcgcttgaacctgggaggctcggaggttgcagtgagccgagattgtgccattgcactccagcctaggcaacaaaagcaaaactccatctggccaaaaaaaaaaaaaaaaaaaaaagaatagatattcaagacttaataaaaaatgcatattaaactactgtaacatagtatttttacctagtagagatttttttaaaagataatcaaaattggtgtagaaatgtcattctgcaatatatgtgttcaaaaggcttaaaatgttatacaacccaaatccagaaagtctacattgaagaatttatttcaacatgggcaataatttggctatactgaaaaatcatttgtaattagaaagaatctaactgtccaagaagatgacactagttaaatagatagcagcccttcgtgtaaaagatgaaaccatatatttaatagaagaaagcaggaataaattttttataacctgcaaacagcaaaaacttagatatgactaaatatatggaagcaattagattgacagccaacttcatttaaaaaaaaaaaaactttcggccgggcgcagtggctcacgcctgtaatcccagcactttgggaggctgaggcaggcggatcacaaggtcaggagatcgagatcatcctggctaatacggtgaaaccccgtctctactaaaaatacaaaaaaaaattagccgggcatggtggcgggcgcctgtagccccagctacttgggaggctgaggcaggagaatggcgtgaacccgggaggcggagcttgaagtgagccgagatcgcgccaccgcactccagcctgggcgacagagcgagactccgtctcaggaaaaaaaaaaaaaaactttcacacgacaaaactaccacaagcaagtcaaatgtcaaatgataaaggaaaggaaataactacaatttatcacgaggagctaatctccataatacgtgaggagctcttaaaagatcaagactaaaaaggctaataatccagtagaaaaatgggcaaaagacaagacagttcacagaaaaaaaaaaaaatatatatatatatatatggcccttaagcatatgaaaacacactccacttgactcattatatgagaaatacaaatttaaaacgacactgaaacaccatttctcacttatgaggttaacaaaaattcagaagattcacacaccctctgttggccaggctgtgaagaaacagaagtgctcacacattgctggtggggtggcaagagtgacaacccctttgaggggggatttcacatcaggttaaaaaaaaaattacatatgccctggttctgagaactcacctttaaaagacacctatgcacataatttttttaaaggacaaggttatttactgcggtgttattcacaactcaagactggaagcaatttaactgcctttccttaggagacaggttaaataaagaatgttacatctacgcaatagagtacccatacagcgctaaagaagaacaaggaatatgaaatgaaatgtagaggtttctatattattaagtgaaaagaccaagatacaaaagagtatctgtcattcattcattcatccatttatttatttatttatttatttatttatttatttatttatttattgagacagagtttcattcttgtcacccaggatggagtgcagtggcacgatctcggctcgctgtaacctccgcctcctgagttcaagtgattctcctgcctcagcctcccgagtagctgggattacaggtgctcgccaccacacccggctaatgttttgtatttttagtagagacggggtttcaccatgttggccaggcttgtcccaaactcctgacctcaggtgatccacccgcctaggcctcccaaagtgctgggattacaggcgtgagtcaccgcgcctggcccgaaagagtatcttttatataaaaggaaaaacataacacacagacacacagagacacacacatacacacgcatagaggcttatttctgcataaagtaacacaggaagaataaaccagaaattaatgaaaatggttatttagaagaagtaggttaagaaaaggtagaaaagagaggaatgggaacaagactttgagtgtcacttttatataattttgacttctgaacaatgtaaatgttttacttatttaaaattaaattaaaaagttggaaaaagcaactcctgaaaatgaataaaaacagaaacaaaggataacataagacagaaaaaaaaagaatcaattattgcaaaagtcctcaaaaaaatactggcaaaccgaatccagcagcacatcaaaaagcttatccaccacgatcaagtaggctttatccctgggatgcaaggttggttcaacatatgcaaaacaaaaaatgtgtttcatcacacaaactgaaataagacaaaacttacatgattatctcaatagaagcaggaaaggcttttgataaaattcaacaccacttcacgttaaaaacactcaataaactaggtattcaaggaacatacctcaaaataataagagccatctatgacaaacccacagccaacatcatactgaatgggcaaaatctggcagcattccacttgaaaactggcacaagacaaggatgccctctgctaccactcctattcaacatagtattggaagtcctgaccagggcagttaggcaggagaaaaagaggagaggagaggagaaaagaggtgagaaaggaaaggaaaaaggaaagggaagggagagaaagagagaaaggaaggaaaagaaagaaaagaaagagagagaggaaggaaggaaggaaaagaaaaggcatccaaataggaagagaggaaatcaaactattcctgtttgcagacaacatgatcctatatctaggaaatctcatactcccagtccaaaagctcattaagcttataaacaacttcagcaaagtctcaggatacaaaatcaaagtgcaaaacatcactaacattcctgtacaccaacagtcaagccaagggccaaatcaggaatgcactcctatttacaattgccaacagaaaataaaatacctaggaagacagctaaccatgaggtaaagatctctacaagaagaactacaaaacactgctcaaagaaatcagagatgacacaaacaaatggaaaaacattccatgctcatggacagcaagaagcaatatcgttaaaatggccatactgcccaaagcaatttatagattcaatgccattcctattaaactaccattgacattcttcacagaactagaaaaaagtattttaaaattcatatggaaccaaaaaagagcccaaatagccaaggcaatcctaagcaaaaagaacaaagctgggccgggcgcagtggctcatgcctgtaatcccaggactttgggaagccaaggcgggaggatcatctgaggtcaggagttcgagatcaacctggccaacatgacaagagcccatctctactaaaactacaaaaattagctggaagtggtggctcatgcctgtaatcccagctacctgggaggctgaggcacgggaatcacttgaacccgagaggcagaggttgcagtgagccaggatcgtgccactgcactccagcatgggcgacagagcaagactctgtctcaaaaagaaataataaaataaaaataacatagctggaaacatcatgctacccaacttcaaactatactacagggctacagtaaccaaaacagacatagaccaatggaacagaatagagaactcagttgaccaggcacagtggctcacgcctataatcccagcactttgggaggccgaggcgggcagatcacttgaggtcaggatttcgagaccagcctggccaacatggcgaaaccctctctctaataaaaatacaaaaattagctgggcatggtggcacacacctgtaatcccagctactcgggtagctgagatgcaagaatcacttgaagccagaagggagaggttgcagtgagctgagatcatgtcactgcactccagcctaggtgagaagaaacaccgtctcaaaaaaaaaaaaaaaaaaaaaatagagtacccagaaataaggccacacgtacaactatccgagctttgacaaagctgacaaaaacaagcaatgggggaaggattccctattcaataagtggtgctgggataactggctaccacgtgcagaagatagaaattgaactccttccttacaccacatgcaaaaattaacttcagatggattaaagacttaactgtaaaacctaaatctataaaaaccctggaagacaacctaggcaatactattctggacataagaacaggcaaagatttcaggacaaagacatcaaaagcaattgcaacaaaagcaaaaattgacaaataggatctaatcaactaaagagcttctgcacagaaaaggaaactatccacagagtgaacaaacaacctacacattgtgagaaaatatttgcaagctatccatctgacaaagatctaatagccagtatctataaggaacttaagcaaatttacaagaaaaatccaccccattaaaaagcagacaaaggacacgaatagacacttttcaaaggaagacaggcatgctgccaaaaaaaacaggaaaaaaagctcaacatcactgatcattagagaggtgcaaatcgaaaccacaatgagataccatctcacaccactcagcatggttattactaaaaagtcaaaaaataacagatgctcgggaggttgcagagcaaaaggaacacttatacactgttagtgggagtgtaaatcagttcagtcattgtggaagacggtgtggcaattcctcaacgtactaaaaacagaaatactatttgattcagcaatcccgttattgggtatatccccgaaggaatagaaatcattcttccataaagacacatgcatgtggccaggtggggtggctcacacctgtaatctcagcacttcgggaggccgaggtgggtggatcacctgaggtcaggtgttcgagacaagcctggccaacatggcgaaaccccatctctactaaaaatacaaaaattagccaggcatggtggcaggcacttgtaatcccagctactctggaggctggggcaggagaatggcttgaacctgggaggcagaggatgcagtgagccgagattgcaccactgcactccagcctgggcaacaagagcaaaactccgtctcgaaaaaaaaagagaaaaaaagagacacatgcatgtgtatgttcactgcagcactattcacaataacaaaagacatagaatcaacctgatgcccaccaatggtagaccagacagagaaaatgtggtacatatacactatggaatattatgccgccataaaaaagatcgagatcatgtcctttgcaggaacatgaatggagctgaaggccattatccttagcaaactaatgcaggaacagaaaaccaaataccgcatgttctcacattctgtaggttgtttgttcactctgttgatataagagagagctaactggtgagaacatatggatacatagggggacatgacacacactggggcctagcagagggaggaagctggaaggaggaagaggattaggaaaaatagtaagtgctaggcttcatacctgggtgacaaaataacgtgtacaacaaatccccataacacaagcttacctatacaacaaacccacatatgtacccctgaacttgaaagttaaaaaataattctaataactttggaacataataacctcagcattcttagtagattagtctacacttaaaaagactcaaattttgaactcagtgtttgtcgtggtaccttatagtaattttgaaaccattttctgtaaactgtaaaatagaccaaatgagtaaaaacatactgatgcttttggaaactaggattctcagtgtgagagaaagaaaatacaaatttggaatgtggaaaataaggaagaaaggtgtggtgttagatttgaatcagaggcttctattttcaatcatagtcacaagtataaacttgtgatttcacaaaaatctatttcttagccaaatcccaccactgtttttatacagcccaaaactaaagatggtttttacatttttttcttttttgagacagggtctcactctgttgcccaggcgggagtgcagtggcacgatcttagctcactgcagcctccacctcccaggttcaagcaattctcctgcctcagcctcctgagtagctggactacaggtgtgtgccaccacgcctggctaggttttatatttttagtagagatggggtttccccatgttgcccaggctggtctcgaattcttgacctcaagcaatctgcccgcctcagcctcccaaagtgctgggattacaggtgtgagccactatgcctggcctgtttttacatttttaatgtaaaatgtaaaaactataactattcttgtggtgagaatggaaactcaaagacttgaagacattatctcttggcctgcaaagactaaaagatttattatctgtaggaagtttactaacccctgaactagactataaaattgttagaaatatttaaagtaaaacaggagaacttaaatgtgttatgcctcatttagtctcaatgattacatcactactaactggttgggtgttatgtcaattcaacatatgtaagcagatagatcatcatacacacatgtgcacagacagcctcaaagaaagataggagggttttcaggcctcaaaactcaaacaaatcattgggtactaattccttcatggtattacctttggtgccttttcaccttttctttcatattgatttcgttgttgaattttctcagcaatttcttgggcaatttgacaagtagaatcgtatgtggagaacctgcaccaaagtcgtaaaaagagaaaatgtttaaggttctttttttttgagacggagtctcgctctgtcgcccaggctggagtgcagtggcacgatctcagctcactgcaagctctgcctcctgggttcgcaccattctcctgcctcagcctccccagtagctgggactacaggcgcccgctatcatgcctggctaattttttgtatttttagtagagatgaggtttcaccgtgttagccaagatggtctcgatctcctgacctcgtgatccgccccctcggcctcccaaagtgctgggattacaggcgtgagcccctgcacctggccttaaggttctttaaaagaaatttttgcattgtctaagtttgacattttcattctagccaaagaattcaaacagaggggaagaataataacatgaccagtaaaagcaacatggactgagcgttatttaccatgtgccaggcactattttgaaggcttcgttagtaataactcacttaatcaaaacaggaacgctatgaagtgggtaccattaccatctccaactcacacatgagaaaaggaggcacaaagagttagagtgacttgcccaagtggttctgcctgctgcaaaccaaggccgtctggccccagagccggggctcttaacaactgtgctgttctgccaatgagaaagcatgtggggggtctccgctgcactgggcactgttctgggcactggagaagacggcagtaaacagaatgaacacagtccctctttcaaggagctcatattttaaggaaagaaagtcataaaacaattaaatacatagtatgtcaggtgttgataggtgctaagaagaaaaacgcagcaggataaagggacagagagtgataaggagctgctacttaggatcaggtgacaccgaggcaaggtgaagaagctgggcttgcagatgcctgggggcggctctagggtgcaggaacagcaagtattgtctagcctaaaaccaaatgctccggggacaaaggccacacacccacctgacatctgagcttgccagaattctctcaaaacatttaataagcttctagttgtcattcagcagcgttggaggctttgaagggttcacggtgaactcccaatagccccttatgttttgcttctctcagagcatttttactttctatcatatagaaaatacttaagcagaccggatgcggtggctcacgcttgtaatcccagcactttgggaggccgaggcgggcagatcatgaggtcagaagttcgagaccagcctggccaacatagtgaaaccccgtctcaactaaaaatacaaaaaattagccaggcatggtggcgggtgcctgtaatcccagctacttgggaggctgaggcaggagaatcgcttgaacccaggaggcgaaggttgcagtgagctgagatcacaccattgcactccagcccggcgacactgtgagactccatctcaaaaaaacaaacgaacaaaaaaacgaaaatacttaagcatgcatacacatttcatttctcctatcagacagtctgctcctaaaaagcagagactctgtggactaacatgaccagcattatcttccaggaccagtccatcacaaaatatcagaaactcctgttgcccctaatgtcctaatttttgcttgagtaaacaatatattttttaaaacctttcaattcccacatatcatttgaacactgagggaacttgataagtgtttttttttaaatgaaggaaaatgcgcccatcaattcccttaggaatcttactagaataattatagcaatagtaacagctgagtacctgacctgagccaggtcctatactaagagctttacactgtaaacttcataaggatcctgagagaggatcctgaaccactaaccactatactgtaaagcagcaccattcatgtatatatcatatatatatcacacacattcacatatatcatatatatcactgatacatatattcatatatatcacatacctatcgtttatatcatatatactatatattcgtatatgtcacatgtatatcattcatatatatatattcatgtatttgtgtgtgtagggaaaaatagcagtgatacaagaaaacacagaattaagaaaacaggaggctaataaggaaaattgggtcctggtccaaactttgccacatttcacttttttttcctccatattatcatgaaaagaggagcctaggtctggctctggggtccagaccatacatataaaaatcatccacatatggtaagttttgcctcctgccaaatgtgggatctaagtggtaagtacgtctggagttcagaggtggaagagattactgctgaccaaggcactcagatggagagggtccatgaggttacatctggatgaccacgaagttaaagcaggtctcttattcagacaggagggaggagcacattctagacttagtgaaagacagggcgagcaaagatgaatggaaggaaacgtgcccggcacatttggctgcgtggtggccctggaagcctgttaagtataaaatggtagagatgagtagaagctagtttctgcagagccttgaacaccagtctaacaaggttagacttaaaggagaatttcagagccatagagaacacttttacacacagagagtggccctaaagaggttatgagaaatgcacacagctagcacaaactcccaggtgtcctgactccagtccttgtgttgttattttagccctaaagagcaatagttctgaaacaagttggaatcactggggaatctttaaaaaaataacaatgcctggtcccaacctcagcattctgactcaactggtatggggtttgtcctgggcgtgcgtggggagctttaaaagctctccaagtgattccaatctgcggtaaagtccgggcgggaacccttggcctggggcaatagacaacctcattacactatcaagcacacaggtgcctgaagtactagtttagaaaaagtaattgggtcggggggtggctgaggcaggagaatcgctggaacccgggaggcagaggttgcagtttgccgagattgtgccatcgcactccagcctgggggacaagagcaagactttgtctcaaaaaaaaaaaaaaaaaaaagtaatctgggccgggcataggcgtagtggctcacacctgtaatcccagcactttgggaggccaagacgggtgatcacctgaggtcaggagttcaagaccagcctggccaacatggcaaaaccccatctctactaaaaatacaaaaattagccgggcatggtggcgggtgcttgtaatcccagctactcgggaggctgagataggagaatcacttgaactcaggaggcagaggttgcagtgagccaagatcatgccactgcactccagcctgggcgacggagcaagactccatctcaaaattaaaaaaaaaaaaggtgtggagggtagagatgaaacaagaatggcagaatattgataatcacagaaattgggtggtgagtatgaaaggggcccattatactattctagtttgtgtatcttttaccttccaaaataaagtttttaaaaagcaattcaacacaaagaagaccatgctaccaacataaaaagtccaatcaggatataaaactattaaggtttaactgtaatttttctggaaatggtacatcatcaacaaattagttaccctggaggtaaagctaattaacattagcaaagagccagttcagagacagtgatcatgggctccttctgttaaacagcgagcttaccacttgctttgataggccattaaaatagtaactgctatattccattgctagacactgagggaggtgccaatgacctatgattttagcaacacaaaggtaaagctgtagttgaatctgtttttataggttgtttttgtttgtttgttttgttttgttttgacatggagtctcgctctgtcgcccaggctgaagtgcagtggcgcaatctcggctcactgcaacctccacctcctgggttcaagtgattctcctgcctcagcctcctgagtagctgggattacaggtacacaccaacatgcccagctaatttttgcgtttttagtagagacggggtttcaccatgttggtcaggctggtctcgaactcctgaccttatgatccgcctgcctcagcctcccaaagtgctaggattacaggtgtgagccaccacacctggccttttataggtttttcaagtcccttcccatactcctttctacccccctaatcagcgacccattttgtgctttgggagcacagctgagtgtctcactgtttcactctcaatagtccaatgagaaagccacttcatcaaactaatgaagtataacagaaaaagtctcaatgctttatcaacattaactgcggaagaagcttggggtccagtgatagcttccaccaatctaaatagataactgggggcctgtcccttatctttgacctttatttcctacttgatttgtaaactgagggatttaggttccagaaggtggagggcaacttaggaatatgtattgtaaaccaaaataaaattctaagcccacccccaacacccccccccacccccgcaaccatctgaacggacccctactctaaggcaagggcattccaaagttaacctgaaacactggttcaggccatgatgggaagaggggatcagacatgcctcattatatatcctctcctcctttttggaattcaggaaaagccaaccagcattaacgtcaatacagaccttaagtctgataagaaacacttacaatgtattctctctaaagcctgctacccagaggcttcatttgcataataaaatcttggtctccactaccccttatcataacccagacattcgtttctattgataataactcaaccaattgccaatcagaaaatttttcaatctacttatgacctggaagccccccacgcccttcgaggtgtccctcccttctggattgagccatcataaatcttacatgtattaattcatgtattattctccctaaattgtataaaagcaagctgttccccaaccaccttgggcacaggtcttcagaacctcctgaggctgtgtcatgggtgcattcttaaccttggcaaaataaactttctaaattgactgagacctgtctcagatactttggggttcacagtatcaagggccttaaaaatgtttatacccttgagcccaacagttctatttcactttcaacagtctaatgagaaagccacttagtcaaactgattgagaataacaaaaaaagtataaatgcttcactttcaacagttctaattcctacttctagacagggagcccaaggaaataagagatagaacaaagggactccctttgcaatgataaaacaaaacaaaacatcagaaaaacaaaaaactaataggagaaaaataaattatggtcattcatgtgatgcattattttgcaacataagacaattatgaggccaggtgcggtggctcacacctgtaatcccagcactttgggaggccaaggcgggcagattgcctgagctcaggagttcaagatcagcctaggcaacacggtaaaaccctgtctctactaaaatacaaaaaattagctgggcgtggctgcgtgcgcctgtagtcccagctactccagaggctgaggcaggagagttgcttaagcccaggaggtggaggttgcagtgagccatgatcgcgccattgcactccagcctgggtgacagacagagcaagactccgtctcaaaaaaaaaaaaaagaagaaaagaaagttatgctttcaaagaatgtccaatgacatagagaaatgctgtttatattatatatatatataaaaatatagattaaaataacaaattcattgtaaaaaaatcattaatggctatttccaaattatagagttaaagatgctatttattttcctttttgcaaattttcaatattctctaaattgaatattctctatcaaggggtgtatataactgttaaaattagggattttggggttttttatttttttttgagacggagtttcgctcgtgttgcccaggctggagtgcaatggcacgatctcagctcaccacaacctacacctcccgggttcaagcgattctcctgcctcagtctcccgagtagctgggattacaggcatgtactaccatgcccggctaattttgtatttttagtagagacggggtttctccatgttggtcaggctggtctcgacctcccgacctcaggtgatctgcctgcctcggcctcccaaagtactgggattacaggcgtgagccaccaccgcgtccggcctaaaattaggtttaaaaaagtaaatgctaaattaaataattggcccaaataacctagattccaggtaactcaactttgttcttggaatccattcttctaatatccaggatgtgggcaacttaaacaattataaactatattagaaataacaacataagacacatattccaacaagaacgttatagagctgtaatatgtttttaattattaagcagaaaggtcaagtctatgttcaataacaatacgttccttgggatcaaacaatatgttccttgggatcaaaagttgcatctttcatcatgcagtccttgggattaactgctaaataaatcacccttatcagctattgttttactgcagaagctactgctaaaggaaaagacttcatgatattaactcaagaaagtgcaaaatgccttataaacaagtgcacaatttccctcccaggttcctgtatctggaagggcccccaagatctaggtcttagccccagctggttactaactggctggtggccatggattctgaacctcggtttctccacctgtgaaataagggggtttaccgggatggactgacatgctacaaaaacgttatttcgacttcacttttataggagtccagggaagcctgcaccagccagctagctccaaaaccaggatgggcgggaaatccccgcaacgagatgcagcccagaaaagctaaaggaatattcagagatttggcgtaagtcctcagctctccagcggaccacctggtctccttcccgggccacccttgcaaggaccaagtgtggcgggatgtggctgagccccctcagtaaaggaaaggtctcgctgcccctcccctcatcccgaaaggccaccagcggcaatgcgaagtgattgcctgctctccggaagcccggcctccccgaaggtccctccacgcaccgccgccctcacccgggactcaccaggggtccggtgccatcctgcagactccgcccgccgctcggactcttcctgctcttagcagctgactacggcggcccgcgcggctcactccccgcagttcgtcccgtgcgcgaccggagcctggagtttgcaaagtgagtagctagggcctcagaactataatcag

SEQ ID NO: 2424 - DNA, 325489 bp, Homo sapiens; identical to SEQ ID NO: 2423

SEQ ID NO: 2425 - DNA, 588017 bp, Homo sapiens
catctcggctccaccgcacccttcgcgggaagtccccaggcttccagcaaagctcagcttatcccgcccccgcttccaacccggaaccccagaagaacagcatgatgagcctccggcagccaggtgggccacctccccgcggctcagtttgaggacacttgtgcggaaccctttcacatccccaccctacccagctttcacaactccgccgggttaaatggccaaagacaaacttctacctctcctgtccccggtcccagcttttcaaaaacccacagctggcgaacccacacacatcgaaactcctaggtcgctgttgcagtctgggcatgctcagtatcagggtaggttttgattgagagtaaaaaaaaaaaaaaaaaagctttgtattatgctctctttctcctgtgcatactgcttgctgaacagcttgtggggcattcctgagtctacctagaggttttatcagacgcccttgattgtgtctccttgggatctgttcccctcttacttcaccccctcccccaacccgcctccaccccgcttcccaggtccctgtccgctgtggggatggagagacactaacagaactgggatgggcgatgttggctgaacggatccacctattattagtgcgcggggattggctccttggcgcagcgtacccgaggtggagccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccaggtaaggaagcgggactggcggcgcggccacctcggcggtgcctatctgctcgaatccatcccaaagattttcttctcgatacacttgggttttagtggtgggagtctgagacctagggagggatccccgggtggcctattgtgagaaatatgagactacatgtgcatctcctggaaaagcactttgcacagcgcccgtgatttagagcctggagttgatgttgggcatcccccatcttcttgcttcctctttccttctcttgttctctctcctccgtcccccacccccaatctcaatcttttctctctttctctcccacacctcccctctcgccctcctcccaccctaagcacgcacagcgtttctttctcctcctggagaggattgcctttcttagaggaaagagggggagtgaagaaaggagaaagatttctttctgttggggagagggatatgggggggggggggaacgtaaacaagatagaatacaagctctgcgaaaatcagagcacataaagcaattaaactgaataaggggagtagacaaccagtccagcttgggctgtcagagagaggaagcgtcaagtttgacttgatttcctccttgcaagagtctatgtctctcacttgattcgttcaaatggaacaaaaataaaccgacaatccaacccactttcaactgcttaattgcttttgcttttgagtgccaaccatctgacttttcctgtttccatctgtcctgtggggctaacaatttggtattgcacatcagtgttaatatctgaactttgaaagctttcttgagtaacaaaaaaaaaaaaacaattaaaatagattattactttcctgaggtttcttggtatggcctgttgttgggggatcaaaaaatgtaaagtttcaaaacatttgcaagggacaacaattttatagggaggcttggatttctactttgagaaagctaatcttctagttagctttgtgtacatgttgatattcactttctccagtattaaccctttcgtgaaataaagcaactgtttaacttttgtatggaagctacatttgtgtagaattttcactttattctacctttgtactatttgcattttattgtctggataccaaacttatgcctggctttattttcttttaataggacaatatttaatggatgtaaacatgatgtttatacaatttcagcactccctttagaaggcacatggaggctcagttggacaagaatcctcctgtactggaactaagtttagaaagtaatgctagaaagataccctaaattttaaaaatcctgaaggggaaaacatttttgtaacgtcttgttaaaagaaagaaaaatatatcaaaacaccaacatgcccctggctgcctgcataataggtcaagtaaatggtacttgttggacagagcctttacagcagcttcagcagtctctaattccatcattggggatataagctttcttttcttattattcttcagggacagctaagcgatagtactgtcagatggaaggaggtatagagaaatgcctcgtttgatgtaataggaaagcattccaagtgggtcttacctgaacacagagaaatccacagatgttagtatacaaaacacttctttttatttatcaggggaaatgcagagtcttacttttttttgtctagaactccacttgatataagaaaagagaatcttctatcttaactgtgtctgaccttccacactaattttgtatctcagagagtattttttcactacgtacgtttaatatataagtttacacaccaacttagagaagagctgaattcatttgccatcagtgtaatgtgtactattttccaaaccattttgcatttgaggcaatgatctctccctaaatagaattaccaagtcacgaaaaacgattttctttctagggctttgacatttaaatgaaaaaaaaaaaaaaatagtgtctctgttgaaagctaactctggtttttagaggtgccaccttttggttacaaggacaaagggacaatcacttaattacctcacatgtatgtacaactgaattaacaagtttagacatgaaaagatgtacaaaaaggaagccagctgccttcatgtgagaaaattaagattttgttttctcatttctccactgtcttaggaatatgtgaaaatttaggcttggtttgtgacatttattttcatgactctttacaaatgttaattatagaaataacatctaaaaatatggatatgagtagtttttcaaatacttctaaaaaattcaatatctgtgtattggaaatcagaactaattccaatatatagtgagtggattggggagagaccttacatgatatattataggaaattcttactttgttatcccacaaaatagtctaatgtcacaatttcatacaatctttgttttttctccctttgacaggatattttagtaaatctcattaatgtttcagagtaaatatgataattatgcctcgaggtatttttgtcagaattgaagactgctaatatatagggaaaatcctaaaatactaatttcacaaaaataccacatgattgagagttgttgctgagtagttttgaacttcatttcataatggagaatattagttatttcatctggtcaaattatcagatagttctaatcaacaaatatgaaaatgaataacattgtatttatacgatttgcatattagactgaaattgaaactaaaaaatagtattaattatatgcttgtattaattatatgcaagatgagctggaagattaataaaataaaatgtagaatatgttagaaatctgaaagttaatttgaacttcctgttagcctaataacaccattaacataatatcagttcatcacttttgatgtcagtatattaagttgattttgagaaaattcccaaaacagttagagccatctaatcttaaagaacacacacttaatgcagacaattatacgagcctgaaatatagttcttatgatttccagtttgtgcaacaaccaagaagagctatcactaattccaaattgaaacataatatttattttcctaatggtaataattaagtaatttggggggaacaagaaataaaaacagtttgattatataatggaacaaatctttgtctaatattaccaaaaacccataccaaagttagactttctgccattgtgtaatgtaggtatgcgtcttgcatgcattctgcagaaaatataatatttttaaaaagtaaatatctgatgtagttgtgatattttaaaattcttaaataatttatttatcataaatatatctgtaccaaaagttcaatacatgacgtggctgattttagctgaaattttttcactgaaattgaccaaagccatttaaaaagagacaaagtatatggcaatatacataataatttcagctagaatttaaggatatgtgtgtgtatatacatatgcatatatttgtgtgtatatatattccgaaattatctaaatttttcaaaaaggtttagaaactcatggacagtagactataatttgctgaaactaggggctattcatgtacaaagtaccatttaaagaaagatgacggtgtcttaggaatgcttttaagggttctttggttgaaagtctgggaatactcagagataatattaatgagagcctagagtttttttcttttaaaatggggttccatggctttgggcagaaatgatttttatatgtatcatgattgaaaaaactctcagtacaagatgatgcacttctttatacaggtaacaaataagttgaaatcatatttttacatgatttagatatgatggctgataaaacttctgtctttctaaggcttttggcagatgtttctttcaatatttgcattaaggtaaacattcttaattttttatgtaattgaatggcatgattatcattgcattgggtgggagaatgtgggttgatatgttttcattaaattcctcaagaaatgatcaacattttttcagtctttttgcaaacttgacttaaacttctccactaagtgtttccatttccttaaggagaaatttaacatttccaaaaaaaaagataaccagcatttttctttcagctggtcattttaagagtgttcttgaggagctagttttatatggactgtaagataaactgtggtagccgggtatgtgaacatcactccattcatatgtactagcaatacaaaataaacttatttaaaattatagtgcaaatgtatgctacctattagaagagagcatgccatcatttactgtctacatcaataaaattaacttttgttttattaaaaaaggaaaacttttctttaaagtggacaataaatatattgctatgttgtagaaatggtaaacactagagatgctatttctgcaatttaaaatataatattagagattctattgcaaagaatcctagttttaaaatggcatctacattacattattttaaaaaagcaatatttaagagagtttcaaaagaaattaaaacctacattaaagtaaaataacacctttatggtagtgttagaaatgaattttctagcatgtctttgacacatgcaaaacaaatattttaaagaattatttctgtaattgctctaatttttatatttatttaagccttaagttctgattgctgatttccatactttactaataatgcaaatgagaggtcaaagtttatcttttttggttactgctattgcggaaatacaaagaaagcatactggtcactcctataaatgtctcacacatagtatgttttatgtttaacattattacttatgcacataaaaaggcattttgttaaagaggagctctagaaaatcataaagcagatgaagatataaaacacgccttctatttctagctgtttgtacaaaatgagagctggggaatttccatgtagaacgggaatggcctataaactagtgtaagaattcggtgaaactacttggttaagatataatttaagatattatttccaagagttcatacagccctgttggacaacatttcatcacagatactagcttgcaaccatgctacggcaatcataaatactgttaaaaagacatttagctaagtgcctcagttagaaattaatttctgattgaaatatccacttaattaaattcaggtatggtactgaaacttggtcatatcttacctcaaagaacctatttctgtacttgtgaaatatagctttattaataattttaaagtgcttagagttccgatatttttttatcaaagggtattatataagtaaaagtaattgtgtcttatttcctgtgatagataaatgttttctttctcttttgaaatcaaagataaaatgcacatatgcactcaaatgcaaacatatttgaagagtttgaaatgtaaacattcttattttgcaattgcttacatgagaagtatatagtctcctgtcctcttccatcatgctccctgacagcagccatcatttcagtcccttgagaatagaaaggaaagcagacaaaccacctgaaaactctggtgaaagttctcatgatgtggcctccagggaacagcctcttgttttacttgaggctcatttccgctgggccatcctccttgcatgtcactccatgcctactgtgggtaggaaacaggtacttggattgactgattgctgctttgagattccttgacatattttttcatcaacatgaaggcaaaaggacatgaatactcagtcaaaacatgcagagctgtacttacgtgaacacttttaaaatgcgatactgaatcttatataattttaggataatttatgaaaaagcttttctttcttggaatttcttttgtttactcacaagtgatccaagcaaaagatgaagctgttaaaccatgagtcagtatagtatttttttaacttaacacctgagaataaagctgaaaggattgtttaaaaagtgtttcaaatcatactttcaaaatccatctgtgtctggagacccttaaataagcacatgcttcatggtcattatcccagataactgacaatttgtttttctacaaaatctctggatattatgaaacatcacacacgagcttgcttttaggatagattattaataatgtatttttcagacacaattgtatgtgagagtttctgcaagtataaacaataagataacattacagcagcaggcaacactcactaaaatatcaattttgaattgtctgctctctctttgagaaggagaaagagctaactgagtatctttttccctcatgatgtacttactggtctccaatatcctatgccatacaaacagtggacatggtccttgcttagctcctatgaaatacggaaactgcctacctgcttatttttgagggaaaaaaaacttttctagaaagatttttagacaaatgatttattggcctttgaagcaaggacaagtgctataacaactcattaagggacagttgagctctagcaatcaggttttgagttatcaagattattaggaagaaaagttgacacagtttctcaggaaaaagacaaggaagcaaagcattgaaatctgtttctgacttggagtgtctgccagatcctagtttacaaggctggctttctgcctaatccctagcattttcatcagatttgaagactgaataaagtgaactattgggcattagagcatatttctagagcaccgagacctcttctataaatagcataacatcactcttctattttaaccaatgttcagaatccgaggccacaagtttttatatttaaatatgtataaaccagatcattctatgcctgaaagtactagggttttatctgtctgtgtacaggaaattcttctgttaaaagcttagttaacaatatgacattacaaataatgtacctatttttagtggttttattaaattataatgttaaatttaaaaagccaagcattcaccttgagctacatctgagcctgataattcaaaaagtgacatttcagtacaaagccaacatacccttaaattgacaaaactgccctgcttttaaattgttttgtaaaaaagtacttgatatgcaagtttccaacgacttgttttttttctggagaatcttagatactttctgaaccactcttagacaacacagaatgaatattaatgacaggagagagctgactccttcaggcaaaagtggatgagacaagttcttttatgcctttgagaatctgtttcatcatttatatattgaacacatagcaacagttttatttctcttgatttctggacttttagacctgtatgcatcgaagcatattacacctcacagcctgaataggaaagatttgttcagttctctggttataagaatgatataggaattcctttgtgttctcttcctttctgtacattttattcctttctcatgtcttctcttcctactctgcccttcttccttcttttcttcattcttttgtctttcctttctttttttgtatcttaattaaatattttcctatagaatcactaaatgaaggtttagtacttttgacccatagtaatcttcaccagctgaattaatttgtgtcaacaactaagaaatgtaattcttagtttgtatacattttaggttagcttcacaaaatatatgtatagataaataaaggagcagccttttaatttgtttatgtaattggcacacttaaatggaatgtgtcatcatatgaatgtttttaaaattttgcatgtaaagggcttgcggataatttttaaaccgtaactttttgcagagagacagaataatgttttagagtccaaaaaactggcatgtactatttggcatgtttttctttattttctattttgccattgcaatggtaacaagttactgtgttcatgacaggcgtgcagcactgtatttttatttgtttatttattttattgccttgtttgatgttgataatgaagaggttctctctcttaaagatgcaatgaaggagactcaagtgttgttacttgcctgcaattacacatttagaaagcctcttatattttttgtctgttggaacttactgcctcagcacttaataaagcaggaaaaagcatgttttgtaattctcttactatgtaagaactagtttgcttttgcttatctaacatcattattgagtataagatacatagtctttatttatcccactgaaaaaataagaaagatttgatataccattatttcttctgtgactctaattgcaaaataaattgagtttgtgttttaaaattattcaagggacatttttgtaatctacaagaaaagtcactaagcttgagtcactaggctaagttggcctttagtcattgctatatcactgtgatgttagataagtcaccttatttgttttcttatttgtaaactccatagttccaagccaccaagtagggtgcaatgagaagtgattgtaatcataagtgttgtagctttatcactaactctccaaacttatctcttattattctcctcattgatattcatacacaccttcttgctgttccttcacataacattagtggaagttgttgaatctattgatactttttatcttctattccaaggtagaatggttaaacattctgctctaagtgaacatatccaaaccacaattattattcaattcaaatatgaagtctatcagttggcaattctttgtgttaagaaacacatttgcgagcaatagctaatagccataccattgcaatgtggaataatataagtgtgtttgtagctaatctgatttaagaaaacaggaattttagttgggaagggcctatagaaagaatacaaaattatatgaaacataggataggtattaagggagatatttgaatgaatacaggtattcatattgtttcttacaatatgtcaggcacttttctatgtactttccatgcttcatcccatttaatattctcaataactccttgggatttgtgctaatttgtttataatttttaagtgagaaagtagtggaaaaagaataactgagcaacttcccagggtcacattatgtagtaagatgtagaattaaacccaagctacctatttacagagccaatactcaatcataggtagtcacacaatcaataaactcataaatgtcagaagaagagaatagatggtggcaaagaggtagaggtacccaaaagagattaaatagtgataggcaaattgatccactttataggttaggtcaatatgagcatgatggcaataggataaaagtatgaaacttagagagctggattcagatagccaactctggaatggtgaacttcaataagatagttccccaggaatgaaaatgcaataatgtttgcaaattgtctggtgccctgttactatatggtagatttgaccacctttgctcctctttctctttttttattttcagaaattctttcacttgtaaaaatgccacctgactcaaaatgcttaagcaagaaaagggattttggtgctcatgtgaccataaagttcatgaatattctggcttcagtcataggtggaaatgggagctcacaccatgtggtcagaaccaagcctattctccttcctaccactgtaccactagtactcaataatttaacgactggtatgattataccagtgtgaaaagtctacctataagaggatattggctgagttgattgttatttaattctagttatgtccttgccttactctgtttggcttcctcactttttaatgcagaagggtagatagtctttattcatctcattgcaaagataagaagaaagtcctttacaagacttgaagaaattaagcttagtagaaccaagaacagcaaattgcagagccacttgcgtgtaaatgagaatttcaaacttttattagttttgtaaggaaggaggggttatttcaaggagtttataaagttttaacctacatatgctacagattaaacgttatcaatttgtacaaatatattatacatttttatctttgttgtactctgaattgaagaggaaatatttgggaataatatatttcttcggtaagtatgatgatgttcctattatatgccaggcaccatttggatgctggggatacagaaataaaaatagtagacaggtttcctgcatgtaggagcttacattctaaggaagaagagagaccattaaaaacaacaacaaaacattgctatggtacttatataataaatactataaaattgtaaaataggctaataaataaaacagagcaatagtggggaatgtgatcaaccaaaaggaaaaggagccagccctgtaactatcaggggaaagcactggggtcaaatgaagcaaccagtacagaagctctacaatgggaacagtttggtctatttaggtataaagacactggttttatgtgtttcccgtgccttaatattttaattaaaaataatctgcaaacattattaagaagttttcaaaacagtgtaatcatgtataatctcaccatgctttaaatatatgctgtctcatttctgtgtaatatgtttccagtgtgtgttcatatgcttacattttttatggcgacaatcatagaatatacactgtttttactttgacttttaaaatgtattctcagatgtcttgtagacatgtatttttatactccagttttatcttcggaagagtagctgcttttcttttattctgtatattcctcagacactttctacatatcttccgtttcttaaatcttaataattctttccctttcccctcatttctaaagaaattaaatacatggcctaactccagttttattgttcctataaatttaagtcaacaccttaactttttatcacattcatgacacttgtcaatgcaatttccttttgagtatatttttgattatatcctacaaaactctaatttagattttgaaacaaaagtaaataaacacagaaaacataatgaaacaaatcattttgtgtcgattatcacttagacaacacagttcttgtagcattaaccggaaattatttttcctctatctagtctcatatcctggtttcaagaactcaataacctaagtctacctaggttgctatatgatagtaaaccagttgcctacaaaggcatattaacttttgtgagactgcattaccacgcaatctgctacacagtaatgaagtaataattaaagcctcaatcataaatgttcctcttttattttctgctaatgctctctatagacattatattctgataataacatgttttgaaaatggaggtgttttttttttttttttttttgccaaactactctgctccatcaggctcttttgtatcctaaatattttatgttatactatatatatgagtgtgtgtatatatatacacacatatacacacacacgtatacatatacacatgtaaatatatacacatatgtatatacacacgtgtacacatatgtatatacacacgtgtgcacatgtgtacatgtgtgtatatatacacacatgtagtatattatataatatattatataatataattatatattatatattatatattgtatattatatatattatatatttatatattatataatacatataatatattatatgtaatacatatcatatattatatgtattatatataatatatattatatataatatatataatatattatatgtattatatataatatatattatatattatatgtattatatataatatatattatatattatatatagtgtattttgattttttaaatgcacctggctcctctagtaaatgccagtttttcagaattttgcgatgacatttttatcatctctgactcttcagtacctgaaagatattaaggagtgaatattttatagaatatttattgaatgagtgtattagtctgttctcacgctgctaataaagacatacccgagactgggcaacttataaaggaaagaggtttaatggattcacagttccacatgggtggggaggcctcaaaatcatggcagaagatgaaggaacagcaaagggatgtcctatgtggcggtaggcaaagagagagcatgtataggggaactcccctttataaaaccacaggatctcgtgagacttattcactatcatgagaacagcatgggaaaaaccttcccccatgattccgttacctcccactctgtccctcccacaacatgtgggaattttgggagctacaattcaagatgatatctgggtggggacacagctaaaccatatcaatgagtaaatccagtaactctatattttctaacatttttaactggcatccaaatttagtgtatgcatacacacactattagcaaaagttctatgaaatattacttgttatgctttctgatacttttcaattatccttttctatttcattaaataagtactggtcatgatcaactaagtttatattacaatctaacaatgtataacagcctgtattttttttcctttttgagacagattctggctctgtcattcaggttggagagcaagcacatgatcctcccaactcagctacctgagtaactgagactacaggtgcataccaccacgcctggctaatttttgtattttttgtagagacagggtctcactatgttgcccaggctggtcctgaactcctgggttgaagagatctccctgattcagcttctcaaggtactaggattacaggcatgagccaccacacctgtcctcaaaagtataatcttcttgctatattcacatacaggtaattttgtgtgaatttataatccattatttttaagtccacaatgaatctagcaccaatgctgttattggccactcttaagcagattcacgtcagttggctaccttctaagggattcagctaatagctcttaagcttccttttggttgtcatggggttgatatattgcactcttttttgtgtgtgtgtgtgtggataaactttcttgtagatcggaagaggatacacgaaaggaataagggattacctcttttcctttaaaatagtgagtggagaactagtctatggaaaaaatagacaatgaagattgagcataggtatttagagttttgtattcaaattaagaaacaaacaaataacataaaatctgtcaatccttcaccaagtacataatgtgggaattttactaaatgatttctctgacacctttcagtgctaacatgtgaaggtctgtaattgactatggcattttgctgcaagaaaattagacatatgagtaacgcagcacataaagcctttggcttcccttctaacatttgtttactctcatagtggtgaataagtttgaagagtatgtctttcatctttcagtcattcattaatctactcaaaaatagttaaagtacacaaacaaactccaagacaccattagccacccataaaagaattgagtaccatctagttaagagtgaaaccataaggaagtaatgattcattcacatgtgagctgtgaaatagcattgtgtaggatattctgtggtagcaaacagtacaaaagcctcaagggcttcagcacgaaagctttattccttggacataccacatagccattgcggatcagagtgtttggagagtacataggggagagtgtcctctgatttacatagtcattcaaaaatctagactctgagagctccagtgccccagtgtcttataagactgtcatctcaatgtaaagtttaaggattcattgcagtagggcaaagaacatcagaatttcttaccagcaattatctactctcaccctgtaaaagatacataaaatttctgctcacagtccattagccagacccagtcacgtggctcctaattacaaggatataggaagtataacacacccattcccaccccaggcttggaagaagaggatattggcaagtatttgaagagataagctgcatcaggaaaatgcaaagctttctgcaaacacatgagagtgaatgacagctgaaacagcaatggctttatataggaggtgatgcataagatactctgagtgactttggggttatgttaggtgttcagttcattcattaatgaaagcatctctttttaaaaatctaagtctccaacaatgatatgtgtttggttcagaaggccagcactcctggcaaatttggaagctgaacaaaatcattcccgtcttactaggattcctgacacgtagtgcaaccacctacatggcagatctatttagaagcctgaaagacatctcaaactcaccacattcaaactgaactcatcttcatcaacatatgtagtccttccctagtgtcttcaatcttggtgaatgattgcaccattcatctaattttgttatctagaaacctgggagttatacttgtttcatatgtctctcatttttaatctcaaattcagaatatatgtcttaataaaatttttaactcataaatatcttttgaatatgtttacttttctctgtctacattgcagcaccatagttcaaatcaacttgccttctcaaatctattatccttaacttgactttcaagtccatgcattatctggccctacgtattcaccagcctcatttatcatattgttcctttgttctgatactctggccatattggccttttttcaggtttttaatattccagatttttttctgcctcaggatcttaacacatgctggttatgatgttggagtgctttcttttctcttttatctggttaaattctatgcagccttcagatctcaatataggtatcaactattcagggaagatatttttgactcttcagaatcactcagaactttgcattgtacctcctcatagtgacctgtattttccctttacagaatttatcaatttatcattatatatgattatgtatttatttgggtggttatttgattagtaacttcttccccaaccagatttggagtttcaacaaaacaggcatgatttttcctcatccatgtggaccagagcctcacaaatagtaattagtcattacattgcattcctgcctcagatcctttgttcttccccttcccactggatggaatgcacttcctctgtattctcttttgattacttcttcaaaccttttgtgtgtttactcaatttttgtgtggtctttcctgaccagtcttgtagtacatttatatctcctcccacttccctaacatctttcttcttatcacttatcactctttgaatacagtttttaaataaataaatttatttatttattgcctccctttgatcattagactgtaaattccatgataacagagatttttatattttttacttcctgatctccgaatgcctaaaacaacacatatttgttgttccataaatatttgttgagtcaatgaataaatgaactgtgaattgtctctccattaattagaacagctctatgcatctcatccaatgaaaaaaatattaatttaccagtcttaacaatttgcatagagatgacaagcttatacctttaaagtgcatgtaggaaattttctttttttttgtagactaagttataatttacaataagaaggccaaaatgactaatttgtctattataccatacttggaaacttaaactttctagtgaaagggttatatttattataaaaataattttcagcttagctattttctgtcatcatccaatcaccttcatcctactgaattttcctcctaactattgctaatttgtttctctaatctcacactaattattgtaagaaaaaaaacaaacctttttccaactggcttttctaccttacagtcctgctttcttccaactcatcttcctcacagtcacctaagtcactgaacacaaatgtgatcagattattcttctgattgacatacacatgcagcttcctcaaaattagaaaacaaaaggaaatgcctctcattcctatatacccattataattgactttgcttggctcgtcacagtacttgtcacccccaaatacttccctcctgtccctctccatgaacaactgctacccttaactacatcaattttatatcgctcccttcacttctaatttattttttaggtctgtttctcaaagaaatttttcccaacccatctctgtagttcaaagcttatgtaatactctcagcatatttccagcattacatttgtcatgttgttttaggattattgttcatagagccacccccttttggttttgaactcgctgggtttaaagattgtgtcttattctttgtattcccatttactggaggaatgtctggcacataacagacattatcgaaccttgttgaataaaaagagaatgagtatatttagccttgatgggggaaaacttctaaaatatgcacagaaatcaggcattttctaactgtgtttgtaaagctaaacttgattatatcactagccatttatgctttggggagagtaagcttcatgcagtctagggaaaccaagtaaccttcgcttggtaattttcctttcaaaagaagaaaagaggagaggagatgaggagaggacagaggaagggaaaagatagaaaaaaaaagaggagataaaagaagaagagtaccagctctctttgagaagctgattctagggctcatctttgacaagagaaatgttaagatgatttttttggcttgctaaacttgactcatccctcaggcatctgcttaaatcagagaggatacttctgatctctcaatgacaattttgtctcccattatatttcccatagcaccctgtattttttttataacatttgcacaatttgcaattatatatttatttattatactattcattaaatgccaggagaagccactaagaacataaaccataagaggtcgggggccatgtatgctctatggaagcagccacaatgccagttacactcaacacctgacacatagtagatgttcaaaaaacgtttgctgaatgaatggggagatgataagatgcataggcgattgactgaactttaaatagatgctttctttatcccctaatctttaaagaagtatgaagttttctgtattggggaggaaacagaaaataatattgtagtctggtatatttgagggaggatgagcaggcttggttaaaatagaaagctgagctttccacagtgattggatccaatctgaatacaaatttaatcactctatgagtgtatctactatcattagacactaaaattgtaaattcagcaatgtaatatggctgactctttaaaaataaatttttattatttatatctgagagtaaatattcagttttttcatattatagtagtatgaataatttgctttccaaaattcctccagaactgccaagaattggcaaactctgcgtggtagagagatttgaacaaataattgcaacaaaatgaaaatatttcggtaaaccctaagtagacattaagtttgaaaatattgaaaacttaaacgattttaaagaagaaatatatttataaattcatatctcataggtgagggtactgatgagactaaatttagttgacagaaatctgaagtgaatgtagagaagtgctttaaatatatattgctaaaattttaaccttgagtttttatccaattgttttgataatctcttttctctgaatcatggcatcatagatttttttttcttgtttgcttcttttctttgtaatgggaacagtctgtgatcttacatcctctgggtgtgaaaactcattttcagaaactacctaaaaaagtgcagtgaaaaataaatcttctagctaaagataaagtagagattgttactgaaatacaaggtcatatgattttttaaaaaaatatcttattacttgattacccagttgagaataactatgtcaaaaaatctctgagattctatgtgtgtatttctgtaatttcttcgaacagtaatacactaaattataatgttataacagtgaacaattgatgtttattgacacaatgcaaaaaataagattgagttaagtcctctatgattgcaggaaccatttctatattgtttgcaattttttccccagtaccgacctagcaatacatggcacatactaagtagtacttaaaaatctttggtggatatcactgaagtatcatccttcttgattttttcattcgtttctcactcacttatatatttcttttgaataagtgtaatactttaatgtgtggttttggtaataagccttcatgaactgatattagatgtagtcaagtcttctcttccaaggtgaaatatgactttctttcttttctcagtctttgtttccctagattaaatcaccaggtagctcactgttaagtttcaaataaaatatggtaatttaaatgctcattttgtcatggacaattaagagtgaagagatgatgtataataatatattccaatttctctttaatgggaccaactaatgttttggattatttgagccaatgttacctatctctgaaacagataatcattcttgactttctcttttccctttcactttctctccaccttttcttctttctctatttttaaccacttcttcagttatattataaatctctatggcatccaaagtgcgaaggggttctgtcactgaaaaagttattccttctgtaaatatattcaatgtatacttaatactatacacatgaaagtgatatttttaagaaaattatgattcatttctagtaaagagaaatattttaaaggaaatattttagcttgttttttaaataaaaataattttctaaataaaaaattattccataaaattatttaaaatactcaatctaataatatataaatggaaaaattagtcttttttcagacactgttttctttcagtcagccactgttaccaatctcttatattctctaacagaaatatttaaagcccctaacagaaatattgcatttgcaaacatcacatttaaaatcaacattccatgatatacacaacggtctatacattttcagttagattattttatttatgttggattagatattactttatacaatctacagtgatttttaaatgtatagttatatattttatatattaggaatagctatatctactgcttttggttaatgcagcattaagtaattgtgtgaaacatgttaatttgaagtgattttttactctaagctaattcagtttgataatttagtttttttctagtaaaatttgtgatgacagtaacaatgaacataaggtgtactaaaggattttatagattgatcatgtctaaagatttttgtaaatgttccacttctttcatactgcaaagtatccttgtgttaacatattttataacatcttgtttgtttaatattttcattaataattgattctctttatcataatcttagaatattttaatgtttgcatttctatatacattcagacattataaataaaattttataattatatttaatatatctttggtttggggctgcaattgttgagtttaagaatattaaagcttttcaaaatgtaaacttgttaagaatgagcttgcacatgttagctacatgtaaaatctttttaaaacaaaaagaaaaaatatggaatctgtctgaagaaatatgaagttttaaaagtgtttataaaatttggcaaatttaataataatagtttatatgtatagagttttcattacataccaggtgctattttaactgtttttgtatattgcttatttaatacttacttcaaaacctctgtgaactattataatgcttattttggaaataagaaaattgaggcacagagaaatgatactatttgcttttaggtcatagctgttaaatgttcggggatttggatttcaatccactagtatctagatgatttattacttcattaattcaaaaatctctgagcattagttcaaaatgtttcagtattaataagttatttaccctcaaataacttacctttcagtgggggcagaaaaataagtggagaaaggaaggaaggcaggaagggaagagtgagaagaaagggggaaggagggaagggaaggaaggagggaaggaaggagagaagaaaggagagagggagggaagaaggaaggagggaaggaagaaaggaaggaaggaacgaaggaaggaaggaagggagggagggaggaagggaaggaagggagagagaaggaggacaggtgctattaataagctttattttcatgattgctatcaaaaaaataaaaataaaaaacaaggaaagagagtagagagtgccaagttgggaatatgaagacagaatacatttttaaataagattgtcactgaaaatcacatttcaccacagatctggaagaggtgaggaattaagctagggttaaagatcaggccatgcctggtgatttcaaagaaagcaaggcgtccacgtgggccaggtgctgcaggctgagggagcactgaaagctttttttctgagagggaacacagggccagatggtgtaaggccctggggtgactatggtttttatttggaatgagaggtgaaaccagtaaaggattttgagcatatgagtaacacatccaactttgatatttttaaggatcattgagaataaaatattcttgctagaatagactgaatagggccaagggtggaaacaagaagggaatttggactttgttggcctatgatggaagcaaaatacatatctattttatgtatttcctagattttgtgacctctaagtacattaagatagcagtggaaagctcagaaatacattcctatccattttttataagaaatggagtttaacttccctcatacttggtagggcttatcataacactaatttttttaacatgttatatgtacttcctcagccactttgccagctaatttattatcctggggcaagtaaataaaagttgggctaacttcaaggcatctaggaaaatagcagaaaaatatctttttatttttttctatgattgaaagactaatgcattcacaaacgtcagagaatgagaagcattaagggttcatgaatatagagtgagtgcaattggttctaaaagctatcctcctcaaaattcctggattggtattgcttttcaagtaagttattttgagacaaaatggttttgcttttcaatatttacatttaatttcattttaaacaaaaacagattgataccaacattcacagggatacctactgtgctgaaggctgattttgacagttgtaagataatacatgcaattctttgaaattaatcatcacctaaatgttgcttattatagacaaatacatagcaacaaatttagaattaaaagatgtttgtaaccatatgcctgtgatgatctatattttaatcagtacatactcctgatgtttttaatacacagtcagcaagtatttacctattgcctgctctgagatgagcattcagccacatttgaataatgttttgaaaggtttgggttgttttcagggagaatataaagtaaacagccaagaaagacccacaaaatgcttttggagaaaagtgtatgatagtgcgttatttattgctcaaataaagacaatggatatttaaataaaagccatgggaaataagctgatacaagctatatggggttaagtcattcaacacattttcatgatctatatttaggcatgagattaaactggaagccccaccagtcagtgtaggatagagtgccagtttatgtatgaagttttagaaggaatatttttctttgagattaaggaaataatggtatcccatgatacttgcactttctaccttttacagtagtcctccttacccacgatttcactttctgtggtttcagttacccatggccaaccatggtctgaaaatattaaatggaaaaattccagaaataaactatttgtatgttttaaaatgcatgttgttttgagtagcatgatgaaatctcacgccatcctactccatcctgcccaggacatgagtcatctctttgtccagtatctcgatgctgtgttatccacccgttagtcacttagtagtcctggcagttgtcacactgactatcggtattacagtgattgtgttcaagtaacccttattttacttaataatggcccaaatgcacatgagtgtggatgctggcaattcggatatgccaaagagaagccataaagtgcttcttctaagtgacaaggtgaaagttcttgacttagtaaggaaagaagaaagaatcatatgctgagatcattaacagcgatagtaagaataaatctattcatgaaactgtgaagaaggaaagagaaatccatgcatggtacacataattattggtactaggcatagtttcaggaatacagtaggggagctggaacatatcccctacggataagggaggatttctgtaacgtaattgcttttgtatattatcttccctattaggacaagagctcctcataagtaaagaggatatctcaatcatctttatatccaaaattatatatcataaagttactattcagtaaatatttattgattgaagtaggtgatgacatactaaaatataatttcaatatctagccctttctttagaagaaattgattattcatacttgttttaaaaacctgattgtatttctcaagtataatattgttaacttattgaagacaggtttacactgttaagatttaaataattaaaaccaactaactgaattttatttctaaagaggactgctcaaattttgtgcccaaaaaactatgatagacaatttaaagtaagagattttcaagttataattagtagtggaactcattacatgagaaaattaagatgtgtcattggtaatagtaataaggaatataattttgtagaatcacagatattataatatttttaaatcctttcttaagaaattgatagtttttttcaaaatctatgattttggaggatgaggtattgtaggtattggctttgtttgtagaagattacacatataattgtataaagttagtgtaaatggattgctcatatttcaattcttagacctcatcttcatttcctctcctggaaatccttgtgtacaattaccctggtaaatggatggacccatttcaatattttatatttaatttcattttaaataaaaatagattgacatcaacatccccaatgataccactctgctgaaggatgattttgaaagttgtaagacattttatgcaatcatttaaaattaatcatcacctaaatgttccttattatagtcaaatgcatagcaacatatttagaattaaaaagatgtttagcaccgtgctggacacttagaaatgtccaataaatatttctatgatagttattatcatcttttctaatcttgttggagttgttcacttttaggagtgcttcaaagatcacttcttctagtcaccttctgaactcctctttactttttatagttcagcataccactacctgctgattggttaatatctttggtagcttctgagtcatggttcatcaggaaaccaagggtgcgatttgcattcaagcaaatcctcctccttcctcctgctcactgtcacttctatttttactttggagcgcaaggttctttaaggcgtctggtattctgaggcttcctgcatttacagatttactacctgcttctctataagaaatgtgaattggtgacaaatctttaccagaaaaaggcaattgtaattagattaatacctaaggccaaagcttttctttgctccgaaacccgtattctttcccctttttagactactatcaatttttatctcagttccttcagagctcctggttaattttttttttaagaaaaaatcaagacttatttgagaaccttatagttaatgcattgacaaacatgtatagaattcctgctttgtctgggaatgtttgttaagaactagttcaggatttcttatcctggcatccatgtttcttcaagggtttcagagaattttctctgaaattttatacaaaatgtggtgtatacatttgcatatgcatttttctggggaatgagcttatagctccaatcacgttaccaaagggttgagactccaaaaaagttaagattcactcactacactggcagaaatacaaaaaacacatttccttggttgaggaacttgtaatataaatgaagctgacaccataaatgacagtataaaaataaaggtgaaatgctctacaataggtaaaaagagaaaaatcacttaataatcattttggagaggaataactgagactttgtctggatttagaaatgttatttatgaaagttttatgggacttctatcctgtgtgggaaagagtgtgagcaaagccttggaattagtattgattagagtgcatgggaacataacgaagagcccatgtcttgaataatattgatttataaagaaagaaaggttattgaacatgtgagatattaataattctcatggtttaaaatgttgactaatacaatgatacattgtagttgatattttagctaattacccttagatttaaacacttttggattttgaaaaccttaaatattcttcaaggatgttttgtaaaatgcctcagtcacaatgatcatcatgatatataattaataaagacactggtccatttcccaaaggggctaaacacagttttccaataacaaatcacattatagcagtttacactgacacagactgccccaaacttatgtatatttgagttttattaagtacattcagtacagtttgcatctgggcctctgttttatttgattaaaagaaaaaagttcaaattttatggctaaagagagcagacatatccatttgaatattccactgtcacctcaaaaataatatttttttcttttcaagcagtgcttttatttcttacaatctgtacaataaggtgacttgccttgaaagcatttcactttttctatccaaaaaagttataaaaatttgcaaagttaacttttataaattgatagtgttgtctctgactcacatcatcatattagagatgaatttccatagtgggagggaaagaaccttagatccaacatacccacaatagtattttagatcaagaaacaacagggtggggaacatcacacactggggcctgtcgtggggtgacgggagcggggaaggatagcattagtagatatacctaatgtaaatgacgagttaatgggtgcagcacaccaacaaggcacttgtatacatatgtaacaaacctgcacgttgtgcacatgtaccctagaacttgaagtataataaaataataataataataataatgtatcttaaactagactgttcaggatgctctcctcccttctacttttatcatcttcctcctcgctcctttttcttccaagcttcacagtttctgtccattgtaaccagtctttcattctccaactccctcatctttcccaaaatggactcattttccccagaaaattactttcttcatctccttacactgtctttcttattttcactcctcgctataactgcatttctgttacctccaatctacaatccggagtctatcttttcctttcaccattttaaatattgctctaaattcaaggcttggctgaagagtaaccatctgctagaaagtttctgaattacaactatgcaataattatgccatagaactatgctcctaacatgcacctctccagattttaggtacatagctcactattttatttagaattaattctactgattcctcatgtatatgtgtattacctatcttctcacccaaactataatattcttgggtcagatataagtctattttattattggtttattgtttgttttattttgttttgttttcatctatcagatcattaggcacaaaatgagctcttgatatgtagttattaagacactggcaagattttaggaggggaatgacacatagttgctagccgccaacatataatttatggtgtacaaagcacttttacatgctttttctcatttactaatcatagcaacactattatatattatcatccacattttgcagataagaaaacagtacatttagagaaagtcatcgatttggttaggaataggaaactagtaaattgctaaactgagcattaaactcaacatttttactccatacccaggtttccatgttaccatagctgtcttccaaggctgcattttgtacaagagagttaaaaatgaaattgtttctaatatctgtttgattaaaggaaaatatctggaacaaatttgtcaagatagttaacagaatttctaggtgttactgaattttaaagtctccacggtgaaatgatggttaactaacatttatttacatatggaagaaggtatttttggcagctttttaaggtgtaaaacttaagacacctcagaacatgtaggataaaaggaaactttgtcagggatgtcttgagaaacctgtggcaatttgaactgtgctcaggaggaaggacacaaatcatggctgtagtgagatctgtgaagtagtcttccctctacagcttctctttaaaagctaagtaatgggtggcaaaataaaccaaactgaaactgagatgcatgtcatctcattagtgtcttcttagatccacagtgctagcactgataagctcaagtgctgagaattgttcaaataaattctatgtgcaatcaatagaagacctaagaaaactgtgaataagttaatcactataattttatatattaacaatttttcattctctttctcctgatataaatatttttgtcttaattcttatgaattgagggtcaagttatgtctggttttccttccatatcatgtatggtctgcctgaactatagatctggcaagtccttgaactatgctaagtggtttaaatgggataatacttaacatactttgataaaaaccaggtggcttcactcattaacctcttggattcactaatatggaaaacatcatcttatcacgtttttaacatgaaaacaacctacctactacctaccactaatttttaaaataataatcttatcattcaaattatagtacattttaggttctgcacataatactactcagaaattagcttagtcacatacacccaggggatcagtcactgctattataaaaatcaaaaaagttataaaccattcttcagtaatataaaatagagaaaatattttagcaataggaaaaatgaccagtatagacctaaacaatcagttgtttccctttccccacctctctaaacacacattttaaaataggagccgccccgatcaaattttaaattttggcaaataaatagaagacttcaatcttccatagaaaataacattcattttattttactggaggtctgatttagaattcaaaaggaagtcaaaatttaaaaggaagtcaaaaggaagtcaagattaatttggaaataatgggacacaaatatatatggatatttaatttagcaatacattaatcacccaaaataatctcaagggaaaaagtttaatgacaaataacggtaaagaggagaattatttttttcagaattacacaatattgttgaaataactagatatgaatcctaatttgagtaaactcactttcacagagaacttaagagaaacataagtcatattcttgaattgaaaaattaggatgtataagtagcattataatattctcataatggtttggactcactcctaactaaattgcccaaataagttgatctactgctggcctttgccatcaaaaatatttaccaatctccactaggattgtgcagataaatgcaatggctgccatcattacaatcagtatgcatgtacttactgaggaggagtctacaaatgaaaaccaattcctgggaatttgtgggcaatttcaatattaagagcaaccatgactaacagtaaatgacaggctacatttttcaatttgctaataatgattcttgctttaatttttttaaaatttccactgctgatttatcaaaatatatggattagcactgactgtaaagttataatctagatggatcattattaattcttagtactaaaatacatatttttgaattaaacttgtcaaaaattcaattctgtctccaaaatttgaatcaatgttaagcataactttcaaagccaactcacctagcaacattcttctacatctgtattaaagaggaggaaagtcttagtgccaataatcactgaatactaaaaaaataaaatgctcacaaacttagatactcatgaagtctgaactataagagaatatcctggaaaagttgaggcaaagatgtcaagtcttctatttgaataaaatttgttatcctataatttctgcttacactaggccagtagatgacaatatgttatgaaaacaaacttctctgaagagaaactaagactttaactaaaaagataggtttaaggctagaatttatctcatgttttatagataagcaaaaaataaaaaccatggtgcagtgttaataaattagaagtgagtttaatgtttattttatacggatgattctgccataaccaaggcaattataaaaaataataataataataaagttgccctctgcatttctcctgaagacctcaactttcagtctctcatgcgcaaagatgcttccaggggcttggaatgaggaggctagcaatggatatgttttatttttggaaaatctgcaaaaataagctgttttaaccaatattggtgagagcactgtgttctttctacctaactttgtattcatattgcttttataatttttctttttttttccaaaaagattctgataattgtacaagtgtcaagaaacttaacacctggaaccactcctacattctttttctctgcttcaatatctctccccatcagtcctgctcactgaaatccttcctagcagtcaaggactaccctaaatacctcctctctaggcagttgttacagtatgtttatagtacttcgattgtatccattttcagttttaattttactcggtcttaatttatgattgtgttttttaatctgtttttttttttttttttttttttttttttttttttgtgatcaccataatgtagtagcaaatgtctacagcctaaaataaggctggcagagacttgtacccaagccttatgactttctagctgtgtaacatacacaaaaaaaagtcacttattcttttactctgattgagcctcagttcccttacattttgatacgcatcaaaataataggattctcttcataaactcctcacgattaaatgaaacaatgcatattaagtgcttatcagagatcttggacaaggatgacaactcattatgagctagttcttacaattacggctatttaaagccaggcacagaaagccaaatatctgacgatctcaccaatatgtggaatctaaaaaagtcaaactcatagaaacagagagtcaaatgctggttaccagagactgggaggtggggatggggagctgttggttaacggacacaaaatttcagttagacaagaagagtaagtttaagagacctattgtacatcatgatgactgtggttaatagcagtatattgtatacttgaaaattgctaaaaagtagattttaagtgttctcaccacaaaaaaataattcagtgaggtaatgcatatgtttattagcttgatttagccattccacaatatatacatatatcaaaacatattatacaatataaacatacacaatttttatttgttaattaaaaattagataagctaaaattaaaaactaaaaaaaattgtgaccaagccactatttttgatgtattctccgttgaggttttccataccatcctgcaaaatacttagaaaataaatatttattgaaatgagtaactcatgagaatattacttttttgagatataaaattattttgaatacaaaatgagcaaagataaaaaagtgttttttcataaaactaatttgtgacatttaggattataggattaagtaatcagcatattaaataaaacaaccaaaaattcttcaactataatgtttattctgtcaaatgcataatgtaaaataatatttgttttggcaattactgaagactaagcatttgtttgcctcccacataataagcagactaaagaaaaacacatttggtagcttgaaaaatggcatcttcatatgaaaaattaaatatttctatagacacattttcatttatttgtgataaagatttaattttaagtatttttaaaagtattccataacacaattccatttgttgttgttgatctatatacttacccatatgtaaaatattttaaataataacatatttgaagccaccgggcacaaaaatgaatgattgtgaaatgtgcaaagtatttgaatagtgagagctaattctatactattaaggacaataaaaagtgcaaaagtaattgtaactgctaaaatattatttcaagttttagtccatattttgatctatggtctaaattgaagtttattgattctgtaactcattggagtttcaacctagagaaaccagtcactgtattatgctgggggccttataaaaagtataattgtgtagaagaaagaaaaatgggtaagagaaacgtaaggacaggagacaagtcagctatttagttaccatgcaatgcagttatttgggagctttttctcaaatgtaaactgagaataattatacctaatttaaagctgggtggtgcatagagcacttggatcaatttctggcatatagtctgtgacagagctatgtaaataaattaatgaatttatatctagaaatccaactctgtataccaccaaatccctttattattttcttttctctaagcatttaatgtaaagtttgaactgtattattctttcctactaatttaaattgctgcttgccctatttgaataaaaaattgcctatttctatggttttgctaaatagtgaataactagtgcccttacaggaatcacaagaaaaacacactgaaaaatgtacttggaagaaagaatatatggaaatatatgataaagaaataactgggaagatgccttaggataaattatgaaagaaaatattttagctacccttttctgttgaacaaatgagaaaatgtggtcaaaaaacaaggataaatctattgggaaaaaaaatttatctcctattacccaaaattttacctgaaacatgtttttaaggaaagagagaacaaacatattctgaaacatagaagaggtgagtttaacttgaaattaagagcaaccaccctccccaaggggaaaaatatctccaaacctctctcctcatgtaaacagagactttagagtattagcagtcaacaatattttcattaattatttataatgtagaaagccatgcccatttaattccattttcatttaaaacactacaaaatatgatatatcttcattttaaaaattatgtgaaaagaaaatatctgaattatcttcatttctttttgatgaatacaaaaagagaaaaaggaagtagtttttactttacgatttctatatctttaggaagataataaggaatcttaaaatccaacatataaaatatcactttctacagcaaaattactttcaataaatggaaacctataattaaataatttaccttccttaagtctgagaacctcacaatcatgctcttcagttcttttgacttaacaaaatatctatataagtgtatgacaatgtcaatagtcaactgaaggcaatatattcgaggtaaattttattttaaacttttcttctatttcatacatatagactacaaaatagcaaacctggcatttaaatatataattccttcaaattaattaaactaaaacatgtcataagtagcttttatacatgttttattaaaaataacacttagaaaatattcagcctaatttatctttaaaaatgtcaaataccaggatacttttaatgatttttgagcataaaagaaaagcaacttttctttctctgtggttcaaagatacagacatgggaatattacccagtaaactatccttgtaggattaaattttcagtgaccagaagctagattgttttgttttgttttgttttgtttaacaaattaggctcaaatactgtccaaacctaaaagtggatcttcatcattacataaattctgcaagcctaaacaatgacagcccgagactgttgtacagagacatatgtgagactttatcctgatcctttaaaatgaatagtcagatgatggtttcacactgatacaaattagatttcatatgctgatatgctcaataatgctaacaaggatctatatataacttattaagtgctacaggcagagcctatgctagggctttacatctaccatttcaaatgctcatcaaaatcacaattaacctattgataagtttgtactggtaatttaaaatttggaggcattctttttccagtggttttgaaatattatgttcattagagaatatagtgccaagcctctgatgcctttgttggtttttatttcatgaagttagtgtacacagcacctctgcctgagcagagctgaaactcccaagttaggacatgaaccaaatataagggccacccagagcttgggtttaggcagccttcctcacctttagctcctaaagggtgaaacatctcagatgaaaaacctcactaaccaaaactcctaattactaaataaaacttaaggcattcataaacgcttgaatgtctgaaattgcaagtctatacagttgaaaatgcattttctgaattcagatatttgcccttgctacataataactgtagaatgttgagcaaattacttaaactcagtgtctcatttgtcttatctgtaaaattggaataagactagcactgcctcatagacttattttgaggattagagtgacttaataaatatcaatactcttggaacgatgcctggcaaaattattattgttttgccttgttgttatcttagataggttgtccctataccatgccaaaactattctgtcaatttgagggggaaaaattaagagtcaaaatagcaagttggtgcttgaacatttactttccttttggttattttatcattgtgtcaaagaattacaaacaacataatccctattttcaaaacttccttagccctctgatcttcccagagtcacagaaagtagtagttgaatggctttaatctagtttgtcttagtaatagaccaacaatccatcaagaaacaaatgccattctatggccctagttagatagaattcatgattgttttttcccctaggactgcattgcaacctcagacaagaatggcagacagccagcaggttctgccagctggctttgcactgctctctgggttttagagaacaggagcacagatatttttgattctgcaggccaattcaagcataatttacagtgaagaagaaaccctttaatagtgatttcgcatgtagagaaattatatttttaatataaaagaacatcacaattttttaacatgcgtgcatttgaaatggatacttacaaattatcagctaacatgggacatttctttaaaaagcatgttttccaacaattgattgcaaatccagtaaagatataaaatgacctgttggttttgagatattttattcattcatctcttcaatacatctttagtgagtgtctactatttgctcaacactggcatgactctgtattaactttattattgacagctttgatgtggcacattctgctgtaatattgttgcttatactatactaatagtggaaactattgctcactaactataactagtttaaaataaaatctgagattaaaatttagcatttaactttcttaataattgagattattgctgaaatcattatgaatgtttttagtgtagggaactttgccttgtccctcagtgtactagaacagtgcctgacagttaagagtgcaatgtaataactaattcagtaaataagtatgaaaatctaagaaatgcagaatgtcaattagaggaattatgctaatgatgaaaggctacgaaccctggaaaaaattttcatttcaaaaatatacataatattctcgaaatataatttttatttatatttaaaaagatgtgcataatttgtattaaatacatatgaatgtattataaggtaaaaaagatgcatgtctatatttaagtgtgggtggagagaaatacaatctactctatttaaaagtttctaaaatgtacttgtgaaatattaatatttttcacctaaaagagttttttcttttttcttattcaagaaagttttctctttgaaatttaatgtagcgcttaaaaatattcagtgctttgtttaatacgcaaacttagcataattggattttgtgagcctggctcttaaaacactatgtgaaaactttttctctaatacacttagttcaatatgctttatactttttatcaaaactttgtaatgaattttaaaataattttatagctagattattttataggtaacacaaaatattttccaagatgaagttctttgaagcaaagtcattaattttgttatataattgaatttagctcctactttttaatctaagttacttttagaaatataaattagaaagtcatatgaatagatagactccttattgaaagtaaagtagcattatcttgtaattgtacagtaagaccaaacgcaaatgtgacaaaccaggttaatcaaataaatggtcattgaaaattgctattaaatgtgtaagtggtgactaagagaggctgaggtaatgataattatatttccatagttttctgataaagtagatgttttggatggaaaaaatactgaggtgatgtttatttacttattattttattctttcatttaacaaatattgatttaaattgacgctttgccaggcactcttctattactaatactaaatttgtgaacaagccagataacaaaactgctctcagggaacttaaatctgggaggagaaggcagatgttaatacattataactatggtgaaatcaggtggatttaattgtgagaagaaaataagaaagaccagaaaatgatgtggggagacagggccaatttagattgaatagtcaaggaagtctcctttgaactgagatccaatgacaagatgccagccattacaagattgtgagtcctattctctaggcaaaagaaagagccaaatgttccaagggagagagctgatctcggtgtgtctgaaaaatggagagaaggcacattagagtggagcatggagaactggaggaaggaagtggagaagaggctagagcacatgcaaagtacaccacatagggccttgtaggccatggaaagaactggactgaactacaagtatcatgaattgtgaacagcatattggtactatttataattttagaaatttcttttatgtggaacaatagctgttctatactttttatagttacatgaatttggattcctgttggtgaacattcttatttcttaatttgaatactcaataccatcaaaatgcatgtaatttttaattcattgcggtttgtcagaacactagaggcaattaaaatcatttgacatagtattttcctttttatccttttacatgaatgcatttttcagttatttcaaaattcaattgaacaaaatctaaaccatttatttcactatatccttcataaaacatcacactttttaaaacttgtatggatatgtatctctatctgtttgattttatattaatccattgcttctctaaccagaaagaatagtagtgaacaatatcttttcaggttaatgatttaatgtgtcatgaaatttttcatgaagtgtatcatgaaatgtttcatgatgataaaactacttattttctaaaaacattaactttgaattgaatgtggacctcctaaaatatttttttccaaaaagaaagtcttcttccatgaatgatgaagattagtgttggttactgagttcgagattttattttggtgtagtattttttcccttttcttcattttccagacatgaatgtctgccaaacacacactgtatttaaacccctgagaagttcaaaagggattggagacagcaaagggaggtcttttatatttcaatatcctctgtaattaacatttctgtcttagcattaataaaactaagcttttgcctacttttgcttttgattttagtggttgaagccattattatttgtgcaaaaagacaatctagtaacacaagtgtaaattggagggtaatttgaagagataatttgctgttgtgaaaacaagtccaaatatttgttcatgtagttgttggcaaaatggtgatcatagaccaatccaattctcctcagacaccaactggttgttgttgagtgcttggccttcacagtagtcatgtgatcaaactccatcatacatgcttgaaacatctttaaaaatggagagtactcttaatggatgaaatgtggatgctgcctccttacctctacattcctaaaaataatctacattcctaaaaatacacttcaaactggaaaccatcattctcagcaaaccaacacaagaatagaaaaccaaacactgcatattctcactcataagtgggaactgaacaataagaacacatggacacagggaggcgaacatcacacactggagcctgtcatagggtgggggatgggagggagggatagcattaggagaaatacctaatgtagatgattggttgaggggtgcagcaaaccaccatggcacatgtatacctatgtaacaaacctgcacgttctgcacatgtaccccagaacttaaagtataataataaatatgtatatatatatatatactttaatactgattatgctgatcatataatcgcaattacacacatagtgttgatcttatgtgtgtaactatgcccactgattcttgaaaaaatgacaatacatttgtttacataaattgtaaagaatccaattgaaagcaagctcaacatatagagtagtaaaaacatgaagtgtatcttagggacatctctgtaccttccacatagggcaatataataggtcacaatttataaacagccatctaccagtgttagttccttataaacaatgatgcaaactagtgtaggtaatataaactgaaaatatggaaaagaaaaaataatttgtcagtaataacagccctcactttgaactatagcaatactattgatgaatatcagtattattatattttttccaggaggtttctcatttttctagaaagtggtagaccttgagttttttaacaaccaaataaataaatatacaaaatcaaattaaacataagaaatttaagtttatttttttcattgatgtgggtgcacacacattaactgtaaagcagaagtaaattgatagttggttattttactggcaactgtgttttgtttgatcttgacatctgatactcatgaaatttgtagcgtgctgtgaaagactctgacactattaaaaatttgaagctccaaataaacatactggatgcaccattttctgaaagtcatttgtgagattatgtactaaagcaagggtcttaatttcaagtcttaactattcaaactctactaacgtaagttctgaaagaggaattagggtcatagtattaaatcagctggatttggctacaattttacagaatcaattcttaactcagaaaattgtcaaaattcatttatcttatacctcatgtgaaagtagtatggcagttcatagaagtaaaataaaaaatcgtcaaatctgaaatttatctttcaaataaatgtagatacttttttgtgttttatcttaaaaagagttttgtgttttatattaaaaaaagagaaaaatctcaaaatatttatacatatacaaaatatatatacaaatatatattatatgtatatatatttttgagatggagtctcactgtgtcgctcaggctggagcacagtggcacgatcttggctcactgcaacctctgcctcctgggttcaagctatcgtcctgcctcagcctcctgtgtagcctgggattacaggcacgcaccaccatgcccagctaatttttgtaattttagtagagatgggttttcgccatgttggtcaggctggcctcgaactactgacttcgtgatctgcccgcctcggcctcccaaagtgctgggattacaggcgtgacccaccgcacctggataaaatatttgtatattttatatgtaacacttgttttataattatctgtacaattcaataggcttttattctttctgcattctataaaaaggttttctttattggttaaagagatacacatatattaatttcaaaaattgctgaatgaacatgatttacaatattctgaatatttaataggtatgtatatttatcataatcttgaatgacaaattataagatagttatacataaattaatttataaatgtgccaagaattttcttatagtttttgaccatattttataaaaagaaatttttgtaccttttaagctagaggacaattctcttaccccattattttttttctattaaaaaatcacatattattaaagaatcacagttgaatctgtattacagaaaacttgatctgtctcattaatggaaccaagtaactactgtattcagtaagaaaaataataatttaaacagctatatatcataacagttattagaatccccggtaaccaaaatttagtcataaaccaaatttactaatttttgtttttatagtgaaatgttacaatttaaaaaacaaactggaaacactagtgtgtattgaatttgaatttatatttttatagacaatgttttcctataaatatttgtgagattttaaattggtcatgatctgcatatgacttagccttatgatacttctatattaagttacatgtgatttatccattggaaagctaatggaaagcttagatacattgaagagagacactattaacgtgtaaaaatataaaatttgaattttttagtaagtattcaatgagcacctactctggaaaaaaataatgtactggatctttggagaacatggatgtataaaacatcataacctctattcaccagttttcgagtatctcgacctaactctgcccaaggatgaaactcattaattctagagtagctcatgatacgtaagtcaacctgaaacacagaaaaactatctttatatggaaaacttttaaaaagaaaagtgctgcaagataatgttatttgacatttgaagggaagagatacatattccattgttcaaaaatgatgcaaaatctgctccattacatgagtaatattatatgagccatagtctatacaacataaaaatacacaagtggacattcttagtgttctaataacatacatacaattttaacctgaaagatcaaattatatatataattgtcattggcaattaggcataatagaactaaatgttttagaagagattttatttttttggtaaaagatttcaaagtttaaatagaatcaactttcacttaaatccatttaatagtttgtaatattgtcctatcttgagtctcaattatcattgtatttaatcatcttataataagaaggccaaatatgaattaagcaatctcctaagatatctcataaaactgtagcttttttgttgttattgttcttacctgaatacatccaatagtaggcactgattacttggtaaggcaattttttgttccaggaccattctaatcttgagaaatgtcttcctgttttctgtgggccagaaaagtttatcatctttctttagtaacatgttgccatgattttaaagagattaattatctggggccagcccatagttccttcttagtagaagtacagaaatcccgcggggggcgggaactgacttacctacacacttccacataacatacaatgggttttgccattaagatcagctttaggagtaagaatccaccaatttcatggagaattggaaactctccctatccaaattatctaacttgtatgttgacagtggtgtcccggtggtaattgaaggaaaacagttgtaatagtaatagctaaattgtcttgaacactcactaatatcagctttacattcaatgtttccttcaaagtcatacaatttatgtttactaaaattccttaagcaggaatggttgggagaaaggtaaaccatctattcttctcccctaaccttttattacatggcatctacaatatattggattttgattttcttactgttgtttattttcattttatttcagtttcaataaaataaacctaaatacctgaacattggactattattccttttaagggaaatgacctaggaaaagtaaagatagagttttttgacctttttaatttttttttaaattacagcacattacaaggctattaaaagtgttgtaaataatgtaaaatctatttaaaactctaatatggagaaaaattactctaattatatgtgctgcagcatcaaggaagttttttcccccaaagggcttctcatatttcataaacactgatgagttttcccttcaccgaagtaacatcaaaattatatttgtaatttagaagtaagtctccttgtcagtatatttcaaggaatctgaagaaataaaagcactatttttagcatactccaatcaagccagtaaataaagatatggaatatataaatataaagaaatttgtgtatttagaaagtacaattataaaagaggttcctttcaatagaagatgatttattgaattattttctataacattaagaaagtcttgaaatagaaaaaaaaacaaaatgaaatcaaatattaagttctggtgattgattttattgtaggcttttgtgtatgtattcaaaaagtaggaagatgttctgagggaaaaatgtatttcctcatgacaagtggaagttcattcaagtatttaacaaatactggtgagtacctgccaagtacctgattctaagggctgaagatatagcagtgcccagaacagaaaaagataccaaccttcatttagtttatgggataatagagagaagcagatagatgtactaagttgtaaaatatttagtatgtcagactctaaaattctatagagaaaagaaagggaaaaaggccgtaacagcagtaaatacatgagttgtctgtgggccacaaattcatgcgacagcattcaagttgtgagggatacactggaagtcctggcctcttgtggaaattagagtaaacagaggattcattctgcctgtcttgatgcaggtcgtggacagactgggggtgtctgtcctggtgtaagaaatgaccagagtcctgccaggaagaagcagtgttctgggctctatctttactctgctagagcaccacggtatccctaggccgtattgatcattctgtcattttcaggttaacatctcatcaccaaaacatttattttagtgcctactgtgtcaaacgttatgctatatcttgtgcatacaaagaaaattaagacttcataaccgcacatgaaaagcttaattctggcactttaataatacctactgctataacttttgatgtaaattatttaaagataagattttcatgttgtatttattaaagtgtacatttatggcaaagtgtgtttagacagggaatttaacatttattgaggtcctcctcttgtttgggtttgtggtaggtgcttcaggtacattaccttataaaatcaccttaaaacattatcttcagttgggtgtcatgtttcccattttaaaagaagaaaaaaaaagatatgcaagttcataaagcaagcaagtggcaaagcagacaattgaatcttaagtattcatttattctttctgtcaaaataggatgcctgcaaaaaccaccccataaaatagattcattctgtagcttgataatattatcataattacctatacaatatggaaaaatcaattagtttatatgaaaatacattaaatcagaatatattacataatacataaatagatttatgtataaatcagaatatattacataatatattatatattagctctctgggatatcacttgtctagttaaggaccaagagattgagtttctctagcaaagcaaaatgattacgtttcggtaatgattcttagagatttacatcgtcaaagcagttctttccagaagttgcatacttattagagcattcaacactaaattcttctcttatgtactgatgaaagtatccgaagatgagctgtctgaaaccaaaatataaaatgccaagtgccgttaggtcaaacactctgatctgcctcccagttattactgtcatgaagctaccttttattttgtcaaatgaaataaaaatgtgagtttgcctatgctttacaaccaaaaaagcatcatcaaaaccacaagttcttaggacttaatagaagcaaaatgatcaagatgactgtttgtacaaagcattgatctgtttctctgctttatactttgaaggtaatgagtaatttaattacctctcaggtatatagagaaaagtttttctccaaacattttctagggtctgaagtatctgaaattgatcagccagcagccgtgtgatcacactgaaagtatgcaaattttggttttgcctaaaggtcaaaataatagaaaatcacaccaagctattaaaatcttactttatttttttgtgtgtttttctcatcttgccagttttcagaaactcaaggaaaataatctgtcaaggattcttcactatctgatcagcctgaggcaaataacttcatctccctctgcctcagtttcctcatatccacaatctccacaattccatgaaaatcctactcattcaactaatattcatggaatttcccatttctaagcacagagggtctttcttaatccattattttagttgaaatactgaatttaaaattacaaattttgaagacggatcagtttttctttttttttttaagtactggttatgttatttctaaatataatgttaccttaagggcacatggtacaacttcaaagaaaccagaagctcaggctacagtctctgtcagttttcataagaacatatctcaacaatataaaactgaacagaactcaacagttcactcttagagcagaatctgtgtcaatcattctgctctaatgatcagtacttaaagccaagatattttccccaaacactaaaatatggttttcccatgttccagtggttatttggtaatatttccactttaccctgtattacaacttctaatatttctataaataaaatagacttaatagaatattgcagtggaaatgaataaaaagaattcatggaaagagtcggcagagtccactattttggcccttagtaaagtcatgacatgtccaggtttaacctcttatctggaatatgcagaaaatcaaatattttttttacttcatttgggattgatcaggttctgggacactgatctctattatatgtttcataaagaaatgatttaacaatcagatcatgttttattaatatataattaaggcatttcaatcaaccaaaagattcctaatccctgcaggacaaagagggcatggaagttgccttttatgacagactctgtattgctcctccctgtggatatggaatgatttctgcccagaaatggctatcttaattggcattgcactgagtaaatatattacagttactgttttttctagcctccatgcattttttgtgctcccattcacaattttattaacttattgtaaatatttccaaggtgaatggttatctaatataagtgtatgattagtttaattactttatgaaattaaagtatgctatgatttatcatccatttatttacaaaacatctcagggtgagttatttctaaattgctttgcttcgtctgtttccttattttctaggtagaaaaataatttattttttttcttattacatcttcaaattgttttcggtatttataattcctttttgctcttaagattctgattaaattctaactgcaacacaaacaataaatataagcttatgctttatccatagggaaaaaaatccagggacatgtatacccccttctatccagagagaattgttatagaaaccattctaaccagacttatttgctgacatatttttcttatggttaaattttggtcctcttataatctaagcctagatagacagagacatagatatagataaagattttgtcctcattgtcctccatgaaggaaaattacagataatgactaatcaatataatatctacttgttttcttgaacattgccatcaccaaactagtactttaataactaacacctatctcaatataatccatttcacttttggttgttgtaattcattttactgcaatcgaataccatgttattctaacttagtcttcaaagtgtcaagtaccacccacaacaggttgttctttcaatttttaaaaaatgtactctctctttaaataatagtcattcataaagttatcagatattactgatgccctagtaccatctccaatattgtttgaccccttcttcctcctctgttcacatatatccagcttggcattatcagcccccaaccctgttgtttcctgctttattcatgtacatccaagaatcactacatttcatatctagaaataaattagaaattgcttcctcaccattgagtgggccccagaactatttacctactaggttgtaagcttcctaaggaagggcagttgtcatcttacatttgtagcccaaatgcctagcatagtccatgtggcatagtaggtgtttaacagatatttgctaagtaaatggatgagtgaataattggataaacaaaagcatgaacttaaaccctgacctccttgcctagttcttatagttcctttattgcatatccagtgtgtcagttcctaaacattcaatttctgcctactgccttgtactaaacctgggttaacttttttagactctaggactcaaataataaaaaggcttagggatttttctgcccttttaattgatttctcagctcatcttaaatccctagatatttacatccatctggttcagactgcaaacatttatttgttgattcattcaattggtgtatattgattttttaatgtaagttgttgaattttgcatgcaacagggagtaaacacgcaacaagcaaagcccttgccttcatgaaaattgcagtctagacaaatagagtaattagataattattgcaaaaacacgcaaagttacaactctgaaaaattctacagaagagggtaaaatataccgtgttctgagagctcatagtaaggaaacttgaccttatcgaagaatctaggctttcaccagtagtgtacatgtgagctgacaccagaaggacaaactggaaataacctagataatgtgcatgggaaagagaatccaggcaaattattgagagggcagacaagagaatgaaaagtcccctgtatgtggaagttcaggcaatgcagaaaggcatgtgtaagaaaagatcaaagtagacatagccagatcatgcagggccttttagattatggtgagattttgtttaagagtaatggaaggccactgaaaggtgttgaacaagagaggaaaatgatcagatttgatttttaaattatcatccaagcttcagtgttgtaaataggtgaaagtagcactaaggtggatgtagacagattagtttgttgtcaagatgagttttctggcttgtacaactagacggatgtgggtgttattcattgagatagaaaacacactgagtgtgtgggaaggctgtgaatttgattttggacatgaatatgtgtttggaaataaatcctaggagagatgtcttatagaaaattgaatatattggttgagagctcagagaaaataatttgtgtttaggtagtaattcaagctgtggatgtggaagaaagtatacaataaaaaaatggagagcctaagactgaaccttggggtgcgccaacatttcatgtctatgtacacgagaataagcctgcaagctgatagaggaaagactaaaataaggcaaatatgtgagagaagacctggaaagacatggtttaagagtgagagaagatgctgtatcaaaaaaaaaacagtctcctttgagatcacctaaaaactgaaaaatgtctgttagatttagtaatatggaagtctttcgggatcccagcaagggctgtttcaatgcagtcatgggaccagtcaacacaatggtgtggggtgaggagataagtaaagacaactccagcctctctgagactttttggtcatgatgttggtgacaccttgggaaagtgaggagacttaaatgctggggaaacatttgcgattgcctcatttctttcactttattctaaacatggtagtgatggagtcctagaggctccccattgggactacctactttgttaaattactaaatgtgatgaatatttgttgacaatagtacctaaaaatttgtattaatagaatcataaagtcttctacaaggctcaaagtccaacataattgatgacatcgtgtctgacttccaatattcatgacttcccaggtgagtttccatatttctgaaagttttctctgtaacacttggaaaatacaatttagaattgggatatataagaaagataatatcagggatggaatgttaggtgtatctgtcatttgtgatattttacaaagtgaaaatagatttattcatatatttttaccccatcttcttcctttcgtattctttttttcttcttgttctctttaagaaatgaatacctaatgtttattccgtactgtacaaggcactagatgataaatagaaaaaggaaattatgagataatgataaatacactgaaattgctgaaaaagaaaggctatgtcagaatgaataaagataaggttaaagagaatagcattgagaggacaggtatgatagatacttttgaatgcaaggctgagacgtggtggagaataaagcagcattgaaaaaaataacatttaacagagatttcctagcagctctgtgaaggtctaaaaataaagagagtttggttattgtaataatctggatatcaattttaggaagtgtatataaatgaaaatcattatgtaatggaagtagtctgaagactcagtaatcaacaggggcatgcaaaggtaaaggcagtgaatttggaaataacaggaactttttaaaaaagatgctttaaaagggagatgttttaaataagtaaaattataattattggcttattgggcatcatgtgttggtaggacatctaagtgttcatataataagcaggagaaaatgctcacacacttggggttgccctgtaactcacctcaaattatcactgggaatacccacttagtaactagcattttctaagagatgctctacattgataaatacaagtgaaaatgtccattgattgaaaatatgttacacatctattagatttatttacataagactggaaagttatattttacttctaattataagtaaagttatttttaatatattcacttctactggatgttattgagtctattcttagattacctaaatagaacatttcaactttgtcacagaaaatgtacacaataatcttgattttccatttaaaattcttatgaagaaggcttatttttaagaactaaattctaaattttatttctctgttcttcatagatatgttttatttaattattgaatttattttgttttctttcaaaataatttttaagcatattcattttgcatcaatctacactcattgtaaaatctaacattgacttatagctattagttaattttaaactaagcaaaatacactctttttgtcttattaattgtgtatttgagaagatccataaactttgaaaaaattctatttcttcaagaaacaatttttaaacttctatataatgaaatattaaatactttattatagttaaggaactttatatattttttctctagatctcataatgatttaaaatccatacatgcttcaaaaatgctttagtatgctcatttctccaattgtttaactgaaaaatatcctgtaatgaggtcagtgattattttttataaaatgcagaattcctcattcattctttactctgaataagtatttaagtagctttttccagtatgagttgtttgtttatgctttgcttgattgataatcagattctttacaacttttatttgatcttgtaaaatatgtgatttatttaacacaatggtgggtacatgaaatgattaaactaatagtaattacagtctaaccattaaccagtgatatagatggtgaacaaatcaaccttatgtatcactagtcacatacatggggatattggaagggtatcttgctatccaaaatatttattgtgtctctaggagtctcataaaaatttaagtatcttgggaaaaatgggtatgttgtaaagggcattgaattgggtttgccttgagaaaatcagttaatttctttaagtttcagtttcttcatttgtgacatacagataataatttttacctatttcacaatgttattctgactataaattagataatataggtaaatttatcaaaataaaaagatgatattaatgttcaattaattattcttttgatcacctatcaaattaatcactaatcaaaattctgaggatatacatatatatatataaaagtaaattttcaaaggggcattgggaaatgattgtggatcttttacattggagaaatgggtattgcagtgaagataccctggaaactatttctgtgagtgggaaaaagatggcttgtggtgctgataatgaagagtgaggtgcataactgggactagaaacacaatggaaaaattctatttcctggtttgtcctggaatctattctgataacagtctatggcctctgcacagatgttttcatatggattagccaccaagcagtttaatgcattaagcctactataacagcaacaaattataatttgtttgtattgatgcacatgttagatagatagatgatagatatgtgagtatagatagatagagcgatagatgatagataggtagataggtagatcgatagagagacagatgtttccacttaaatgccctcatttacataagtttaaatagacatatgaattacagctcaggctgatttgacttcatttatggttcctataccttttgatgtttgcctaaagatatattcagcttaagtgctatattaggaatatttatttttcttcttataaaatctctgaattcaagaatattattttgttttctatgtatttttatgtattaattcatgtaattaaatatgtacacttgtgagatatgtacacagaatacagagtttgtacatatgcagacaattataatacaaaagtgaagattacaaatgccacattagtcatacagaatgtttggggattccaaagagggtgtgatgacttctcacaggtggtgaaagtgggcatcttagaggaagtgtcttctgagctgtgccttgaaagataactagtaatctctttaaaaagatagactggaactcaactatgagctattgaacgttttaaaatagaaaggtgatgtcatcagagagatgctttaggaagattgaagtagtggcttgaaccaggtggactggaaggcagggaatgactctgcaggtaaaaatgcagtcagatcactattttaataatagatcaaaggttcccaagcactgaaccccctgctacagaagcatctgcagagacttttgaactgcaaatttccaggcccctcctcagggcctaattcagtgggtctaagatatagccccagaagtaatattaaaaacctgcagagtgattttgatgcatagccaaggttaagaaccacaggctgcaatgaaaaagctctggcctcgctgatagactcgaaggagggtgagaagacaagacaatggggtcaaaaaagaaaaaaaatgtagaaatgacacagaagatattttctttcctgttgtccaaatttcaaaatgataatttccactatttgaatttaataaaatacacttgccaaaaagtttgtcttatatatgtatttgtctgtattttatctatagatgtattgaatggttcttttcctgccatttttctcttatttaaaaaacaacaaaatttgtctgaataagcttacaatatttcttttttttctatttattctggctagaattttgaaaatgttttaaaattttatgtccttttacaattacattgatatttaaaatgactctgcttcttaccatggatatttttaagaagaaaaatatcagttgatgagaaagaaaaccactatgcttgagaccattttcagggctttgttatctacttttcatcccaaattctatatatttttattaagattccctaatgcataaggatagaaattgtatttgtaaatgctaacttaaaataccagtatttaattatgttgtgttgatagggatgatttattctagactttaatcggatgtttttgtacctaaatgaaatttagtcttattttaattaaatggtagaacatgccaaaaatgatgggtaaaactagaagaaatgaaccccaacggaagactccggtttcagttatcagttttgtagctgtaaagtagttaagctctgtggttgaacctgccagacaggcattaacattatggtataggattcatctgctgagataagattttctcttatttaactttattgaaatgtctgaataaatcactaagccaaacgtatggtttcttgtttaaaatatattaaaatcatggcataaaacaaaattctcatgtgaagtaaataataaaaataattgtgaatgtatcattcaaaacattttttcaataaaaaatgtttgaggagagctcagatttggttactgaaaccaatattcctttgataacttatttctcttttttgtttcaaagttcagactagttaaattgacttatttctctcttatcctacttttttgtagtcttgcaactaaataaatttagttattacttattgatctgttcgcttgaaccatctgacattttttcctattgtgtacatataaaataagcaaagtatcctttatttataaaggacttggttaattgtacccaatgaaactatcaaaaccttttttaattacttctaaaactctattctctgttcaagtctccgtgtttaatatttaatattgaaaccatagtgtttactgttttgctacctaatttctttttaaagactttattttttagagcacttttagtttcacagacaaaattgagaggcaggtacagagatttcctatgtacccccattctcacagattcatttcttttttaaaaatataaacttgaaaacttttctttttacaatcttaatataaattctcaaagcatttacaattgtccctgtcctttattagaaaattctcgcccaggctggagtgcagtggcatgatgatgactcattgaagccctgacctcaaaagcaatcctaccacttcagccacccaagtacctgggaccacaggcatgcaccaccatgcagagctattttttttatattttgtaggaaataaaagaaagaaagttctttcctatattgagttgaaatgttttcttatatttccaccaatagctcaatcccttgtggctacacagaacaaatcttaccctacacggcagcctttcaagaatttgaagacagttgtatttatcctcctacatcgtctctgctcttggcagtttttcatgagtcatggctttgaattctttatcatcctgtcttctgaatgtatcccaattagtttccatacccaaagttgactgtaggacccagttttagtctgaacatcacagcaaaaggaacaatgagagcacttggacacaagaaggggaacatcacacactggggcctgtggtggggtgaggggagtggagagggatagcattaggaggtgtacctaatgtaaatgacgagttaatgggtgcagcacaccaacatggcacaagtatacatatgtaacaaacctgcacgttgtgcacatgtaccctagaacttaaagtataataaaaaaatttcaaaaaaaaaaaaaggaaaaccaattttgttcttgagaataaatttccgttaacaccccttgctgcccacccacacatccccacaaacctgcctaatgagattagctttgaagatggttgttttgtaatcttgactcatattgaatttaaggttgacgagaattgggccttggacagaactaaagcctacgttgttggatagcctaaaacacaaaatttgttaactcttaagaattaatgttttatatggaacaaagtctttcaggaattctaaaagtcatacatcaataaagagatttttatgtctttggtaaggcttttaagtactgtcatattaaatcctccctaaaataatttagctcagaaatgtacaagcaatattaacacaggtttttttgcttaaatagttcattagcctctgtaacttcttgaatataaaaaataatgccaggatttttttaaggtgtctttaaatctgctagcaagttaaagaaaaggttaaactttttcagacgctatgctttaatgaaaacaacagaagacacatgttttattgtaaataagtagataacttttctattaagatttggagcaaggctatgcaccatacatgctctgagtgggcttgattcctccagggaagaggccaggaaagcattgatgtgaaaacagcctttcccttgccattctctccattccaggcaggttatctgccaagaagctcatccctatctgtaaaactgccagcatcagttcatgcagcattcatgtgtaatttgctttttctggagagccataccagggcagagttgactgattgagggaattaaaagctacagactctgggacaggagggctgccctgtgggtatatgagctggttacattttggccccttttcaaaccagggatatgcaactcttgatatgtatgggaaaggcagaactgccaatactgacagcgctcctgagcagcgcaaatgctccacatggcaaatgcatcattcacagaggactcatcagagcagcacccagaaaaaaaccaaacagagcaatacacagagagaccaactggggccagattttgtatataaaacattcctcgtagagtgacttataatgggtagaaaaaggatacgtcctgaatggcaaactattatagtactgattatagtacatccatacaaagaaatatcatgcatttatgtatgatgatggtaaagaaaaacctttaagatcttcaggagaaatgtttatgacatactaaattaaatattaaatttcagtgcagtatgtatattgttacctcatttttaaattcttaactaatttatttggaaagaaaaatggtaattaagatcaagatgtggagacaggacaaatgaaagattataacgaaaattttaaaagaggccaggaaagcattgatgtgaaaacaacctttgagatgacagagttattgatgacttttcatgattattaattcctgtctttgtgctcctatgtgttatgcaaatattccacagacaataaagttactccttttgtaatgaaagtctgtgtaattaaattttttttaaaaaaagttgtgacaggtataaaagtttctggtttatgaacaataaaaactacctctggggaccttgagcaaaataatgatgggttagaaggctattaaagaactcctagaatctgctgggtggctagatccaagcttctgaaggatgtcaagggaagctccataccaggtgagaccagggagctgaacacaaagctggatcaggcagaccaagagaatagtctggctacaactcttccacttgacaatcgatctgtgccacagcctttgacccctgggctgtcctgccatgaataatcgttagttccccttacatttttgctttgctttgccaagaaacaaaaacttaaggtggtgtagtatatatgcagtatatattaccaccccatttcccatggcatatgccgatgtctgagcttccagggacttgcatgtatatttactgcttcctttggcttctagtgaaggcatttctcatattttgagatttctgtaactccctgcctccaatagaaaggtgttggatgctaagtagtggcaaatgtcctgcacatgaaatgttggaatagaagataaagtattgtgttagtacgtctctggatatttttaaaatccttaaaataaatttttacctgtccaagaaagtctaattgtgtgtgccacaattcctaagactctagaacatttccataatttgtattatatatgtcaagcataatacaaatacattgtcctagtgatcaatgtgtgatctgatttatgtatgcattgccagcctcagacaccatatattagtagcaatatattgtagagtatcattgggctatttttttttcaaagagctatggaatttagtctttttgaaatactaaggcagaaaaatgtgaagctaactaccgaaatttaaataaaataaattttcagttatgagtgatatatagtaatgtgtctttattaatggacttgaatgaaatgtgcaaactaaattaaaatcttggaaatctataattaggttaataatgtagtgatgacttcttaccagagaaataataacatttgataggatatgcttttttctttcataagatgttttacaagataagaaataaagttatagatataatacctgtgactgggttgtcttatgagctaatagatcgcattcaacaaatgaaaatgaaaagacaaaatatgcatcatagacaaacagatgatgccatcatctatgaatgcacagtatgggttattggaatggctttaacacattgaagttggtctagtaaaaattcaagaagcaatttagtttttaattcacatgttttaatttcttcttttacccacttaggtgcatgcatttttataaacttttataaccaagttctctaaataagcattttttattaaaatgcttacataaccacattgagaatagaaatagctctttaaatattgctattaccttggggtatataaagtaagtctcaaccggcaattcaaaaccttctatgatctattcagttgaaattaatcccctttctttcccttcatgtttccactaaactttgctttaacctttattatctgattcaagtttgtattatatgatgctgctaataatgatgataatgatgaacttttagtgatttgcaaatcaaagattagacagattagcaggtttgttcaaggccatgcagctgacaaataaggtattaatactaagatccagtcctcagcagtcagacttgagtccatagttttcatttctacacgattgatagattatctattttcttctctgcatcatcagttttttgaaggtgaggcattgatttttatttagtattacaactttgaagatacttaggaccaccatgaccaccaaataactaaaattaaaagaaaatacaccaaaaattttagtacagttgtatagtgtgattataagttctctatctcatgtttttaccactttaatttttttaatattctataatgaacagaagttagcataggggaatactttagagtagaaattttggtcaaatacaacggattttaaattacttcttcctcactttacgactataacaggttatctattgcttcatctaatccatgaattgggagctgttggtgaaaccgatactcaagtttgttgtaacaactatatatacacttagagtctctggcagaaagcagtcagtagatgctagttattatttttaaatcaaacaaaatatttaaggagagactttaatattcttaaacataacccttcaaatccttaaaccagattttttttctgtacaagaaagtctggttgtatatgctacaattcctaaaactggaacatttcaataatgttattacacagctcaggtcttgattctaatgctcagggtggatagaacaggcaaaaagtgctaggtaatgaagacatgccccaccaggcttcttcccattggtatgctgccttgacacagtcatatttaacagtgaactctgtttggaagcaatttatatgcatatatagatatgttcacatggcgctgctgagataattacaatgttatttactagttttgtctggtatttctgctatgtctttaatgacaaaatgctgcagagacacgggtgagagagacaaaagatgatgaggatgaggtgattttgtaaataagcaaaaagaggaatatttttgcatacttttgtgctggatgaaaccagtagaagagcaaatttaggtctaagagaaggtaataaattatatgcttaaatcaaatacctttaaagaataaaaaaaaaaacttttgatcatcacaggaaaaatttcaaaatattttatcttgcatcaaaaagttacatctaaatattacttcataaaaattatcctagggtttacttgacttttctccatgcaattccaaataaaataaggttttatgaactctgagattctttgaacagtttgaagaacttgaactggaatatctcttacactaagcacaggagactgttctccatatttaacactattttcacagtgtatactaccatatccagtacatactatgtgctcaataaatatacaatgaatgtgtaactaatagagtcaagaggcataaaggacttggagttgcaagacctcgcttcaaccctaggctttgccagttgttgattattcaactttgggctaataatttatcatataaaatgttgtttattatattaaattttaaatatataatttcttaagaaaacatattataaagtaaatttatttatttggaaaattaaaaaaattctcagactgtattaaggaaatatatgtaaatgatccttgcaaattataaatgctaattgttttaaagtcacttccagggcagaatggcaatgctcttaatattatgaaatcatagagcctctgttgaaagagaccttaaaaggcatcaagttcaaccacatctctggtttttaattatctttctacatagggaccagatggacacatgctgtatatttaactttatctttaaggaaattgttaactgtatccctggtatgcctcagaatgttctctttgaattataaaggagtgttcttttcagtactttatttcattcatttagttctcacacaaccccatgaagtactattactgttcccattaaacagatgagaaacctaaataaaaaatgtggttacttgcccagcaactcaaaactagtaagttgtatagtcaggacgagaacccaggtaatctccagagcccattcccataaccagtacagagtaccctttccatgtgaagtggaatgtgaaaatctcctctgcttcttgcacacgattgtggttgaatgtaaggagcaccccttttaattgcattacagtatatcatccaaaccagcagagtccaatttctatacaaatttcagatgtgaaagaaatattctatatttatgctgtccaatatggtggttagtagccacatttgccttttgagcacttggtatgtggctagtgtgactgaggatccaactttattattttgataattttaatttaaataagcacacatggctgttgcacatgccagcacttattgggcaatgcagtttaagttctatatcaaagctcttcagtgttttctttattggcatgtgttacagctcctatttatatgtgagacactctcccatagctgtaggctgacaagacagagaaagtagtgactaaaagtttagatgctgaagagacaagtttacatcttggctgtggagcttagtatgttactctgagtttagagctgacttacccttaaattgggatgattattgaactacattatagaactatttaaaaaaaatttattttgacataatttcagatttcagacgttcagaatagagacaagaattgtacaaagaataactgcatgaacttcactgagaatctccaaaggtttctgaactctctctccaccccccctttctttctctctctctctctctctgtgtgtgtgtatatgtgtgtgtgtacactttattgttttcatgaacaatgtgagagagtaagttgctggcttactccttttcttttaggtgcatattttctaaaaataaaggcatgatctctcatcaggaaattaacattcactagtcttaatactattatctaatctacagacttaattcagatttcataggtttcccaataatgtcttttatagctaaagaaaatatcatcttatgccttgcattccattttcatgtctttaaacttctttattctgaaacaattcctcaatcttaatttgcgtttcatgacatagacattttctaaataatataagccagttattttgtaaatagtctctcaatttaagtttgtcaaatgtttcctcatgatgaaatttattctatgcacttttggtggcaataccacagaagtgatgatgtgtcttttgcaatgcatcatatcagaaggcccatggtattcactgccccattatggtgatgttaacttcaatcactttattatcgggttaaggtgctgtctatcagaatggtgtttgctagtataggcaatgtctgccaataatttcaatgtagttattactttttccctctgtaatgaaaaatatattggggaaagttacattgagaataactaaatatcctgttgctgcctcgaatttttacacacttctttttgcacttattcatgattcttatgtgaattcttatgatgattgctaaatagagattttctagttccatattttctttacatttattagtcgagtttccacctgaaaaacagcttttttccacctaattatttatttatatcctggtagacatatattattcaatgggttgtcatcctttatgtcattacatataatacatgtgaatatacatatatatgtatatatattctttatatatataaatatatatatttgtatatatttctttatatctttgatgctcaaattgtcctggatttgagttaagggagctccttcaagctagcttctacgtccttttgatgtgtctccataattctttgaatacatccctaatttctggcacaagatgaggtttcataatgattttctactttccctcactagccctggaatcagtaattttcctaaaattcctttattcctttgagtgaaaagtatttagaagcctagatcatgggctaggtcttcttcttgttgctactgggtgtcattgcttctaggccttctcagcagatagcctggaagtaggacttgaaatattcatgaatgtataattatctatatgaataaatacatataaaggcatatatatttatacatgtttatgagtatatgtgtcactacatatctatttctatttttatgcctatctatgtatctagctatccatcttaaaactcttaaattcaaactgacgcctccaaaatcaacaccttggagttcattctatcttctcccttttccatatttgtaattcccttctctaatttagcaaaacttagttaccattggccacaatttattttatttctttgctcaccttagaatatatagaaactagtttccaaactgttaatctaggaatctgagcaaaagctactcactagaattgaatatttgttcagagttgtcttcagactcagagtacatagttctaatagtcaaggttcatatagttcaaaagttaactgaggttccccctaagctgtgtggccatgttattcatttgaaatatgactctgttcatgtttttgttttaggtttttagttctaggagttttttcctcccatgcttgttagttttctattctttttaaagtatgtatgtgaaacattaaaaattcccaaaagtcagaaccataaaatattatactcaagaaggtgtaagtccatcctccctttcttcatagagcagttttgaagagtaaataatattataaatgtttagattttgcattacctggcacatatttaggtctcaaaaaatctaatatagctattcatctaataatcgcgctttttctatgttcaattacacactcactaagtacttcatacctttttctcaatgtatgaaaccaaataagaatgcacatatgtgaacaaaactcttctaaaattttggtattttaactcttactagcaaaatattatttgcaatctttctcacaattaatcacgaaacaaactattgtgtttgatttcctagctaagaaataatggcttatttcattccttaaaaagtagaacatgaatgctgcatgtggcataagcacagtgttattgcaggagtaatatagaaaacatatcagggtcagaactcatttagtggtgccttaaatgtgaagaaaatagctgtaattctgcataaatgttataattgttagattgcagagaaacaaagagtcctgaggcatgtctgaagaaatgagcagattacatgcttaactaattctggaagataaggtttctagattaagtcatgctctgcaagggaaacaaataaagcaagcactacatcattagaatctattttattttaatgtatttctttaaagagaaagctttgattctggaaatgtctgacattgctgcatttttctcatgaagtcttctgtgcatacttaactagtgattctaatacgtatattttactagtgatattcagtaaatatgtcagagaacagatttcttctcttggctaaatgtttgcaataaaatttctggataaaatttgaattattttcctattttgtgaatcatatatccttactaaagcatctttttacttcttttttgatcatgtataaaagttattgagtatcataagaaattttaaaacattttatttttatcacataacaggaatggaataaaccaaaaaaaaagtatacttagaaaactcttaaatgacaatacaactatgaatcttaaacatttttgggaagcaaatagagatgacatatcaagatcaaattgtaaaatccatgtaagtatcaccagcatgacaatctttctaagagatgtttacttttagatatactccctatattctttatagtatatagaaactttctttgtccatatcttaatagcagggtgaacttagaggtaagttacaagttgcatacatttaaatgttaattttaatgcacctttggtacactttatattttgaattgaagggaaattttaattctgtaacataagtatcttaatagatacttaatcatatatccagagatattaatagatatccagttttacccagaattttcttaaagtaatacacagatgcttactgattggttagtacccttctttcacatttctgaggtctcatcttccaaatgaggtagattcaacaacgtttccaagttgtagctcctcaggacccaagtcctctccatgctgtggctagggcttccaaagtccctcatttccccacatcaccactcctctttaagatctccttctttcctgatttctcatacaacttttttatgcccatctctgtccttgatgctggagggggaagtgaaactgccaaacatcatcaccaggatgtgcatgaaatccaaccacacattgaaccccagatttccttgggctcttttgaacacccaatctttgggtaagattatttctatgaaaattttgtttcaactttctaaacaattgaactgtaaattttactgtaagattagtgtgcgtcatttaaaaaattttgtgtcttccgtgcgttatgagatatgtcccattctgtaatctctgaccatggaatcaagcttaaatttcatgaccctttctgaaattacataagtgtcttgagtttgtttttaactgatattcacccgccccgcttgttggtctaaatgaagaggaaattatcctaatgactttattttccttctttagatgaaattgttagcatggcaaggaaaaaatatattagcttttccatgtttattgcaataagatttccagtagatatcaggataatttaaggcttccgttgctacagttgcttgcctttctctcttctggttttgaaattatcattaggaataaagaactcattgctttctcctagctaaccgtctatagcataatactaaataccctttcaaaatgatgcttctatttgcatttatgttacttcattctactaattttccctatgctttcactcaaaaagctatggatacctccacactgtgtttttcggtatttctccccgtgttcttctgctgggatttgaaagtatacacttgaacttgaaataaataatagtaattcatgcaatgtaagaaatatgctgctattataggatagggagagagataacttagaaagacataatttgtaacaataaaagttttgagtatttttccttcttggctgacttcgttagtaactatcatagaagcatttgacacttcattttaaagtacagtagtcccccattattctccagggatatattagaagaccccctagtgatgcctggaactgcagatagtactgaacccaattgctgtcaatcttcctgttcatcttccacctacaaatttaatacttattccaccttaactaagcccttatcatacactctagccataacttttatagtgaagtatgacagcaaagcttgcataatttgttttccttcttcccgatttcatgaatagaagactcattcttaccatagacattagcaacctcaacctcagcatactttttttttctttccttaagtggagaactttcactttttcccttaaaggaagcacttcccagcttctgtttggcatatccaaattctcaccaacattactattgtgctttggggttattctgaagtcaattaagggttccttgaacacatgcactgtgatatcacagacagtcaatccatcacagagacggatactaagtgactcatgagcaaatagcgtggacagcttggatacactggacaaagaaataattcacatcctgggcctgtaggagcaggatggcatgagatttcatcagctactcagaatgatgtgcaactgaaaacttatgagctgtttatttccaaaattttttatttaatattttcaaactgcacggtaactaaagccatgaaaaccaaaccttgaacaagaggggaatgctgtatatatgtctgaatcatattccattgggaataatttacataagatatacagcatagctatatctgtataaacaacacaggtttgaactgtgcgaatcttcttacagatgaaacttaagattgttaactaaaaaaaagatggtagaaaattacatatagttttattttatgtcttaaataataataatcaggaaatttggataaatatataaaaagttattagcagccaggcatggtgactcactcctgtaatctcaacactttgggaggctgagacgggcagatcacctgagggcaggagttcaagaccagtctagccaacgtggtgaaactccgcctctactagaaatacaaaaattagctggacgtggcagcacatgcctgtagtcccagctactcatgaggctgaggcaggagaattgcttgaacccgggaggcagaggtttcaatgagtggagattgcgccagtgtactccagctcatcagcctgggtgacagagagagactccgtcccaaaaaaaaaaaaaaaaaaaaaaaaaaaaaaaaaaaaaggttattagcagcaattagttttataaaggtaggaagaatctttactcaataattttactttctaacttcacaatttatgtagtgtttgaatgatttacagttagcagttattacctgtctgagtaggaaaagatagagattttcaaaagacaaattttattttaaaaagccaaatgatgtaatggaaagttgtggagtttacagtcagaaaatgtagcagccatctaatcatatgacttactagacttaatttattccttctgagcctcagtattcttacctgtaaaatatgataataattaccaacctaaaagattgttctgcaagcaacatgtgagaaatgtaagctgcaaatagcaagatacgtcttctggttttgtatgtatgattttatactgacttacagatacttataattgagaaagaatgtggtggggggaagggtggtagtgagtaggaccatttgtaaaatgatgagaacaaaattcaataaagaaagctcatgtttctgtgaagtgggcttttttagattacactaataagtgagatctaagaggacagaggggaggaagagttatggagaaagaggagctgttgatccagggataaaatttcagttaaactggaggaataagttttagtaatctattgcactgcatagtgactacagataataataatgtactatatatttcaaaattgcttataatagattttaatgtcttcaccacaaaaaatcagttgctgaggtgatgaatacattaattagactggttaaaactttctgcaatgtatagatggatgaaaacatcacattgtaccctataaatacacacaattattaattgtcatttaaaaataaaccaatagaaaaagaaagctcatgttgaaaattgaaggcagaaagggaaggaaaatacaatgcaaatatactgtaatacattttcaatcaaagtaaaatagctattcagtgctgaaagtaaggagaaagggaattgaagaaaaagtaacaaagaaaacaaaaagtcaaaagttgggaaaaaaaaatagatggagttaatgactcagagatttttagaaatagcaccaagctgtgaagcccaagaatggtcattcaatttggaaaggatgatcgaagcctcaatcacttttgtagattgataatgacaggattaaaatatttttaaagattttcaccacttcccaacctcctccattgggaggttgggaagtggtgaaaacttaaacataaccaagtgttgcaagcaaaatttgatctactgaatgtaatgcagctcttcatggcttcaggttacgtgagcaacaggtataagctaagctttagagtaatatacagatttgtaatcttgtgccaattgcttttcttccttaagtctcattttcctcatctgttaaatgaggttaaaaataatagctattccataaggctgtcaggaggaaataatgtgttgctatacctaagactgaataaatggtaaatattgttgtagttgttggaaaattctccaggcattgtgcatcgatgatttaagaagttagatattcaagtcaggcgctgtggctcacgcgtgaaatcccagctacttgggaggctgaggcaggagaatcacttgaacccaggaggcggaggatgcagtgagctgagatcgcaccactgcactccagtctgggcagcaagagtgaaagtctgtggaaagaaagaaagaaagaaaaagaaagaaagaaagaaagaaagaaagaaagaaagaaagaaagaaagaaagaaagaaagaaggaaggaaggaaggaaggaaggaaggaaggaaggaaggaaggaaggaaggaaggaaggaaggaaggagagggagggagggagggagggagggagggaaggaaggaaggaaggaaggaaggaaggaaggaaggaaggaaggaaggaaggaaggaagggaggagagaggaaggaaggaaggaaggaaggaaggaaaagaaagaaatagagagagagaaagaaagaaaaagaaagaaagaaagaaagagaaagagttaggtaaatattcagagagcttccatctgcccatagaatgcaggacttcaattcgcatcttgagaactgaaattggttacttagaactgagtgaacaagtgtgtaggcatgatgtagatttatttatttttctctcaggagttattttaacaattttgttttgagacttctaacagactttctggagctctcctaccagctgctattgttctgtgtcccttgctggcaagtactgtctttcaatagagatgagccaatttatttgatgctgcctctggagaagagagaagccctttgggtacaaagtgtgcctgtcatgcagatggcttctctaatctaatgaggtagagagctgagcagtcaggagaggaaggagtgttggtaaaagcagagtctgttctctgcacccacttctcccatctatatatgaatagttagtacaagagccactttctacaagaatctttaaactttgacatgactatcctaaagatgagcacatctgagtctgtgcatggctggtgtatcagtgcagtctgtttggacagccactttcctctgccacaaggtgtgtttcctttttattcttcgtgacagtttggcttataaagtcttcccttattgatgcaattgtgagagaataaatttcattcttcccctgaatctgtaacatctttagaatataatctgaatatcaaaatttaggtttttggtttggttttgtttaattaattcatttaaccataaatacttctgtaatgagaaaccaattgtagcttatagaataacctgatagtggtgatgagggagacataagcctgctgccttaatgctttctgtgcctcagtttcctcatgcatataagtgggaaatatgtcactatcttttactggtttcataggattatattcagtgccagttatatttgttctaaaacacttggatagttatttgtgccttcaaaattatctaatgtcatatgaaaatacaaattttgaaaggatactattgcaatgagctgtcagttttaaatattttgatttgaattttattgaaaaaccaaattccaccttaggttttctatctgaaatgtttaaaatttgtgtaaatattaacatcacatggaaatcatattctatttaaattttttgccatcatttattttttatctgactctccttgtaattttattttcaattgccttcagggaacaatatgcaaactcttcgagaactcatttaactcttgtcaatttgtaccaataaaaatcaaagcttatatagtattatgcaaatattttattcacttggataagagggagtccattctactaagtcagttcttgtattaaaataattattcattttgtttcatcatttcaattataggcgcataaattcttatatcttgtctcaaacacaaaatctcagaacgtcttactttcatgcaaaaaaactaagttctaaaaaagcaaatttatatcaccttaagacgtccaaaagtataaaggttattggacatcactcctggtatccttggaaatatttgtttgattttgaagaaagcctctaagcagtcaagttgagtaatatttttaacttactcttctcgactttgaaagagtgcacctgtgaagaaatatctagggcatagatatttcctcatctctctttatcatcttgctttctaccatgttggtctgcatatggttagatgaatctgtgtgactaataccagggcaatcttgacctcagtgtatcaacttctgtgagcctgtcttgtctaaaatgaatttggctgagttatagagcctctaagaaactcttaccagaggaaggaagacaaaagtttgcggtgggaaagtgaagaggtcaaaaaaggagctagaacttactaaataaacattttagcatatattatcaatataagagtaacccaggaaaatcattgttatggcttctatattcttgaatttagtagtaaaaataatttgattttggcttaaatgtaatgttctatttcttaaggtcctgtttctcaaggtcccatttcttttcactctacttgtcaagttcaagaccatttaaaaaattagtattttgctagtacagtttattaataaccatctcatttaaaagatagagatatatgtcaggtgcactcaactttatgtttcagatcaccttggatactgttttagcattagtttaataatttttgataattcatcataaacttccatcacagatattagcataaattctacaggccaatttttttaataaatccttgttttacctcatcaagagagaaataaagagtgagagaaaagtgaaagagagattgagatggggtagaatccgataacattaaaatttaagggaacatgcctgctttgtgtgtttgtctgtttggttatttccagaaacataggaatctcagtaggagaaattgagtataatgttctgtatttaagggatgcagtttatatgtctttttggtcaatacagttattccctttattcagggggatatgttccaagacccccaatggatgcctgaaccacagatagtagtaaaccctatatacactgtttttacatatatatatgtgtgtatatacatatgtgtgtgtatatatgtgtgtgtgtgtatgtgcgtgtgtacacacacacacatacacacacacacacacaccatacctgttgatatggtctggctgtgtccccatccaaatctcaccttgaataaccgtcatgtgtcaaggacagggccaggtggagataattgaatcacagggtgaatcacttgagtcaaggagttcaagaccagcctgggcaacagggcaaaaacctatctctacaaaaacaaacaaacaaacaaaacaaaacaattagccaggtgtggtggtgcacatctgtagtctcagctacccaggaagctgagatgggaggatcacctgagcctgtggggttgaggctgcagtgagccatgattgtgccattgcactttagcctggataatagagcaagactctgtctcaaaaaacaaacaaataaaacgaaataacaacaacagaaaaaacacttgtcttacatcatgtccggaattgaaaacacctgtcacgcagtcaaaaactagattaattttctatgtggaatatagaaaaagaaagaagttgaagtggaaaatctggagcaaaatatttatattgaaataaaatctgaacatttttttgaaaagatacactgaaatttactacacaaataagtcaaggctctctctaaagaatgtggcatataatttttgtctttagaaagtattagaagcatggtgatggctgcacggcctccacattctctgcgggtagatgaaatcttgaatttaggaattcaagcagatcgtgctttctgcccttagagaaaaggtattacatgttggtaactgaggtataaaataaccaaagcccagatctcgtctcgtgctccacggaaatcatgcctcgcccgagtctataattggctgaattcatttccaatgaatgaaatgcaaaaacatggaaaagactaaaattgaaattttataatttaaaagatttaaactgtgaggatggtacatccttgacctagagaattttgaatctgtctttggacaggtgggcaaccataggaagcaagtaggtgtctggagatggctgcagagacatcccgtcccctcggtagcactgattgcattttccatgaaggttgctcttaacttcaaagcagacactctgctgtgaaggttctgagaggttagttctgggtctcgttgtttcaattaatcatttattcaattaataaattttgagctcctgctgtgaatcaggcagtatgctaggccctgtggctacaatataggcatggttcatgttttcagcaaacgacattttactgctttggtaaaaataacaattcatcagaagaaaggctatatactaagttatagaacagaacagaagtaagaccctccaaaaaggaatgtgaatatacaagaatggatatgaataattttccaaattataggttcagcttgggtaaagaaaactgtgggattagttacccttgctttatgctgagaactaagaaaaaataaaataaataaaataaaataaaaccgttcatgttaatcctttctaagacaaacatgcttttatattctgattttaattttccatttgccaatgaaaggctcttagatagcagttaaaagaagtatataaaaattaaaacaaaaaagaaattattcctaggttactaagtatttaagagctacaaacatatataaaaactaaaaaatttgttgtaaagtcatttgaaaaggagtatacttatctgtagccacctaagctatatcttagggcagagtaagcacagcttgatcatataatctggaaaccagaattatgttagcctcataaagtatttccaagtacaaagagttcattttctttgataaaacaaaggagagatacagtaatcttatagccaaggcaagcctttggatataagatttttaaaagcttggagaaaattattttattataataaaatcaattattgagatccactgtatttatgtcacttcttttagagttacatagaaattttaatctttgtctacaaagaattacactttaaaggaacaatttcagtgtaggaaaggttaaccgatgaaaatatcatatatttgggaatgtttgcttagataaggacatagtattcattgtttcctcatttgtaacatatggtggtttaatcagtattatctctaagtttcctggtaacttgaacactaggattctttaaaccctaaggaattagaattcaaattatgacttgtgtgcttcctactatataattgaaaagttaaaccttgcttatttactgtttcttaaatcattacatatgtgttacgtcttttaagcggcttttagtataattcttgtagattggccttgtaggtatgcctgtttattttctttattctttaaattgggtatttatagataattaggaggtaagattaattacaatttttcctttaaaaacctacttttatgttcactaattaaaaaatgcatattctttatttcttagtatatgtagactatatttttctgactttaaccgagtttggcaattttgcatgaacaagcaagggacactttattcaagactattgcagtaggaaaggaaggccagaattcagtctgagctcaactccactgaaataaaaggcagaaatgttcttaaaagcagtggtgggggaatgttaagccataggtgtttgttaattgtctttaccaaatggaaaggaaaactttctcatatcttccaggcaagggatggctttgcaacttggagcaaggtacccctgaaacttaggcttctaccctccaaaagacaggggaataggagctctatcttccttaatgatgacatttcaaaaggatggctcccaggtccttgagaaagacatttctggttataaaactgacaagaagcttttttaaagatttacatttcaaaggaggaaatattttgcaattacaagttttctaaagcaaatgctctaagaaaaaagagatcaagggcctagaatcaggaagcagcctgtctaaaatttagtcaagctgaggggaatgtttagtccaccttggccaatatattagcctgtaatttaacttttttttcgaggtcctgtgattgtgggccttctgggtatgactcatttggactcttggagataggaggaacagtagggatgatgctttgggtactctcctttactctgctatccactatttatttcttgagaagactttgtggcctttaaattctataagttgagtagaaattaaatatttattctggtaacaaacaatgaaaatgtatcttaaatcagtgagattgcatagaagaggattatcattgaaacacaattattaataatatttttagtactttttttagaccgtaaacatgatggggaataaaaaagagaggttgttatattacaaagataaataaattcaaatgtaagtcaagataagcaactacttaaatagaatagccatattcttctattagctgcttcttaccttccaactgaagttaaaagagaaacggtgtttatgtgtcattttagtaagaagactgtaataattacaaattacttttttccttcagaatcttctcaacaaaaagccacaatttctggaaaattctatagtgtgctataatgctgaaaataattcagaataaatttgctcataaaaatgtcagtaagaaaagctaactggataatttttatttctctgaaagccagagctctctaatatctgcttttgggatgctgcttagggtaattaggtatgattttccagttacttggggacgagcagatgtgactggtattgctgagatcctaattttatactgctaatgcaatgcttaccatacaaaggcatgtgaaggtgagacagttaaaagtcgatgtaaagactggaaactgggagtctttgtactatatttaaaataattacaactagggctaaaaataattttatctttgcatttctcttttttctttgttttcatccaccattcccatagcacctgaattctcagggtccctcctctccctttccacccttttccttctatttctttctcttttaacacagcttttctccaggaaaataggacacagaaagaacatctacctgcaaacagccatcagcgagtaagtccagatcatgccagtattcagtaagccatgtctgacaactcaccctttcctctgagtttaataggataaagctagtagtggaatagaaattgagaaatgtggctctactgataaggaaaccttgtcataaagtatgaattagcagcggttgagcagatttacttcaggagtgtttcactgctattatattgcctgttttatcctttggcttctatggacatatcatctgagataatgaccctccatctatttgcacaggtgcaagtaaaaaggtcctaaaatggacacacaaactcacacacatgcacaagtaagcatgccaagcatactaaattacagaaacgaataactcatcaataaagcaaatgttataaagtcctgtgactcatcattcatgatttactcataacacaaattaaaaaataattttgaaataagttgacagattggaccagaggataaatgtaggctatccaggaagtataactctgtacagtaacactaaaggaacagctgccgtctttgtgtagctcacacacagtctgcttttatagaccctaatgaggacaaaaccgattagcagattagaaattgacagaaatcagagacactctgcttaagaatcactaaagttggatagtatttcaactaatgctattctttgttcatctaaagatttatggaatgagtgtcttatgtataaacatctgcctcttcagggaagcatctgtcatgcagccaccaaataacatgacagaggggtactgtgtgcatctgaagagccttaagatctgtggtattgcccaagttcctactgcagattaaaacttttaatcaggtagtttttaaaaaaaataaaataaacctagctcataaaatgaactgttgaatagtttaatgtaaaagaaagcatttcaaaggatatttcatttaaatgcaaatgtggactatgagttattaaagagaatcgagttttcatattcttgtttttctagactcctgggatcaaagtcaccttttgaacttgcaaagtaagcttcaaaacttctgtcttactgttaggatttaagtttattgttttcgctattaaaagacaaatgctatctgaagctttatctgcagcattaattgtcccttaaagacaagggaactgaattaacaggagaaagggtaggactctagaacatttaggtcatggctttggaatcagagctctcagcagtttcatgctttgtggataattaaaatcaatacaaaataattacagaactagaaggatctccagatacctaatccagtcccttgtctccaggagaaactagatctagtttaaactaacttccacacagatacttgagttgtatgagagaaactgggactctagattcactttctgcacttaccaagaatattgcaaatgtggcttggtaaccagtgttcaaaaagagattatggtttttataagcatgacattggcatcatgaaactatcttctacagtctcagatcagcaatggaaggcaatgatggccaaaataatattcatctttcacactacatttatagagaaattagggtttctgacaatgccctatctgctagcttgtcttctcatttttagtgtatcctgtcttatcttaaaagtttagattgggtgctacatcctccatgaagcttaccaatctcaattcttattggttattttctttttgattcctttatttaataagactttaggatatatacataactctatagtaaaaatatagatgaccatataaagcagcatttgccatctctctacttaaatgaaatgtgcttaaatgctagtccctggagcctaacagaatactctttacttagtcactactcaaaaaatgctggttgatgattttttttttctaaatctggttgaaattaattctctttattattctgttctcatggaagatgaggacaagaatgagatgtattgagtctcctgatttcaattccctattccaacattatatttctctttataccattcttaatgctcctttttgttatgagctcaaacatcagaacagagtgaaacaaatatatccaagctccattaactcatttctttaagtaattttaaagagacagtgacttgcctattgcccagtctacagtgcagtggcccaatcatggcttgctgcagcctcaaactcctgagctcaagtgatcctcctgcctcagcctcctgagtagctgggacaacaggagactgccaccatgcacagctgattttttttttaattttttgtagagatggggctatgttgctcaggctggtcttgaactcttggcctcaagcatcctcctgcctcagcctcccaaagtgctggggttaccagcatgaaacactgcacctagtcactttaagtaaaatttaatgtgacaaaattactttgcaacataaatttctggatgactccttggagtttagttttatttttagatacattttcttcctaaagaaaaggggcatggttatcaaagcattttgtaaatcagtagaattcaacatgcctaaggtaaggtgtcgagttagattagtggactagtacaacaatactttctgtttcagaaaggtcaacattgaaaacgtatgtgtgtctgcattactgaattgaattggcgaagttgaatatttaattgtgtgctctgtgagaataactgcagtgagatacatgtcctttagagcatttctttttttctttttcttttctttactttttttttctttttttttcttttttttttttttttttgagatggagtctcgctctgtcgcccaggtggagtgcagtggcacagtggcgccatctcctctcactgcaagctctgcctccccagttcacgccattcttctgcctcagcctccccagtagctgggattacaggcgcctgccaccacgcctggctaagtttttatatttttagtagagatggggtttcactgtgttagccaggatggtctcgatctcctgacctcgtgatccgcctgcctcagcctcccaaagtgctgggattacaggcgtgagtcaccgcacccagcctagaacatttcttaatagaatctacacacacacacacacacacacacacacacacacacacacattatgtaatactttagaagaaaaagatggatcattttcattgttagagaaagtcttaggaaaattttatattttacatctactgcatgctttgcaaaaatagaagagagcttttaatcaatagtaacattaggcagctatatggaattgcatcctatttcactgaatcttgtcattcttgactactggtcaaaatgaaagactgctattacactattacaggaaatgtttcccattgattgttatttctacaaccaacagtctccaccatacttttctatattctctgatccacatcttacatttctttataaatgcttcttcttcctccttgagctaatagacacctggtcagttcacctgccaaaaacacaaggcatcccaagtgaggctattcatttcattacaccagttgggggtgaaaagagagggaagggctgaaaatagggatgacattctcctcagtttccattgccattcaaggaccatcactttcctcttatgtaaaacctttcctctgcacacacatcccagcactgtcttctaatcattgaggacactggcatctggcttactattttccttttggcctcttttgtacaacttcattgtctttgtggagaacccttcaatatgccaacctcctctactgacattccattcagcaaacatcgtcaaacctgaggtccaaagaaaagaattaaccttcatttgattccttattaaaatctctctctccattcaagctttatgtcctttaactctttatgtcctttaaaattattcattgaatcctccaaaacaacacattactgcagacaatgactgcttcccatgatcacatgttcaatcttcttatccaggcattcaatgaccttcaagattggttcttaacctttgtctctagacattttttaattacttgcacataattataactaatccaacgattctccaaatatgcctaacttttcagactccaaatctttctcatggcctctctccatctttccaattctcttcctccccaacaaccccaaataatcatcccctttaaagcccaaatttccaggcattccatgacctttccatgtcaaagcgtccatgtccttctctgaacttctgcagaattgtgtcccactgtctgaaagcatttactttcttgctctgtggttacctatatatttatctaagtctccttaactacttggaaggtagtaccagcttactgtattagtaaaatagggtattagttcagtctctggttctaattagttcttctgacttatctcgccatccgtatgaacaacagttgtaaaatatattgcctggaaccagcttccacttttcctgtacttccaggctgagccgagggtcgacagaaaggaaagccattcagctctggggtcccgacaagttggttgaccctgcagccatgagcggaactctcaaagtcatgtcacccaagtgagaccatgcaaagataactggttacagtgctttgagttctgtatgtgttctatgaaatcatcagtaaaactgaccagggctttcctatgtttatattttccacatcactctctgtatagtagtctaataatagtaaatattcaatgagtattcattgactaagaagaagatatttactacattcttttgtatagagcacaataatttataaggggtttctaatccattcaagtggctagttcttcggtcatctattacttcttttatcccatctgtggttggaatttctcatggagtctcattgtgttaggctgttcttgcattgctataaagaagaacctgatagtgggtaatttataaagaaaagaatttaataggttcatgggcccgcaggctttataagaagcatggtcttggcatctgcacagcttctggggaggcctcaggaagcttacaatcatggcagattacaaaaggggagcaggcacctcacatggtcagagcaggagcaagaggtgaggggcaagggaggtgccacaagcttctaaacaaatagatttcttatgaactcattcactagcttgaggacaataccaaggacatggtgctaaaccattcataagaaatctgcccccatgatctagtcatctcccaccaggccccctctttaacactggggattataattcaacatgagatttggcagggacatatattcaaactatatcacccatctcacaggccacagctttagcctatgtcgaatactaaaactagtagaaaaagcatggcatgtcagatttggcaaaacagatttttaagtaatagtgacaagtcataccatgttacaatgccatgattgctttgaaaatactttgcaaaacttctcaactacaattcatcatatggttcttgtaccttgacaatatttccctgataaaatgacataaaattggcattgttactcaccattgacaagactgcatcacatgatccatctggcttgaacctcatactaagtcagaagttacaacttcttcctgttgaattagttgcatattatcactaattttgcataattatatgtgtttctttgaatgatgatatctcataaacattgcaatttatatctttcagaaacttataccttttggttgtatatattgataaataatatttaaaattagtttattcttataaagatttcagaattttaaaaatctctgggaaggaatatacgctaaaagatgcttaatgttcagtgtagctgaaacatatacttagaggaaggtttttctttttaaacagttaaataatggtaaattggcaagtaccatgccaatcccccttcttgccatgtgtagtacagcagtggtgataatgttagcgattagagatattaattttatttatcttttttcctggagataaaggcttagtaaaagatgaaaatatttcttataagtaagttactacaaacaacttagtttctatttaaaaagtggaaaaagcttctaactcagcctcaggacattaattttatttgtgtaccatctaatatttgtaagtggacttcattttatcttgggagttcagaatgcaaatacaaaaaaaaactcctggggggaaatgcagttattaaaaactcccttagagaattattcaaaagacaggttactttatttacttcaataaataaagtaaaagaatattgtgatcacaacatgaaagaatgaaattaatctgtatttgttacagaacagaaataaaattaagttgtaattaattcaaaacagaaatatgccttatttgtaattaccttatttgtgacagcatttaattattcctttaaatacaattttggagaaactaaaatttttgactaaattttgattttaatcaacacacacacacacagtgtagtcttatgtcataataactgagattaatatccagtatgcaaaatacttgagattaatgtagaataattttgaagcaaaaatgtttttccctcagatgtgggacatgattcagcatttgatacttaaatttcctttgaaatgttgcagagacaaactgtactcaaactcaaataagagcaatttccattattacataccaatcctggaaatgtgtgtgagaatgacaacttcaatcaccaccacatcagtttgccttccttgtcgatttcttagtaaaaccagtttaaaagaatgtgtagccacaggtgtgtatagacaaaactgaacttataaataacacagcaattcagctgtttttttgtttcagaataaataagtaattatttcatttttacaaattatttctaaactttaaaaatataaatgcaccttaacttgattttttttcttacctgagcatctgtgaatgattaattggatttttagcctaagatattctttcatgtatgattttctttgtaggaacttataaagctatgcacacatatatataatattacacatatgatatgcatatgttatacatatgcatatatgtacataatatattcatacatattttacatttatattatgtgtgtctatatatatatatatatatacacatttctttctttctttctttataaaattacacaattttaggttaaccaatgatgtgattaggcaaatgttttcaagccaaacctccctcctctgttcagaaaatgagattagcagtgcttatatgacacactccttgaatcatcagtctttggtgctaatttagtcaaattagggttatgcttctttactaatgtagattttgacaatgtaatccaaagacatgaatctcgtaatattaatgggaagtcacttccatttgtagagagagtaaagaatggacaattgtgcccggtccacccttattcagtccctgatcctcaaccccatagccaacatgcctcacacatatcctacctataatcgaaggcagcccttcttggttttaccactttttctaagattctttagccttgtagaagaaggtttaagggggaaataaaagaagtctagttcaaaatatccagtttcctcttcaatggcaccactcaacctaatactgttcaaagaaaaattcaggaccttttctttcaagcagtaacatccatgagaaaattttaggctataacacagtgataatattgcagctgattaataacacacaaatagttatatattagagaattcttaaataaaactcctttgtttttatttcaataaaatgtctttttaaaaacatttaaaatctgaagtaaacatttccaaaagatcatctcttccaatgagggaacaggtttattcaggcctcaagaatttgaggggcatctggtgaatgccaggtgtcttctaactgaagatacagcaggaaacaagaaagacaaatgtcttgtctttgagaagcttatgttctagtcatacgtaatggataaaagcttgtatttatggctgggcacagtggctcacacctctaatcccagcactttgggatgcctaggcgggtggatcacttgaggtcaggagttcaagaccagcctggccaacaaggcaaaactgcatctttactaaaaatacagaaattagccaggtgtggtggcacacacctgcaatcccagctactcaggaggctgaggcaggataatcatttgaacccgggaggcagaggcaggagaatcgcttgaacctgggaggcagaggttgctgtgaaccaagatcgtgccactgcacttcagcctaacagcctaagtgacagagtaagactctgtcaaaaaaaagaaaaaaaaagaaaaagaaaagaaaaagcatgtatttataaaacctggagcaattcttaaacccactaaactcagtaaatctatagtgcctataacattatactaaataagtaataaatacttttctgatgatacacgtactcaccaaatgtaatgaccagagaagatatgtttttagctaaaatatcctagctttgggatgaacagtaggagcactggattggatcagaatgcagtatacacatatttatttcttatgagtctgcctcttagtaaaaagtgtattttatacctctctgttttcaaaaacacaccaaaacccaagttttgtttcctcaaatgtttaatgacatttatttattgtatctgaatgatttattatgatattgtgatacagcatcacttaaggttgtttggatttttaaaagctattcccaaaagatttgcaactactttcccctgctatcttggttgcttcctgttctcacagaaatgtgaatgatgtccctcatgtattgcttatttcttgagcttttaggtacaacttggcaaatataccaaatgatagagaggaaaaatgaaggtatttttacattgaaaatttttcactggcaaagctcttttcctgaaggaaacatcactcatgtttaggctagattatgtgcgcatcgtgacctagaattggaaacccagtggctactgaactgggggctcctctaaagccaaaccaaaccatttgagcaagaactatggactattcatacagtttatcaaatttagccagatgacagagacagtgtctgacaaaaggttgaatctagtaaaaaaaaaaaaaaaattcacttaggataaaatgtctaatggagattaaaactttaaaatatgtactaaattggtgttccccaggctgttcatattctcagtgcctacagaatacagaaaagctagaaatagctaatgtagctttggaggataacagaaattttgtttggttttgttcctatgttttcttcaaaatgttgttattctttatataactatttaggttattttaattggtttaaaaaagctcgagtctattccaggagggattgtttaaaaaaaaaagatagaatttaaaaaggttgagtctctacatggatgagaaaaaaaaagccaatataagtcttttatataaaccaatctcttaaaacattttaataaatattttattttaatctattaaaatcccttcatagcccactaacattctaaaataccagctatagatttcaagttcattttttagaactttgaaagaaaaatagatatattgcataagaaaggtgatgaacttaataatagttatggaaaaagatacaaatataacaatgaaaggtcctgcagattaatttaaccatttaattaagaaaaagagagcactattacttaggtaattttttaaagtcaatattactataactcagtatattaaaggctttcaaaatgaaggaattagtcatggaatagtgttttgtataattaatgacatatttaactttttcatttagtcatattgctatctttactcctaatcaaaatgcaatttacagaatgtattatttcatcgagaaattaacagctggcttgtaagaaacatttaagttaggttaattactgccttttaaatttgtataatatactgtgacagaaaattaatgatgctcacactatttagcatagttcataacccatattttaatgaaaatatactattattagtgatatacatgatacagatataatacactctaattgctggtcattttatgtctgttctatataattctataaaatgaagccatattcattctgcttattaatttagacttcacagataaaaatttgcatttaatatattcatgtgtatattggattatgtgaattttattaacctaaggcatgacaagtggggtttgactgacagtttctcaagattctaatctggtcaagaattcattttcctttcatcttatcacagacatatgaaaatcttaaactgaacacgttagcattttaagtagtatccattttcttcctgtgcactgtgccaaaagtgagataactacttgcatagtgtccatggagaggtgtttccataacatgccctgataataaatttgtgacaactccagttctgctgtctcaaatgtaagtttcttacagaagcctaagttaaaatctctttctttttctgtagcaaaaatcaaggcctattatattatattatattatattatattatattatattatattacattatcaactaccaaatttaggtttcttgaattgggtcactgctttctttagtcatactaagttcagtgatcgtctttatgccagttgctagtgattggctataggacttctccaaacaaggactacaattataggaaagaaatggtatacctctgagctaatatgagaacacatattttttgaaccataggcaaaaaatactagaaaaagtgccattgtagttgtaccatagaacataattttagaaatataggactcccgtgaaatacttgaagaaaatttgataaatatattgcatgaatagtcaagatggctatattaaaatgggtgtgaaataaagttttattacttttttaaagtaataccaactaacttctgtgcaggtcaatgataacgagtaaaatatgtctactggtttcaagatatttccaagaaagtttagaagatgtgagttctcacaagacaatatagctcattaaaaaaaaaaaaaccttaaataatatccagtttaagagatttcaaataccattgcatttataattcactttgaagtatctatattccagaaaatcactgacaatggcaaatgtttctgagtcattgctatagaaaatatccaagatgggttattgcagacataaaacttcccctaaaagaagagaattcaaaggaggcaagtaacaaaatttatttttgagtgagaaaatatgacagattttcaaatctctcattttggcttattcagcatattgagaaagaagcatatcagagaaacagagaagccacagaggatagtagggcagttccatcccattagggtgaaaggacaaacaggaaaaatgtgaaactgggcaacctaaattctattggattatctgaactatgaaaacctttaagatatgcatttctaactgaacaggaagagtaaataaataatataataaatgtttgtacatagcagcagaataactttttttcacaagttacaaatattttagcatttttctgttaacccacaattctccaattattttttcaaaaacacaaagaaagtaaaagcctccctggaattattactatatactctaaaagtaactgcaataatcagtttggtgtaaatcccttcagacttttggtagtgcatgaatatgtatttttgcattaatgacattttcctataacattttgctatagactagattttcattcagtcatgaggcataagcattttatatcattacatatgaacctaccttataattttgtcactacagtgtttaattaaataactgcatcataattcaattgaataatcctttttgaagtatctttttaatacagtaatataagccatcatgcaacatatgtaaatgaacaatcatgcaacacacacacttctagtggaatttacatttttacacagtttctaataagcctctgtgatatgaggggaccagtttctgtggaatatataggaactgccagggactttttcatatataatttcataaaatcaaaacatttgtttgtagaaattgtgagcattgttttacagtagaagacaatatgtttcaaagaagttgaaaagtttgttgaaagacacatacataatatacggcaaaacaaatcttcaaaatcagttgtgtttggatgattccttggtcattccaggtcaacaaactgcaggaaaggcactttaaatgtatgtatatttatttgattagatcatgcttttttaatcagatggtttgagtctcaaactgttttccttaaccacaaatctctgatttgcttttctaaacagcacaaaaattgtgctgttctgattttcacctaacatccttaacaggaaacctggctgttcagacaaaaatggagttgccatagtgctctagccaaaagtatcagctcaaaaattgtctcagcaggaatgatgggtttctatatttctacattttaaatacaaattgacatcacccatggacatcaaaaataaaattttcccatctggtgcatattatagtatattggaactaattggtttggttggaaaatgaggcaatcctctacataaatgaacgtatgtattctctccagagtgatagtcaagtccaaactctcagtatatggactaaatcttttttcctaattcagtaatcccattgctttcataataaatccttacttgtaactttttaaacaactattttcttttcttttgagtaaaaagcgttctttacctcctaatacgtcagtctattatgggatcaggaagtcatctatttatttattaaacaaaacttatgaaacaattattatttcctagatttatgctagactctagggatataaaaacaaattacacatagaatcaatatcttcacgtagtagttaccaatatagtaggtaggaaagttatatgggcaaggaattgttataatgtcgactataaggtgaaaatatagtccaaagttcattttgagttataatacagaagacatatgaacaccagtgtaattttggtttccaggacaacattaatatggtatctaataacataaaaatgttaaagtaattggaatactccaaggtgggagaaatgtaccatttaatatgtgatgtcaatgtgtaattatgcaaagaaatacaatgcctggttaacagtaatttaaaactctcctagtctgtattttgagtcagtacagtgaacaagttagtcaacctaccagtgagcatgttaaaagccagatgaatgaccagatttttttgttcacctgagtgggtattttgccattgtctaatcgcaacctccgtgcagctcccagtgatttggctacgtgagtgctttctggagcttatgtgtcattcagggcatctctggcgtctgcacttctgtctgttctaatgaccacactcagcaagctccagctttcgaaggagactccactaattagcttagtcggcatagcatctggtaactggttggtgggataaacagaaaagactcccgaagtgaaggatggaaaaatgaattctccaggccatgaagagcaaaatgaaattatgagcatacaacccaaaaccatgaagaagcttgatcatttacattagccgcatctgtaacattgcctggcacgaaatcctgggccaaaatggagataattggaattatgcaatactcagcgcttcagtttggcatcagtttcataatataataaaacttatcatttgtaagcctgtctgctttttcaaaaaaagacctagaacaatttgatctgtcctgctacagcagacactgatgcaggtggtttaaaaacaaagcatttaatcaggcagggttttacttaaactacttgatgattcatcatccagcctctgctcattgtcaattgtgcctctctgagctattatttatagaatatttaaagagcctggactgcatgtgcctctgtcttgggttctattgtactataaattataggtccagtttgtttcaaattcggcatggactgtcaggataccatgactcatcctctgttcagatgaatactgtatatggctaaagcaaaaagtactgttgttactattaatttataggtaattctggaatattcctagactacagttttgtcatgttttaggtccacagaatcactctattcctacattcccctatgttcttctttccacagggtaaaaataaatgagtggctttatgaccactatgtaaattctggtcttctaaatggccactgctaaaggaggttgttcgggatgacacaaccctttctccatcatgaaaacagaccaacttttcctaagtagagactgcatagatttattgaaatcacattctatatgctgagggatttttgttttgttttgtttttcttaagctgactattaaaaacaaagtaagccagaattagattaaagaaaggaaaaattgacctttaatgagaaaaccaagagggcaaaattttttgtgtctcattttttagcactcaataattgcaattaaatattcagtttacttcatccccataggctccttggaagcagaactgtctattttcttcatcactgtattctagcctttaacacatagtaagggcacaataaaaagagcggtggtaggaatcaatgcatgagtgaatgagtaaaagacaagttgtgtggctagactattgtgagtctggagaaagtggatttttttaacattaaaggatgagaataggaatgaatgatatagggaagagatgaaatggatatgtttgtatctggtctgagagtccacttcaaaatgaacattccctcttcagagcacccatgcattgctcatgtgctgctattgcacccatcacattgatttgttatagctcctaggggttacttagatggattagttcacctttttatttccagcatagagtgtggcacattagaagtatccgaagtgcatttatgtatacactgactcatactggatgaacagtatcatcatcgcccaatcctaaagtcttgccccgtttaaggagctttgaggtattattgtcttgaaaactcatggaaatggaaataatgcacaagaagcaatgtctgaaagagtcaggcattcagcaaacacaattttttgtaaaatttgaaaacccaaaccacagtatgacattaagaaaacacaaatattacttagccaaaagaaaaaccattttgaaatttttcataaaatatttagaaagaaagaacttggagcctggagcagtagagtgagaaataaggaaggaatatgtgggagagaagagaaagggaaaagaaagtgcatcagattttttattgttattagcactaaactggtttgctttgggcccttagccagggttgctttttaaaactatccaaatattttttttaaaaatcctcaatgatatttatatgtctactaacatttcagttgtttttatagggtcagtgatattaaggcaaattattcagattcacatggtgaacaaaggcacttcatagaattcttggactacttagagaatcagagagatactttctctagctgctacttcatttgtggccttagagaaataatgcattaatctccaattagatcatgtcatctttcaggatgtttagctaaggtgaaatgtgtaattaaacattttaaattgcatgtcacctccacccacagggttgacacatgttttctttttggtatagttttgtgtaaggattcactcagtatatccagaagtcaccttgaccatgaaaataaatctgctgcaaattacagcctcacaattaactcaaacattatcatctattatttgtgttctctgacttgaggagcaggtatttgatttttttccactttttacttattaacataacttttatatttgaatatatagtaattttttaaattaccaaaatgatagcaggtattaagtgacagtcttcagaatgatcctatgtggtaccctgtgtagcttttcttataataaaaatatacatggaacatcagagagagagagagaaagagagaaagaaaaatatatgtaaatatctttttaatattgagctaatttaagcttcatcagtttgttgtgcatatgatatttaccctacagatttgttttcaataatggtatactatgatgaataactttaaatagaagtatttttcatttagaactttgttgaatattagcacatgagggaaaaataaaatatgtaactcatctatctgtgtaaaataataaatgctagatctaaaggagccatttgctaaaatgtacttaaacaaatgcatattgcctgcattatatttctctactcttttattgcactattagtcagaaatttaaattctatttttgagcttgtgattatcctgaatactaagtgaaagggaagtgatgatggaatttttattttaatgataacaacagttttcaagggagataatcaaaatctttttctgaagtttgaagatgagaaaactgtgtaaatccatctgctgagttcatgtgccttttgagatttgcttttctgtcttttaatttcacatttctggtttttaaattatttctcctataaaagaattttttgatgtcattaatgccgtttcattttgaaatgacggttaaacagagtttctaataattcaacagttctgtttggttttgtacaacatgttatattcaggtgatatctgaatgatcaactggatcaaaattcagaagacaagaaaagcgttgcttgatcgattttcaaacacacattcaggttttgtccatagatcttgaatgccataacaccagttgtgcctcagggaaaagcatatgcttacttgtcacatagatttttagttggtatgttagaccatttgggtcattataacaaaataccttagaccgggtaatttataaataacagaaatgtattacttacagttctggaagctggaaactcctggatcaaggccctggcagattctgtctggtgagagcccattccttatggtggtaacttctatatgtcttcccaccacagaaggggtaagcaagcttcttggcctcttttataaaggcactaattccattcatgagggcagagcccccccaaaggcccacctcttaatgccatttttggagacacaacattcaaaccacagcaattggttttagtgtcattgaactacaagctttataaggaccagaaagaaacttttttttttgcccttaacctaacagttttctgggtccatgcgttttattttctgccaagatatttgtgtgtgtgtgtgtgtgtgtgtgtgtgtgtgtgtgtgcatgtagagagagagagagagagaagcactcaaatgcaatgtctgcactatcaattgcattttcccctatcttttgaaatttcaagttcaaactcgtagtttaatatttttctttggctgaaaataaatgagttgatctgtgtggaatggggtgataaaagaggtcaaggtgtgtgggtaaggatggaaacttctataatatgaaaaaatactgcaatgaaggtgcagtatgagggtgctttacttctctattgaacacagatactttttgaatggaaatgtggtatgtagtaatttgggagagagtatcttagtaataatggagtaccaacattgacagaatgactggtatgggggggcagaatgtgcatttaataaatatttcacaaaagtgcaataacagtctgagaaatacctggaacattttaacataagatattaatataaaacacagacaaataatctggagacacacttattgagtttgaatcctagctcttctcctttttttttccatgatgggcaatttgtttaacttccctgagcctcagtttcctcatgggtaaaattggggaaacagtagcatctatttcattaaattgtcttgatggttaactgagttaatatctctctccctacccctgctagaaagaaaacttgaggaggttttaacgtgtttcaggaatgtggcccaaacacctgaaacaatgatgaaaatcattttaaacttaaaataggcatcaaaaatgaaaaaaaaaaagtgtttattgtcaaaaataatgacatttgtgcagaggttctgtattttagtagccaattactctgtaatatttattgagatttgactccgtatatataagggagtttcaaaaagcttatggaaaatgtagttaaaagataaaattaaaaatataaactttatttcttgacataagttctatcaagttcaagaaacttttgtacatgaagaactaaagttcctgggaatttaaatgtactctagagcagttaaatggagtctatttttcaaaacccatctaggccataaagcctttcctgacttgaaaaagaaagatcaaataggacaggagccccacatcagtgatttcaaggagaatgcacagcagagtgaatatggactatatcctttgtccattttatcagaggactaaggagataaggtcagaatcagaaaaagatttgctgttgaaagtcacatttgttgattccactggctgtccactgtttgagggagactgatgggcaaacatctgcttagtttttctatcaattgtcaatttaccggaaaatatacccatgtgccttgattattaagaagaacacctaaaaccggtcacagtggctcatgcctgaaatcccagccctttgggaggcccaggcaggaggacagcttgagtccagttgttcaaactatcctgggcaacatggtgagagcctgtctctattttaaataaagaagaagaatacctaagaagtagttactttttttccctactttcattttctccttaaataaaagtgctttctaagtattttaaagaaaactcttctttctcatcctgcctcttgctgaagcacttacgacgttcaaacattaagcataatacttacattatttcaactaatacaaaaactctttgggatgaattttattgactttattttgaagctttaaaatgaactcagaaagattaagtaatttgtctgtgatcacacagctagtaggagagtagagccaaggttggatcctgtttctttttaaaggaaaagcttatattctttgcatttctttgggagtcaaatagcgtgctgaactgaatcactacatggtttttgttattgttactgttgttgttgttattttgggttgttaaggtcctgtgcacatttttttttaaacctggagatcttaatcttgtaaggtgttttcaaataatactcacaaaataagtaaataaagaaatcctacaaaatgtagaaaatcagtaacattataccaaattgtttggttcagaaattgcttaagactttaaaatcagttgacccaatctgtaattttatttgctttccagccttcagataattttcaaacaaaagaaataactaaaaaactttaatttctcttttcctttaaattcttgcatagtttcatgtgagatcatagcctgttataattctgttcaaactaatttttatggaaaaaaaccatttttgagtgtacttttcatctttctttgtgaagaaagttataagataaagatttatctcccttctccaagtgtcctttaataaatggattatgcttctgaagcccaggtagtttcaagcaacagcacaaacactgcacacaagagctgtcacttagaaatgaagtaatcaataaacacttcaaatttctttttaaaatttatttcacaaatccaaacaaaacaagtttgtctataagttccttgccatgtttttttttctttttttcccctgtttatataattcttatttagtccctatcagttatgttcaggaacaggccaaaatcaatcaaaacacaaacaaggccgggagccatggcttacaccagaaatcccagcactttgggaggctgaggtaggtggatcacctgaggtcaagagttggagaccagcctggccaacatggtgaaaccccttctctactaaaaatacaaaaatatgctgggtgtggtggcacacacctgaaatcccagctactcgggaggctaaagcatgagaatcacttgaacctgggaggcagaggttgcagtgagtcaagatcacaccaccacactccagcctgggtgacaaaagcaaaactctttctgaagagaaaaaaaaaaaactatgcattattgtttatggtgattgagttttattacttgcagctgtaatttgaaataaaggaaaccacactatgcttaacctcattttggatcatttacgcaaacgtggaaaactttcaagatctgtatagtatctgagaaaaatatttagagggcttacaagtctactttttttttgatatgtgaaaagatttcctacataaatattcttataatatgctaactcaaacttcattctttcatttttcagcaaattattcagtcaatccatttagttactttgcaaactgatagaaagctgtcaatatctacaaactgataaaaagctataaaactgcagcataagggaagcccatttgcattcagctgagtttaacttgaatacctagataacttctggaaatttgagaagctacctaagctggaatgcgcaaatgtagctacctgcttacctcacagttattgttatgaaataaaagactaaaaccttaaaaaaatacagcatgtatatacgtaatttatatatgcatgctgtattgagggaaactcgggagatgttccaaagtgttgaatcagctagaagaaagatttttttaactaaatatgtatgttcataaatatatttagaataaaattataggtaactgcaaatataatagcttaagatgtttgtttagagttactgagataatcttattttaaaatttgtaatttaaaagctaccttacataaaaatactgattttattttgcttcaaatttgttctttaatttttttgtacacatctgatatcacaaaaacattgtttatgaattggcactgctaccttaaaatgtaaatgagggggaacttcgccatagatatccattattctgttggacaattctagcaagagacacctaaaaaggaagaataagtcaaacatagaggttctagcctcttattacaaacaacagctgtcagggcttcttaagaatatgtgcccatcagagaaggctgctgagttcttctgtgtctgaaattaataaaaacgcagttgcaatgccagctatgtaagccagggaggaactcggtggaaaagtgagataacaggggaaatgtttttatgtctttggagctgtaagtgcatttcaatgttatgccatgatcagaagggccatatgaagcaattttgtttctgaagaattgtggttatagagtttgaactgcaggtatcagtaaacaaataaacactactggtgattttgaaattgatacaaagccaaagttaggaaaaactgcattccagaactgttttaaaatgtaatataaattcaaagttccaaaatttatatatttttaaattcttggttttttaaaattttaccgtctaatagtcaatacattagtgaagaaatttaataaaaatggcaactttaccactcatatgtttttctgggagttatgctggcttttgttttaaccccatttgaacccattcttttaggtagatttctttctaaacattggccttttcagattttctctaaatatgcatttcaagtaataacttgaatttcaggaattttttggtcatatttttctgccacaatttaaatatatacagcaatctggcaatatagtgacctgcaaaatcagtgctcatttcttgagtgaataagtaaatatgtttataatttggaaaatagaaacacttttctgactcaatctttatccctaagtttcccttatcttaaagaaatgccaaacaacaacaacagcaacaccaacaacaaaactgagttcctttagcatgaatgaaaccatttggtgagctaaatgtaacaaacaaatgttctcgcgtgcttcctgctctgggacatcccaggctcttgaagaggaccaagttcagagcggcaccatcagtgtcatgttatgaagggggctgcaggatccgcaggtacccaggaaggattctcacttacatcaatagggttagagatggcttctgggagatgtcacctggaatatggaacacttttgaaaattttcaagtgaaaaaaacttaacctagctaaaagttttaaagaaggacctaccatgtttttttcctgtagaactaaaaatattagtttatacttgaattgcaagaatgtctattagcccagtggtctgtgttcacatgttagcactttggagcatacggtagaggtggaaagcaatataaaactatcagaattgttttatatagcccaatatggctctgtcatccattaattttctaaagttttcttcaaaaacacgtatatattcattctacctttctgaagtagtttatttctgtactcaaaatgcccattgagtatttttttgttgctgtttccttaagtttgctacttcaagctttattttttttaagaaattttttttttagaaaaagtttctcactttgtcatgcagcctggagtgcagtagtgtgatcacagttcactgcagcctccaactcctgggatcacttcctacctcagcctccagagtagctggtactacaggtatgccccacctacccactggctaattttttgaatttgtattttgtggcgacataatcttattgtgttgcccaagctggtcttgaactcctggccccaagtgatcctcccacctcagcctcctaaactgctgggactacaggtaccagccactgctcccagcacattccacactttaaatagttcttaccctcttaaattctaatgatgcaagatttctgtgaccacgttcctattgaaccaattggctgctttcatgtcttcatgaaaattgatcatacctttttgtctttgtagaaggagaagattttatctttgtaactatgtctcctatagtaggttgatatttccctgggtcgcaagcagtatggcatataaacatgagaaggtagttatagaatacattgcttaacaatgagcaattcttaggcattactaatgacaacttgaaactatttaggcagaagggctcttagtacagataaaatgaccatccttccagaagatataagctgtataattgaactggaataattgttgaacatggtatccttttcttttctgcttgatatgtcatattttggcaaatggacataatcatttactaagtagctgatattatactttagcaacttcacagtgacaactttttgactcataagttactaagaaccaatcaaagataaaaggtaatattataatattcttacaattttttaatgtcacataattctatgtaactaaattgtattgagacgaatgtatcggattatgttgtttgttgttttataggtttcttctcgtttttgttttcttttgttgttgttttgctttgtttggcttggtttggtttgagtttaggtttgcttacttcagtgttttggactgtgctgacatagagagtctacacacaagtttgggtcactcagctaacttaaggaattatctcaatgaggctgggtatataatggagcaaacatacatatgaactatctaatatgattgttacaaacgttaaataacttaatacgaggtaaagtattttgaccactgcttggtacgcagtaatcattcaatagcattctttctttttttttttttttttttgagtcttataattaataatagcatcacttcgtgggtcacgtacctttgcttttctcttgtgcaaacttatcctttatagcctaatgatcaataaatattggacatcagtactagaaaactatctcaatgtttatgacctaattacatcaaccaagtgggtaaatttgtaaagagattggaccaattgaataagtatatatatgtgaggtgtgtgcatttccatcttgtgtggtgggggagagagagaggttggcctgtgtgtattctcattcgtaatctctataggatattctaaatctgagctgtcatttaaattatgttttaataatgtggctcataggtacaaggaatttgattaatcagaattggaaagaaaaaattgtgtagcttaacttgtacatctttgtttccctgaaatctactcaccatgccacagccaaaaatgatgtttcaaaaattcaggtctgatcaagtagaattgcccacccggcttaacaatttttaatgacttcctttttcattttattgtggtaagaagagttaacacaatatctctagaattaattcatcttcataaactgaaacttcataccaattgaacaactccccagttccccttgcccctagtctcgggcaaccaccattccattttttgattctatgagtttgactattttacctgtctcataaattagaaccatgaagtatttgaccttctgtgactgtcttatttcacttagtgtaatatcctcaagtgtcattcatgtcgctgtatattataggaattccttctccttgaatactgaataatattcaatcgcatatatatatatatgacattttcttatccatttatctgtattcttaaaatatgtttatcatagggaaaaacatcatgacattggtttttgcaatgatttcgtgagtctgaaaataaaattacgggcaacaaaagcaaaaatagcaaatgtgactacatttagctaaaaagtttctgcacagtaaaggaaacgatggcgtgaaaagactacctacagaatgggagaaaatgtttgcaaaccatagataatgatgggtaaatttttaatgtaggaactcctacaaatcaatagcaaaaaaaacacactgacaacccaatttaaaaatggcctaaataccagaacagacatttctttaaagaagacatacagttagctagcaaatatatgaaaagatgctcagcctcacaaatcattaggaaaatgcaaatcaacaccagagatatcacctcacacctgttaggatggccacaaacaaaacaaaaacaaaacaaacaaaaaaacagatgctggcaaggttgtggagaaattgaaacccttatatgctcttggtgaaaatggaaaaagggttcagctgctaaaaaagcaagaggaggcttctcagaaaattaaaagtagtgctattatatgattcagtaatatcactcctgggatttggtcaaaagaattaaatcaggataccaaagagacattagcactcccatattcatagcagcagtattcacaatagcaagatgtggaaataacctaaatgtccattgacagatgaatacattttttaaatgtagtatatacatacaatggactactgttccactctcactttgctttctgtgcttcagctgtccccggcacatgctcactcattttggaggaatctttggcattctgaatcatcctcctataacactttcccatccaggccccacccaactaatttttaatcataatttagatctcaacacaaaggctggcacaaaggtaagtcccaaaaatatatgtaggatgaatgaaaaaaagatgaatgaataattaattgaatgtgtattttctcagaggctctggaataaagtataatttgaaaagttttcattagtagtttttcctctatttgagttagttttatattagaattatgtcaaaacccaacttaaagcttccctttcttatatttcataatcatgtatctgaatgtttaagattcttagcagggtaacagagaaaagaaatcctttatgtgctactattttcttttaaaatttagggttactgcattaagcaggggaggataatacatactctctttagaattttggacgatttgagataaggcccaaaacttagctcactgaaaatggaattactgcacatatcaaaactacactgaatggtcacaattgaaatagtgaatatgctgcatatggcataaactattttactatttgtgctctaaagtgttataaaactgtagtcatacaaagatactaaagtttaaaaatcttaaagtaaaagaattcctgtaagtgttatgaccttaatcccctgcaactgtctcagtctcctctcacagcagtcttggttgtttagagtgagtaattgagacaaaaataattcttttgaaagaaaaaacatttgagcctcaaatgctgataacttttcttctcctcttagaagagcaaaaagaaagaaagatacaacctctgcactttacttttatatataacaaggttgttgtggtcaaataaatgtgaacagtttagaattctataaaattataaaatactgatgtaaataataatattttattattaactattattaatgcaaatatattctgatatgccactgaggaaagtgatacattttatgcacactaaataaaaataggcccaatctgacaatgagaaattattcctaatcttatttctaagctttgtaaaatttgtaaatttaaatgattcaaaaattttatattcactttaatcttcctctatttgttagttcctcaccatattggaaatcaatatttgttgtctgatatatttcttaaataatacgaattaaatattgtgagatgttttaggcctttaagagatatcatttttccttttcagtttatgaaaatgctagttgccattttatatgtacagattaggcagctactatgagcatagaacaataatactaagcaagtgatgcacaacctctgctctcctggagcatatagtctataatcctctgtttccagcttcctactgaatatttgtgcttgattttcctattggcatttcaaatatatgatatttaagttcaaatcaaatacatgtgttcccctcaaatctacatctagtgctaatacttacaatctttacaattataacctagtaaatcaaatatcactttaactagtctttgagggaaaccactttttgagagttttcacaggtgagaaacaggaggcttaatggggctcagccacttgccaacaatcacatagttaataagtcccagagctgacacttgagccaagatcggtctccaggccccattaccatcatgtgatactctctcatcaaagatctcatgttgcgtggagcctagtaaatcatcaaaaatattctggaataggcttggtgcagtggctcacacctgtaatcccagcactttgggaggctgaggtgggtggatcacgaggtcaggagttcaagaccagcctgaccaagatgttgaaaccccgtctctactaaaaatacaaaaattagccgggcacggtggcaggcgcctgtaatctcagctactcgggaggctgaggcaggagaatcgcttgaacccgggcggcaaagattgcagtgagatgagaccacgccactgcattctagcttgggtgatagaatgagactctgtctcaaaaaaaaaaaaaaaaaattattgaataaacgaatataattgacttttattaattcatagttcacatttttttactatatctattttctgttttgttgacaaggtagtgggaagggaccaacatttgctgaacattaaacatttacatttatttgtaatcatttatttgtttatttgtttattttttgtattatttatttattgtatttatttgttattatttgaatcgtttatttgtcatatatcatcccatcttatcctcttaactctaagattggtacccttatcatcattttaaagaagtgaaaacccaagaaattgaacaattttctctaggccagtgtgtgttaaagtcacacactgactttagacagacaattccaagtctgcctaattctaatgacttaaatctactacaccatcttgctgatccattttgcctagcaaactatagagagtagtttccttcttcacatttttagcgtttcaaaagatgtatggcaaacatttcttccatattacttatatcaggtaagtcagaataaaaaagttgatgaggtgtcacctatttacttacagtgcctcagcctgaacccaggagcatgattcaaaaattcaggcatgtgtgttaatttcccactacatccttttgatatgatgttggagaaagcacttattccttctgtatcctacagatacatataaagcataccaaaaagttaatattcataaaagcattttcttgccaaaaatagataaatttaagagaaatcattgttgatttctgagttacatgtaaagtcaatatatgctgctaaactctctttaacttttccagtatgttacagtttttaacaatctgttgttcaaaaactaaataccagaggtatataaaatattagataatatttgagcataaactgttgaaggcaacagcataattttatttccttatgccataatagagcatcacatctcagtcagcctaccccaatgatgacatattttctgaattgtttttacccacacatcttatgctcaatttaacaaatatttattaagtgcatagttggcaaggtgacactatggaggagatgaaaaagactaaggtatcatttgtgcccttgaggaattaataatctgacggcaaaagctgacatgtatacaatcaactgtagtatttgaaaggataaagtaagtcctttaatagcaatataaactgctcggctagtattgagagagcaaggctagagggcagagcaatgtgaagcttggattgaagtggcaggatattaaaggcaagacatcagttatgaagctaaagcatatataggcaataacatgataacagcctgaattagtcagtggactgatagaatagaaggaaaaggaataccaggggcatttcactggaagaatcaatagtatgtgacaattagatgtgagagtggaaattaggaggagtcaaagataaattcaagttttcttatcagatactgggctaggaaacacaaaataagaaaactgtgggagaagcatatgacatttcatttgaggtttgtgggtttaatataccagcaagccatctatgagcagatagccatcagtgggaaatttgagtctacagtacagtaaagagaccagcagcaaagatatacagcatagcagtaattggagtacatagaagattatagaaataggaaagtgccgaggataaaaacttgggggaaattaaacacagatatgataaaggaagagtaagcagaaaaatacactgaagtagaacacaaaactagaaaaaacaaaatgtgtgtgcattgacacggaaccaaaattttgaaacaaagagtgaaaagaagctcaacaatattaacaatgtagaggagttcggaattgagaacgaggtatgggatttgacaaccaggacttttgtgatgactttagtaggatggaatggggaacctagattactaaagattacatatctatatatggaagtaaatgcataaaaatttactatgaaaatttaattgtaaataggagaaagaggagtatatggttaaataggatgcaatgtggaattaatattttgactcagtatggagaaaattgaacatacttgtgaaccagtagggaacagaaatagagaaaaatgtagcaagaattcttaacccaaaatcacggattaggagtctattaggttgtttttgatctcctgcaagcctaggcaatatattgaatgtacatgtagttttattggaagagtcatcacattctcataaagattcatacacccctctagcccccaccaccctcaaaaggaaactttggaatctctgaaatatgtagacagagtattttatgagcaatgcccaagggaacaagatgaaatgcatttgagaggatgtatattctacactatttcattgaaagttcatctgtgaatttcaagtgttccctgtaaatttaaaacacatttaaaaggagtaactcatatctcttaatttactctgaatcttgagaagaaaatagatctaaaaggatctccactgtattcattagttcaacaaatgattgttgaacacttcccaatctggggcatgcatagtgcagagtgtacttcaacaattaagcaggatacctaattaacccagactttagagggaccatgccaaagtagggttcagtaatattttagcagacataatatctaagctcaggcatgaaaaatccattcactcaacaaatatttatatggtgctcatataggccagatactatccaagatgctggtatcatgtgtgtgaataagacaaagtgcctgccctcatgcattgtatgaaagagagaaaataaacaaatgaacaagtaaacaaattctataatcatgtagtgataagtgttataaagaaaatatatatgcagtgacccttctgtatccacaggttcaacatccttggattcaaccaatcatagatcaaaaatatattttttagaatttgaacatgtagagactttttcatgttctatttcctgaacaatagactataacaactatttacatggcatttacattgtattaggtattataagtaatctagagataaagtatactggaagatgtacgtaggttatattcaaatactacaacattttatatcagggtcttgaatagccaaagattttagtatttacaggaggtcctgggaccaatccccaatagatactgaggaatgactgaataagataaaggtacaatggcaatggaagacttccctacaaaggtgacattcggaaaaagaccgcaataaataaaagaataagccaggttaacatccagaggaggtggagggaagagcaaatgcaaagccctgggtaaaaacatatcttggttgggcttcaggaatgaccaatgtggcaagagcagtttgaggaggacagagaatggtagataaggccagcagagccattatgggccatggcaggggatcaggataggaataagtcaacttgggattggaaggagtagcttggattggaaggagtagcatgacttattccagaagtttgatttgactgtgatataatgaggggagtgtggtgagatgaagtaggagaagtcagcaggacccaggaaataaagggcattataaacgtaagttatcatcagagcaaaggtgagccactgaagattttaaatggggaggtgacgtgctttatcagtcttgcattttgagtattgcattttcactggatatattatagaaaatgccttggcagatgatcaagattgtcttcaaggataaaatttacaagtaaaggcccaggattcgatgtctattgctctttctactagtactttctttcctaataatgggaatgattatgtactcaagtatattaggaaaattaatctgaaactggtgtttcagatgaaggggaagtagaagattattccagagtttgttacagtatctaagtataaagtggtaaagatctcagtcagtccactcaatgtattaatgatggaaattgagagaaaaaggtgagttgctgctagagtcatagaagaaagaattgatagacttgtgcctgattacagaaagaaaggaaaaaagcaaagatgacctcatgtggtattaatgactaaagacattgttatttgtatttgtgggcctagcccattgcaaacctccaataaaccctacttaaagtgaataaatgaacacaggaccaagtgagaaataaagaaagcaaggttatgggaactggttttagttttaggcatcttatatttgaatagaatgggtaaagacagttgcctaaattttaaaaggttatcagtatattagtttcattttacatcctggactaactcagtagtattataaacatgagtcagtttagctaggtgcacctatgtttcagcaatacacagaaaaaaaataagacagagacatgtttaagagcaaggtcttgaagcgtgatagccagggttcaaatctcagctcaacttcctgttagtgtgaccttgagaaaagtatgtaattgttatattcctattatcttcttcagaggatagcaaagatgtgataaataatctgctaccactagcctttagcacatacactataaatcaggtttgcagatcaaagacatcactgagtaacttaattacccaagattctcaaccgagaaataaacccaatatggcttattatgagctacacattttaattggattaattacccaatcctcataacagcaatgttggagatttactattatacccattgtttttgtttgttttctagatgatgaaatcaagaattatagctaagtaggtggatcacctgaggtcaagagctcaagaccagcctggccaacatggtgaaactccatctctaataaaataaaatttaaaaaaatacaaaaagttagcagggtgtgatgatgcatgcctgtgatcctagctactcaggaggctgaggcaggagaattgcttgaacccaggtggtggaggttgcagtgagttgagattgcaccactgcactccagcctgggcaacagagtgagactatgtcactgttcaatagatcatgtgagttaaaaattttctctcatcataattactttcagcaaatctctagactagattcctttcttaaccaaatttatcttataaagatgtccaaacttcttttgaataatttaaaaataaaatttgaaaaataaatttacaaaagataaaagaaatacattcatctgtcctcactaacaaaggactagagaaagtgaaggcaattcagttgaacaaaaacaggttgttaaaattcacagcatagtctgtgttgagattttagaaataataaaaaaaagagtagatgcattgttccatggattaaatcagacaagagagctaagcttttcaattcacttttctgaacaattcacaaagaaaaattatataaagtttcttgtgtctttcatttcacattgaataatatggtaaacaatttttcctaacatttttgataagaaaacaaacaaattttatttttaataatgaagctaaaacgtgtatttctacgtattttatactattttaactttgtgattctagaggcaaataaagtcttatgatggcttgacttggactatatattatagcagaggcaatgtataatgaaaagggcacttttcactgactagactgagaatcaatagatatgaatgatacttcaactatactactaatacgctgtgagactttgggcaagtaaattcaatttctgaacactgttttcaaggaagggaatcattgaccccttttaagggtctggtgaaaatgcataaacatgtataattttacaaaatatttcaggaggtttgcagacttctaggaattaaagttcctattaataggtaattaaatgaagaaatacataatcctaatgtctgttttacattctgtttctaatacaatttgtaatcatttaattgtaaatgatttcttaaactaagaacaaacaattgaacggtgtaggtgaaagtctcgctcttctattttctcccccatttgctgcctttgaccttttaaactaagattcttcttatgtaaatatcatgtaagatatcttgccacaaagaatatttcagtgtaattattccttaaatattcatgtctcaggtaattagctgatatatcatctgtgatttgcttatacgtaaggtcaaaaacctaaggtaatgcatcataaactaatcatttatattttctttgccaaggttcactgaatcttttaacctacattgactacgataaagttaattttccatattaaagtaatattcaaattagacttttaaaaattatgctatgggaaaaaacgaacacacagaagttaaaattaagggtgccataagcaaataacttggcagcttttctcagcaaaaaaaaaatatatatatatatatttatgaggcacatttctctaaattatttaagttggtgtattaaaccaatttatatctaatccagtgaaatttatgtcacatatgttcattaggagaaaataattgataaattaagaaacacttcactgtgaaaaatctattaatattcctaactcattcgatttttttttcacctttgagtttttatgaacttatttctatgccataacaatataatatagataagtataaaatacatacgtttggcttaagttatatccccaccagtctccctatcaaataaagggtgccagacagtctgctatctgcatttatctctaaactgagaataactaaaggattcagaattttatgtaaacatcaagacaatgggcttaaaataattgaatcttactctacaataatcgaacttaaagtctcagagaaatatgttagttaggacaaacgtattttgctttcccattagcctctttaccttctatttttcatcaatttgttttgcccaatcgggttttatttacacctttttaataaactacaacaactctaacaactgtttcttttaaatttattttttaattcacaggaaaaatgatatgtatttacatgcacaacatgatgttttgaagtctatgtacattgtgaaatgactaacactagctaattaacatatgcattacctcaaataattactgtttttgtggtaagaacactttacatccactcttagtatttttatgactacctcatattattaactatactcaccatgttgtacagtagatctcctgaacttattccttctaactgaaattttgtttcttttggtcaacatctccccagcccaacatctaaacaccccaggccctgataaccgccattctatggaggcttctcaagaaattagaaataaaactaccatatcatccagcaagcccattactgggtatatatccaaaggaaatgaaaccagaatgtcaaaggggtatcgccattccactacatattgcagtattaatcacagtagccaatgtatggaatcaacctaaagaatgtttttaatgacaaacaaccaggaacacattttgttaatctaatgtgctccaacttactacacaggttgaccttgcataaaagtaactttacaagaatattagcactaaataattcctaacatcttggagacaattttcaaaataatgcgtttgtttactcattcaagatgtatttactgagctaccactgttatatgccaagtgatgttctaggtcctagacatgtagcaaaaaccaaactgaaaaaaaaattaactcttgtagattttcaaagcaactatagcagcaagaggaagagacgaacaccaaaaaaaaaaaaaaaaaaaaaaatatatatatatatatatatatatatatatatatatatatatatatatatgcagtcatgtcttagtgacaaggatatgttgtgagaaatgcatcattaggcattttgtcattgggtgaacatcatagagtgtacttacacaaacctagatgatataagctaactatatacataggctagatggtatagcctattgctcctaagctcaaaaccagtacaacatgttacttcaatgaacactgtagacaattgtaacacaatggtaagtatttgtgtattgaaacatagtacagtaaaaatatggtattataagcttatgagaccatcatcttaaatgcaattcatcattaactgaaattttattatttggtgcataactatattggataatgataagtgctatgaagaaaaatatagcattacttataaattaagaaaacagatcaatctactaaacatcaggtcttccgaaaattattattattattttatttttatttatttatctatttattttgtgatggagtcttgctctgtcgcccaggctggagtgcagtggtacgatctcagctcactgcaagctctgcctcccgggttcacgccgttctcctgcctcagcctcccaagtagctgggactacagccacccgccaccatgcccggctaattttttgcatttttagtagagacggggtttcaccatgttagccaggatggtctcgatctcctgacctcgtgatccgcccgcctcagcctcccaaagtgctcgcattacaggcgtgagccaccgcccccggccctgaaaattattttttaaaccaatataatagttattcctgagaataggtacaagaatttttttaatcatgataaatttcatatcctacccctcttcattcctgcctccacctcaatccattcttcaaagagcaactaaagaaattagatcgtccagaggcttctcgtgatcctccttgcatagacccttcagcacaaactcacccatgcccgcctccagcttcatcatcctccgtgtttctctaaactcactatattcaagccatagtaactttttatttttttaagtctgtcaaacgtttaatgctccttcctgccttgggtcttcacacatatattgttcccacgttgcgcccacccccacctccctgatcccaccccacccccaaacccgactaactcctggtcactttttaataccgaagtgtgatttctgcatggaagccagttctccatgaggttcctctgttttcactcttcaagggtctttacctatcctttgggaacttactactatttaaattatgtaaacacttatgttatactctgtatatttatcaaatacccctcctcagattgcaagttctgcaggacgagttcagagaaggggtggaggcagttgtttctctccttggccagtgtactttcactgctttgcaccctgcctggcatagactaggcatttagaaaattgttcctgagagaattaaagaataaatttcataaaaaatgtcttcagtttacaacatgtagttttatgcaacacttggcaaagtgggttctggtgggagctggtaatatcctttaaatcatgggactgagcaaatgattctagttgaatctgtgttatttaatctgtgtttttaaatctgtgaggctcttgccccagactctacttgaagtctgctgtgcttgcctgtaagctcataatcccaatgacagatggtttttaatctttgctatttggcttctagaatgggtatgtattactaactcatgtattttctctaacatgtagaatctgattctggtggccattccctctgaggaataagatactttctgggacttgtagccatgggagaaaggtttaaaacactttcagagagttgaggggaagccactttatgcttggaatcattgttgaaaaaaattcaattatgaaaaatcacaaatgggtaaaaccattaaataatcccagatagcagtagctcagggcattattgtttaatcatctcatgctcaatattctaaaggacacacacatacacagcaaacaaacagtgttggtgatgttttctgtgttttttagagtgagaaattagaattatttttgaggactggaagaatctttcctcactaactagcatatcccaaatttacaccatgacacttaccaatttataaaaatattttattttatttccatatatgtcgccctaacttctttagaggcatgaacctatcttttctcttttttatccccaaggactggccaaaaagaagaaaaaaaagtttaaaataggcaattaatattcattaaataaatcacagatagtaaagaagtattaaaagcagcctgagctggagtcaactatttcttgtctgtatcagccaggcaaaatgttgctcagaagccattcagggaataaaactctcttgtgaagaatctgttcctttaaactaaggacttacgttttcccaaaccctgtaaattcccatgtttttctatatggatttatgccagaatcattccaatccactggttggcgaagagaatggtttaataactgcaggggaaatgtaaaattctattcagaatataatgaaagctgtatggtattatgtattcatttaccttgtagtaggaaaactcaaatcttcaaataacagagtgttgccatgtcagcttcctctggagagttgaaaactaaactgtaaagacagtagaacgatgtgatttgtattggagtcactggaatcgacaaaacctaaattttttttataatttatttatttcaattaacaaatgacaaattttataaactagtggtatacaatatgattttaatgtatgctctactatgcaaagcctcaattcttaattggtctacaggattcagctgataacgtgaattctgtctacctgcgtttttatatttgtgaaagaattatgctactttataactcagttttttagagtttctatattctaaaattattactttcaaccatcaaatataagatagtagaaatatggggcaaaattttttgcagttttatatcaaaaaagtagatgaatgcaatagggagtgcattaaagagaacagaaaaaaattttaaaagaaagaatggggaaaaaagaagagaaaaaaatgtaaaagaaaggcgaaggaagggaacccgaaagggcaaagaaagtgaggaaggaagggaatattgaagtatttgatagagcttccctaccacccagatgctttagtatgtgcagtatttcaaagttcttcctaggtaaatagcaatgtctttcctttttattagcactgctgcagctgctgttgctcacaaagagattcacaaatcaaaatagactcagttagcttttcaataattctgaaaaggtaggagaacattgccagaaaaggatagcactccagtatcctaacatagagtcttgttagcaaaacaaagtgtgaattgcttagataattccctgctgttggtaattccactgggtgtcttctgtggcagcacaggctacttctcctctatagaccaatgccattgaacagaagatgtcagaatgatatgaaaaagttgctcttttgaaatgtttgttcttctagatttttttaaaatgtcagcatgattcatacctattggttcttagcctggagcacccagcacaaccaggaattgaggaagctagagcaggatgtgaataacgaatgggctgcataagcagaagtctatacccagtcaataagcagaagtctatacccagtcagtgtgcagagttgcaggctagcattttcacagattctattattctctctctctcaagggaaaacgggaaaactagcaagagctagcaagaactagcaagagcttgaacaaacgcctggactcagattggaagactgctcatttgtctactgcctcattcctggaaattgcactggaactgtctgattaaggtatttggaaaaaacaaatttttgacacattttgttgatgatcaacctcctttatccatccatatctttttatatgtggcggcggggccggcggagggaagggtagtatttgtgctgaagattgaagaactgtatctctttaaaaattcttgtgatattaaggggaaattagtgtttgtcacatattctgaaattattactattattaatgtttttgaaatgctgttttcgttggtggggcactggctccttgtataacatgtttgctttctcccactgtcattttgtactctatcaaatccaaagttgtcatggttcattatctgtagatgatcttgagcagtcttgcattctaaaagaatatgccatggcatctgcctctgtgcttttgtggcctgctgcacagatgatattttagcacgagtattgggtgaggggttagaggggagagcagaatttgtctcagactgatgtttccttgtaccatgctgtgtctcattctttcatatatggctaattcaacagtgaagtacatatatcacactgtgactattacatatgttagagtacataatttgggttgtaaagtatctgtttgtcttaactaatgaattccatcaaattcaattaccattcttcattaaccaatcaaattactcctttggtctaagtcatttctaacacacttttattaggcatacacacaattctatgaagtaaacgtgaggtgattagattatctcatgatctttatttggagtcccatgctacagaagtttggatttctaaagaatagcctttcacattacttccactgtatacaggagaaatagtgttacagtgtgaagctctgtctttaagactctgttttactacttctatcttagactttcttttccctgaggaagtttgctacagtggatcgccaatacaaaaatacatagaaatacaccaactatatattcctataaaattaacctatttattaagtaaatgtacctatacgcttatgcgatactggatcataatatttttcaccttttaggaataaattatttcagtactagaactttctcctatctcttgcagtaagataccacagtgtaggatcacagttgttattgttgaaacacttttttcaaattatcattatttctttacatggatttctttttaaacaaagtggttctggaaatgcatatacccagtattgatagtacttcagttttctaggaaataattgccacagtactaatttacattggatattttaatcattttacaatgaagggcaggtgcctaatgtccttgcagtatgattcttaccatacagatcttaaaatatttccattttgttctcttctacattaatgtcttttaggaacattttcatcttctttcctacaactattttgagaaacatctcaaaatgtggtctaaagccaacctacaaaaatacatgttctgagttccatgccagacttaagtcagaatctttgggagtaggccctaggaccagcatttaaaatatacatattaggtgattataatgtaatccaaagtgaaataaccactgctctacaaaatgagagcaaggaaacaactgacagaaaagcattgtaaaactagatgtataactgatatgaaaaataaaaacaccacaatcaagttaaatttgaattttaatttttttctacatgttttcattacttggctgcaaaaagcattctaggttgtttatttcacctttaatatgagttttaaatatcttaaattaaaattttaatatttagtgttaattaaggatatggatgtctgttatttaaaagctttttccaagttgccaaacaatgaatgatagttataatggtaaaaggtattaaatttataatttgtatcattcattagtattttcatatttgaatctttagttttacaaagctttgtaaataacaagtctatctttaatattttatatatctaataaacaacactttttaaagaatttcaaccgatctttttgttaaggtttccatttaaatgaattacgtgagtgtcttactttcagaagatactttattaatacaactaaattgaattctttgggctgagatttttccattttttcataaatgaatatttccatattatctaatcttaataagaatattttctcagtgcggcaagtaagacatgtttgccaatttaatataccaaactctaaagtaagtatacactcaaatgagagttaggggacaaagaactgtcttctgaaccatgaaaagacggaatgtcgtgattacctcaggcactgaaagacagcaaaaatctacattagttctagtagaaagactacagagaatgtttgacccataaaattaatttttgcttcctacatagccgactccatggagacaaggtctaaaaagggaaaatggtcgaaatcttaggtttgtaggttaacttactttgtaaactagatatgtcctgaaaagactggaataatttaaattgtttctgcgttcataagaatcattttatgtatcaaaaattcttttgttttcagctagttttgaagattgtatttagattatggacagactactttaattgggttgtgtttcaaaagtttcattatgaagttaaatatttgggactcaaaacttattttcaaatataaagaatgctataaatgctgtttcatgcccagattcaattttatgaaatccacaacattatagtaaaattacataagttataaaactagaaattgaagggaagaatcattgaaaacaatactatatgatcgtcaaaattaagccaattagacaaaaaatattacattatatatttactttgaatataaatgctaaaggaaagtaaatttgcttataaataaatgagaaattaaaagagggggtagaatatttttctaaaacacagagagagtggggttatagcatgaacagtattctcctgagccaggggggagagggagatggaggggagagatgctgggtagatttagagaatgaaaggcaaaaggatctcaagtatgagtggccaacagcattgaactagctattaaaaagaaaatttgctcataaatggtaggcttataatccagaagaacaggtgtattcaatggtttgtttgtttttgtgttttttgttgttgttttgtttgtttctttgtttttttttttttttttttgagacggagttttgctcatgttgcgcaggctggagtgcaatggcatgatcctggctcactgcaacctccaactcccaggttcaaatgattctcctgcctcagcctcctgagtagctgggattacaggcgtgagccaccacacccagctaattttgtacttttagtagagatggggtttctccatgttggccaggctggtcaaaaactcctgacctcaggtgatccaccaccttggcctcccaaagttctgagattacaggtgagagccaccatgagcagccttaattcttttaaaatgaataggtaactatgttgttacatatccatttagaaagcagctgtgtagaggaaatggtaaggagagatagtgggcgagcatgcatgctaactcagtgagtgccaactaatggagtgaagggagaactaatgaatctttggccttctactaatggctttatctctgagtggattaactccttactctttattgagttccactttctaaggaattctaccctttgtttctttctgaaaattcagcatcaagtgaaccaaatttaccaatttgctgcctttgtgtgcacagttgttcatttaatttatgaaatagttattgaatacctactatgtagtcagcactatgcaaattttgttacttttagcccagacattaggacacaaagaatattttgttgtatttgaattttagtattttgtattttaccatttctcatttattttctgtttcttaaatttggatagttgaagggaacaggtggcatccatgcctagggatggagggctaggagtgtggataacccagagaagaaggtgcaaaaaaaggaggtatctgtcttgttcctctattctgctgattttaaggaggtcttagcagccctaagcagagcccccatcacttccatttaaccttaaaaacaatttttagagatggaaaaaatagaactatttgctcatgataaaaattctacattcaaagtgaagaaaaactactacattcaaattgaagacctgcagtatatagctctttttgagctgatatatctcattactaggctaatctatggtataagaagcaagaagttagaaaggcatcctggaaaaatggcccataattcttcatcaactgtaattttcagtgaaataaaagtctaaatctccattactagttagtttgaagtacagaaggtcatcatgtaagtttctaaaatcccttttaactctagaaattctactggagagacaggtgaataagattgggaaaaaataattgttcatctttcattgaagaaagttatttagaggaatttttcaatatcaagcacccctcctttccgttccattttcaagaaacaagagcaaaggatgagttttggcaacattccaagaagtgtcttagggcagaaatggtcaatgcctgtgttgagttacctgaatctctatttggcagcttctgaaagctactataaaaacctgggcttaagaagaggatgatggtatggtctcgcagccttgtgtgaattttctaaacggttttgttaccccaaagcatagaagtgatacctcaaaatttataactgatgctatatcatagttatactcacatataaacttgcttgataatatttcctacagttgagtttccaatcaatctatttttatctcctacacttccctgatccaacaaatcttatccatcatgcagcctgagttcatacctttgtttcttcaatgtttttattaaacatctacaatgtcagttattcttcaaaccttcttgtacaggcccctgtcctcatggagactaccttctagtagagaggtagactattaacaaggaacaaatatataaataataagacccaccaaaatcttgtttattcactaactttaatcgtatttttgtctaaattttcttcttccaagtttttttttttcagtcagtaatcctactcttcattttagcctacttgattcttactgttttcaacattgccctcaaattaatataatccactattttaactcttttaagattttccatcatcttaagtggaaggaacaaataaattcataaatttacatattagataagatgaattgccggagaaatttgatccgtatagccagatgtaagtaataccagagtggctccaatgtggccattatggaatcaaatacctcacagcccaggcctcaaaggcatcttttcttatcatgagatttttcttaattacattttccagtgattaagtgtcccatttctacacattggaatgcattttctatattaagttgtcaatgatcataaactatctgtcaagaacttattccaattatcctaacaacctcctctaggatccctagcttaaccattctacatttactatatgtacttggcacaaagatggtataaaggtttagccctaaattgtttataaatttttcacactattccaggatattagaacaggatagtcatttacttgtgtacacatataaatgtctgaatacacatcttgaaaatgcaataggttacatctgatgatggttcaagaagaactaaaaggataatcttaagggaacataaaaatttcgtgtttgaagttactgctaagaagaatagcaatgtaagagttcagataactgcaaaagtaaagaatcaaggcagtgtaaagtttctataacttagggaacttaactagctgttaaaagggcacctctctgacagcattaacatttcaaaaatttgatacataaagatgtgccagtacaaagtttggtccttagcaataatcaattaatgatactgtccttttcattcagtgaatccaagaataatagttttcagacctaaatatttacaaccacagtttcatcaaaatacagagaatatatattgtatcaagtgtgcctttatctagggcaaatcttaatagcgtctagattcagaccaaccaccaagacaaattgccaagagaattattaagaaatttgtataaatccctttattacatcttagattttaaaacttctcaaaacaattacagcccttacatacctgtgatggtttttaattccctggacaatttatcaagaaattaaaaattcagagcaccctagcaacacagtggtatatttaccattgcagtatgccagttttgtttattttttatggcacaaataccacaatgtattttatttattaatctattggctgaagtataatatgccaacagaaaagtgaataaaacatgcattttatatagcattatgagattttttctcttgctttttggtcattgatcttgtaaattgttattttttagttattatgatgaggatttaatatccagaatatattaagaaatcctacaactcaacaacaaaaacctaatgtgtctatttacaaataaaaattacaaattagtttagataattacaaattagaaaacaatgaagaatagaatttaattgaatggaaaataaatgtttatattcatggaagaaacacacataaagatgaattataatttgctatcaaatatacagaaaattagatggagtttttggttcacaatagctgacaagttgacaatatgcttatgttaaaaataaacattattctaaggtatttaaatagaaacataacaaaaataatcctgggtacggtcacttcgttagagacttgggctcaaatttaggtcccacaatagaaaaagaattaacaggaaggtggaaagagcaacaaaaccgcagttatttgtagtttgcgacataatcttgtaagaaaataagttcaagatgctaaagagagaaaaaagaaagatgcatcaagtgtggatttaaagtaaatatataccattacaagacacattgtataccgagaaccaaaaagaaacttactgaaattgtaggaaagaacaacgaatgacataatgcaatattctgagaagagaatgttgaaatttattcttgattttttttaaaagacagctatttatcttttgtgaaaaatcataatacagttctgtttaacaatgaagaactattccactgtattacctcccaattctcacatatttatacataagtattaaaactatacgtagtataataaacctaaatttctgaaatatgaacactatcacaattttctaggtgataagttattatacgattttgttatttaactgtaagcaagggagaatctaagaaagaagaatatattctttctaaaataactccccttcaagatggcagctgaatacatagaataatcagactaatcatttggggttagtggttgtttttatgttacatagaaggagaaatgaccactatctgatggcatccaagaaagtgcctctctggggacagaattgtcaccctgatcaccattgctcatgaacccccttcatgttaatgggcacattccaagtagaagacgtgataacaaattctttatgttcttttaggactgttaattctaaaaattttgggacttattatatagtgctggttaattctgagtataaatgtaaggaaattctgtttcataatttagtgtctagaataggactttataaattggtttatgatcagtgtgcttcaagtttattttgggtaccaaatgttccctttatttaatctatttaaatcaacaaaagaagcaatttcaaacggtattcatccaataaactgtagttaggaaaatgttcattaatctatttttatttaccaacaactttgtcattttctttcgaaaagcactttgaaggagggaaaaataaaaacagaaggaaagagaaattatataccactataaaaattatatgcagttttgcctgctttttatgtaacctagtattcaaaacttaactggttttatcagattccattatgttatgaacacacaggccagtatttccccaccagtttcttctaactaggaagtacattcaaacggaaaatctaagtttgtgtttttctactgaaagaaatgtcgctggtgaatagcgaagatgatttatgtgcataaagctgaccttataaaaataatctctgtgttcatcataattttattgctatgtaacatttgttccattttctttttgtatatctctgataaaccattagtttgtagatctctgatgccttagaacatatgacagtttaaaaatatctattgtgtttttccccaaattattttattagtcagtagttttttttgatgaaacagtgacatcaatttctttcatggttacaatttttgcagtgttttagctaacatattttactaactgaaaattatccttgccttttatttacacttcagaagttaaaaataaatatatttattaattaacaattatatctccaaaacaaagtaacgattatttggtttctaatgctagcagttcttgtttatatttaatgaaaatcgcatttctcctgacaggggaaaaatatttttccacattaagaaaggcttttcattcatgtcctgaaactacatatttttgttctggaatataaatcatctatttatttgatatgtatgttgaaatttagtttgtgaaacagaatatatatctatttgtatgtctctctataatagaattatggactgtgatgagttgttctccatatacatgaaggattagatacatatctttcttctttccaaaaatgccatcagcattgtcagtctcagaaaacaggtggaaaattgcctcagtgtttctgatatctcttattaaagatagttacgatgcagaactgaaaaatactaaagttttatgaagcatcaccatgaaataataaaactttcctttaataaagggctcatatccaataaagggcttatatctgaatgaatattgtcgttcactatggtcaccttaaatttcagatgcttccatcgttcaaaatattctgctgtttgtttgcaacttttagagccagtttatgcaccaggaagcagtctttgacaaacaccactgtgaaggcattatatcattatgatcagtacaaatgaggaggcaccctttctaagcatgaggaacatttcttttaatgagtctgtgccctctccaaaggaaatatgcattcatcaagtacactttaattcaaaatggtgtgtgttttctagacaaaaagatacatctctcataaaggagaagtactctgaggctgatgggctcatgaggtcacatgttggctaaaagacctcgcaggctatgcccagaacattagttagaccttttcaagatgtgggggaaaaaaagacacataaagtttcaggctgaatcaaaaagactatttttttactcagctcttgttatattttatagttacatccttatcccagacaggatataaggtcctttcaagaacccatgaggctacacatgaccttcccctgctacctctctttactggaatatgaaaccttacttgagcctacagtactctgcatacatagttaccatttgctatttactttacattagggatatataaaaaaaccctaaaaagccagcctataccaagctcagatgggcttactagtgaattttactcaacatttaaagaagagatattactagttccctacaatctcttccggaagatagaagcagagggaatacatcctaactcattctgtgaggacagaattacatgaatatcaaaactagacaaaggtaatacaagaaaagaatactatagaccagtatctctcatgaatatagaggcaaaactcctcaacaaaagccagcccataaaccatcctgtcaggtgaaaaggtaatggaactgtggagggatgttctgctttccattacaaaccatttattcattcaaccaatatttacttctgtgaggttgattctacgtggtcaagaaatcaaacctgtcatctctctcattcagtcagtcacttattaattcactcactgaacaaattttttttttcaaaatgtacaatgcgttaggcattatacctggtgctgggggatacaatagtgagcaaaataggccaaatccttgccatcatggtttttacattatattggagaaacagacaataaatgagatattaaacaaataaacaataaacaacataaatatatctatgttatatactatgttatctttatatcaataaatcaagatacatagatatcttgtttattatctatttctccaatataatgtaagatatatagtaagatttatattatatataataaatattatatatatatataaaatgtaaagtatgctaaagatatatgccaagaagaaaacaagaacttaacatgtacatacggtgaaatttacatagattgttcagagatggcctcattgagaaaatgactttgtgtaaaatcccaaaggcaatgaagaaaagcatcttgataatgtttcctggaagagcattgcagacataaagaacaagacacaacaacagaggctggtgtagagtgagtgaggaaatatacttggagatgtgaagtcagagatttagatggaaatcaaatcatgcagagccttgtgagaaatgacatggagttgtgatttttggccaaatgtaatgaacagccattggagggttttcaataggaaaatgctgtaaaatgattgactattatacaaaatttattccagtttctgtatagaagacaatatttagatatcaagagtgcaggcagatagaacaatagaagttattgcagtattccaggtgaggcagctaccagagttggtaattttgattaggcttatggctgtacactactgagaaattaatagacttgagatatgtttttaaagtagaacctatatgacttgttgatgaattgaatatggaaaataagagagaaggaatcatcaaaataattaccctagagatttccttgaacactttggtgaagccatttattctgatggggaagactccaacagaaacgggtaggggaggagaaaacaaattttgtttttatatgttaggtttgaggtcatctttggacttctaagagaagccagttaggcagttaaaatataggaggctggacctcagggaaaaagactggaatgaagatatcaaattaggatttgtatgaagtaagatactctcaatagcaaattaaagaataccttactaaaatttacttaaatattattaatatttgttatgtcactttattatatctgtttattaaatccaactctagagagtaccaaggtttattcagtagattattgatatgaaaaccctgggtcagcctctctgggagtctcagggcctagcccccccgttcccagactttgtgcagcatctcaagcatcatatcctcccatggcaacagagaaggcagagtcactgtaaggagaacatgcaggagaaagggattctttttaaagttagctctcttatctgattggggagaagagagaaaatatcttccagaaaactaccaatggatttccctaatgtcttcctccagagctacagcaaatgcccatccctataccatcctttgcaaaagggaagtgtattgtctaaaattgagaggacaagtatgagttattacttgtgactcaggttccatcatcaaagaaaaaactaggacatgttgggaaggtaaccttccatgtctgctacaggagacattctcttacagattttatttaaaatcaggaccagatgatgtccccaaaaatacacccactgtgcactcaagatatcttcatcctctctgtataaaactctatgtggctactggaagaaacagattatatcagcctgataaggggatagacagacctgttgaatcataaatagaacaagcagaaataatagaagagcttagaacattcacaggaaagtagaagaaactggattttggaaaataagtttctgggtttttgtaccacaattgagggattgtgggtggtatttgaacatgagctagtgcacctgaatgtcttagatgcctgtgaatgctgccattcaccagcagcctctgtgagagggcttaatgggtattaattgttcatttgtttctgagactctccgatataccaaccaggtgctgtgcctggagcaaataaaaagcaggcctctatcctcaaaaagttcataatttctgatggtgatctaggtaaattagtaatatattaaatatttttgccataactctcctattattgtaactttttctgactttaaaaactataacccaagcaatctattgacatttaaaccatgactatctggtttacactgtctttccagacatttactttgttctatttgttctattatagaaaagacaatgcgagttgatatctacatgtgtttttaagtacaaattcttatctgtgtctgccatatcacacggtattgtgagaagtccaaaatttaggttctttcttaaatttaattatctggtactttcctacaacactgtgtctcctattgacatttcaaatttcattttgttcacatatcttatgtttgtgtctccttgatatggataacaatagctggtgtaagagcttatctccttttgattctgaaaatgtaataaagaaggaaaatgcagagtaacagccacatgtgccggttattcaagcaaccatccaacttctgtatgaagttaatttggggaaaatatggtatgcacgctgcagctcaagctcacttgtgtcaaagagaaatacgaaaggcaagggatggtgctactttgacaagtacatgaaggaataaagtattgaaataaaacaagtgaatgtggccttatgagaatctttgttttacttataaggcacagcagtttcaagaatatgaccttgcttaatatattactgtttttacttcaaaacaacagcatttgtattcttatctaacaatttatgaatacaaatgacatgaaaatcatgagatacttttactctttatattaatttttattccatttactccacttggatatatatcctaagtaatcatcaaaattaaatgaatatttgagggaatatataacattaaaagaacccctgagaagttatgtagttcttgcctgactctaggcaaatttataatatgtaaagatcttctaaagaagaaattcatataacctattatagaaactcttccttatttctaactcaaatctttatattttatattaagcttgttgaagttttttcttagaaaatttgtaataaaacatcatatcatgtctctttggcctatagcgaatgaaaaaacctcacagttaattaatacagagattttaaaattgtagacctctagaaaactcattttgttttctttggattttatacataaaagtaaacattgatttgtaattaagagaagagaagaattcatgatttggaatcattttctgtaaaagaagaatagaattaaagatgtggcactatttaaaattagaaattagactttttatccatgaaaactctagagaaataattttgattttcaaatatgattagaaaaactcaaacattcagccttgccctttctttgaactctttcttaggctaacaagttcttctaatcttatagttttaggtgctgtttataaaattgatagttgtacatttatagattttacagaaatgtactctttttgtggataagtatctttatgccaagtttatttggctttgtgtgaattactgtttgaaaaaagactgatcattttgtaatgagtatcattacatgaagagctattatttcctggaaactttattctgcagcctcagaatgtagatcaggggccctagcaagttaaggtccaggctcctcatcaaggtcattttccttttcataccactgccctttccccaactcaaagtcagcctaatggtcagaaaggttcacttacagggaaagaaaaggaacagtgccttctttacctatgccctgcatagcaggtaacaattacctaaaattcattgtggaggattggaatatccaagagttttagaaacagttatgctcagacacctctgtgtgaccctaggcaaagtgactaagctctccaacgtattgtcctttatacacaataattaaaaagagtcctcaaaacattatctctaagataagatatgaaggtagttatggtttttcccaaactattttgacttgttctttgtcagtagcatgaggctatattaagatacaactttaaatagtgcttcataaacagtggatggccatggaatcgaattagtggcttgtgattggcatttgaataaaatagaatagaaaaaaataaaggatgtaagttacatcaaatgcagcaaggattagtattgctttgtgaaactttgtatatttgtactgtgtatatgaaattgtgctgtaaaatgtatttcttaccgtgtgtaaaagttttccaaaaatgtttaaaagatgtcagcctacagaattggaccatctagtacaacatgaaaaccccctaaaaaataccactcaaagatagagagcacagactggcattcagcaccactagaaagaagcagtgcagtgatgatcttcagggtctgtgattgctttgggcagtcttcttgctgtcatgttgcagtaagtaaggtatctgagctgcagtcatcatgtgggtgtaataagtaaaaactcacacatgcccattcagttgggcacttgtgggaaaaaagcaaatagaatagtgtatccttatttagtatatgtaagagctgtgtttaggtatctttcctcagaattcatggtactatgatgactgcagagaaaattctctatatgtttcctctacaaacttttacacttgctctttggcatttttttgtcagcaacaagatggcaactgtatgctaataaaatccctgtgcatctacctgcaactcatcccttctgatggctttatatctaattacttaaagcctgtattatgtttatctgttttataaaacagaatatgaaactgtcaggcctaaattatcctgaaccccaatctgtgaaaggacacataatgatggggaaaatatattccttatcagaacaaccaggtgttctcaaatattgactgagctgcataatcatttgggcaaagtatatcttgcaagaaaaggcagtaatgttcaaattcttgcatttttattttccatgagtttggtgttttcctttcagaataatcattgttcatgttcttgataaaatcaagttgatgcatcaaggcagctatccttgaagatataaagcctatgacattaggtcctgtgatgttgttttacatgttgcttactggcatggatgcccattcagaaattctgctattctactgggactccatttctgtttttctagaagcaactgcacatccatagaatctttcttctggaaagaaaacctttcaaataaaacacactctgcatttatttattttaagccacattaaaattttaaaaggcaaacaaaatttttaaaagtatttacatgaaccatatgaaattgctgatactttggttttttggcctataaaaatgatgatttcatatagcccaatctaatattacttttcaaaaagtaatgtaatattctaaacccaatatgcaattgcttttaagtatccaaattctttgagttcagctggtattagaagcagtctgatgctcttcctcattctcatacttaacaaatattgtcctaagtttctgctatgttcagagtgccaggcatgtggtaaagaaagaataaagctgacacaacttaataattatgaaacattttttctgatgatagtatgttgttggcagaacaaaaaagttgtgtttccattgcctacaaagtgacccaaaactttacaactccttcacatgtgtggtttttcttaagcatttcctcaacttcgtactgctttttatcgaattccctgtatttatttcctcctgagtagattcaccctgaatcaacctgtcagtgtagtttagtctttcccagatattgttccccaatttttaatgtaagaattagcctagtctttctgtgtcttgaaacattaacaaagcacttaagtgagcctttatcatttcaattgcaccaaccacgataaataaaacattagttgttctcatatattattgttccttcagttttgaggagagaatcacaagtggatgtctatgtagtttgtccctttgtaagacattcactgaatagtctgcctattgttctgcctagctctttcacatttacttgagaagtgtcatcataatttttctttttctttgttttctttttcttctccttttttttttttttcttttcgcttggtgagcatcctttgttctgaggattttttttttttttttttttgagatggagtctcactctgtcgtcaggctggagtgcagtggcgtgacctcagctcactgcaacctccaccctctgagttcaagcgattctcctgcctcagcctcctgaggagctgggattacagacacctgccactgtgcccagctaattttttgtatttttagtagatacggggtttcaccttcttggccaggctggtcttgaactcctgacctcgtgatccacccgcctcggcctcccaaagtgctgggattacaggcgtgagccactgtgcccggccaatatttttgaaacgaatgtttcccaccatcaatatacccaatgctgcagagtttctgttttttgttttttttcagagctctcactttgtttctccaaaattggtcatcccacctgtgattgctgcactgacgctccccagtctatatgctgagtaacagtagggaaattcatggaagccagcgattctccaccttcacttcaccctggatcacctggggagttttaaaaatactgacacctgggtttcactcccaagattctgattaaataggcctgaaccaaaggctgggcattaggatttttttaaatctcccagggggagctaaatgcacagtgaagcctgagaaccactaattgaagttttaacaagaatccccaggcatagccttgtgtctttgacctcattgaaaccaggcccaaactttggaataggctaaaagcaagtgtctatatccacttttagaaacccattgtggtgattcattggctaccatttattaagttttttctatctgcccaaaattcatcagagtagagctcagatctcaataggggtgagaaacaataaccataatggtcttgaagtcactttttggtatccactgccagattatgctactcacctaacaatttgggcagctttctccagagagtaattaacatctttgtaaagatgtaatcacctgaagcagctatataagcaacagcagtctcaagagctttcatttctagcagcaaagaaattgtattacagtagcatttcgccagcatatcttagaacatcagtgtaatcagtattagaatgatgcattgtaagactgaataacagaaagagattaatttctattaaatatctacatctgttggttccccaaggtagattatgctgggaaaatctaatggaggattttttttaacccagcctcctttcactccgtgcccaattcctgcagttgttgctgaggtttaccagatggattaaaagaaaaaataagaagtggctccaaacatgtaagcaatcctcaattcattgctgtttgaatgaactgtggtgttatttgcattcagtcttaatttacacggaaaatgacatccttttgcttagaaacaaagatagttttctttttctacgtaacattactcactgtaggatcaaaaacttgcctgaagtttctgaaccaaacttattgttgtccataatgtcactaataacccaggtctatctccatccaggattgttacaataaggtctggaggtgtaattataggtataatttgacctcttttttactaccttcatacaatttacttggttgaaagatctctgtcagcttttgctgaactttatgcttcgctacctcagtgcattaagtaaaccataaaaagaggtattaatagtaattttcaatgaatataatatccagctgctctcaagagaatcccttgatcacatctattgccatgattttgccttagaaaaatgttactaagcaccgacttctcccttaaggaagggttggtttcaggattttataggggaatcttgcaaagacacttttgcccattgaccagtatattgagacaaagttagagaaaagaatgagatgggaactctgctaggtgtctgttctgttttgtcagaactttgttaaagccgtggggaagagctttaaacttcccttgattgttattttagacgctaatagtcaagggtattctttaaggttcttaaagttcagaaaggccacattgacactgttacctatcaataattaggtttctaaacatcacatcaaacagcatatgcagaatgagcccaagaacagtacgatttgaggatgccgtggagttccatgccacaccctacaaatccatatatctgcttttcctgctcaactctagtttaccaaaatacagaaaacgggtcaaataaatcacagatataaagaacacaagtaaactaacaaaagcagcctgggaaatgcagtgctttaaaggaaactcagaaacagagtttggattattcacagaataaatataggcctggtcactgtatgaagaatctttgaatggtaagtcatagaaaccatgtgagctaatctcagtgatttttatcaaaaaagacactgggctatctacagaacccaaggaagcattaggctttagcatctcaaagagagagggatcaaaagcaaatacagggaggtcagcagcaggagtatggtctccaggtttctggaagtctcttagaggcccaacagcatatgcctctatatctctcagttccaattccaaactggcaggaaagttatttgatttttctatttggataagaggctcatcctatatgaactagtgaattagcaataaccaggaaagctgttcttagaacaaaaacatggcccgtgggaatcattgctatagacagtgtcagcagttctcacttagaaggacctagatagataactccataagattctgttatggctattttcacagagtccttaaaataaagaaaggtcaccaaaatatagggaaacttatgtatcatgttattcccaatgccttgggcttttctattttggctaaattgccttatattcttgacagctagatattaaataattatgccttgagagtaggtggtaatactttgcttttaaaaatagggttaaactagtctgtaagcaaccttgagtttcttttctcttgagtttataagtgatacttgaggaggagcatgcactgagggtatcttctgccctcccagaagccatctattacccaaattatgtatctttcccctttctttccttctttctctttccttttttttttttctttttttgagaaatgaggaagaaaacagtggagtttggatgagatgacgggtaggaaaggccgtgaggaagaagagacacatggggaaggaaagacagtgtctagcagagaacactgctgttaaacgaggtatcccctcacccagcagcctcatggaaagagaaccactgcttcaaggaataattctggagaagtgagactgactccacagtcaccccatctttctcttagtgatcctggtgcctgaaatgactttacaaaagctctgaccctcagtccacatttaaaaaggaaagactggattcatttaaattcaaaacaagtgacaaattggctcctatcagatctttgccccagatcaggttttggtagatctgagaacaaatgaaacaaaagaattacaataatctgaaaaggaaagaaagaaagagcaggatctgagaacccccaaaatgactcttgctttcttcatagtttgcctagtgctgtccttgattagaagtaattttatttcatttgcctatgaaaaagaaaaatattgaaattatgaccaagcatggagatattttacagataccaacctttaatttagctgaaggaacagttagggcaagagcacaacagtcaggatttgacatgaaacaaatttcattcatactcattggaagataaccctaaatatgtgaactcagtgcaacctatgtgtgaagtctctttgccaaggagcaatgctgcttgctttgttcagggatctggattatgagcactctgagaacagaagtcatgtctactgtgccatgacataacacccagcacctagcatagggcctgcacatggaggcgctggactgagtaagatttgctgaaaggatattaaatcataaagcagtatctaaacaacgatatgatgtttgagaaatcttgggaagaagtgtagaattagtagtgtttaagagtggggactctcaagttagattaaattgattcaaatcatgactgtattctctagctttgtgatctccgatttgtttactctctctaaatctggttactttctctgcaaacttggagtaataatatgagcttcctcatgggatcattcttaaaaatgaatcagcttttggacataaagcacttagcacatcttctttcacacaatgagtactcagaaatattaagtacaacaagttgctgtacagctatatgcaaagtccagtggaaatttggtcaatatcttgagtttccgtattgacagaaattttcattctatcacactgattactgatcaagggatgggtgaaataaagcgtggtgataaaaaggtctcgtttgtagatagtaatattgatgttctagaacatcaatactttggaccatgtcacagaacatggcttattttagtgctctgccctatcaactaaccaataaataaattataaaattcaaataggaagctctgactcagcaagtaatttttggaaattcatatctcgtgtttttcatctacattagcatcattcaaggagcagtagcatgctcttggctgtggtcctaagtgtttttgaaacttcatttgcaacattctctctagaaaggcagcaaacaatttagaggcaacatgatggtgttatttgtcaagaagattcttatgtatatctatagtttcactttctgagggttatttttaaagagtctggatctttgacgtatttttctattttttgtctaaaagtgggagactaatagtgctgaccaaaaccaggataaccatgatgtaaacggtttctgacagcccttctaatgacaagttcaattttgatttatatcacctttccttttcttttctaatccctccagcctggaagaaatagtctactttggatggaatgtatatctatcagaatacatgtgattaatagcaactggaattaaaataatcacactctcaatatttgaatttgtgtgttttagagaggataggtacatgtaatgcagggttcagtgtagcactttggcccactgaattgaggtaattcaggaatcagtcactgtcagtagttaatatattcaatattagtgagaatgggagaggggaccatcacaaggtgtagaagcttgctaatatccctacaaagaattcattaacttcaatatgatgtgatttgagagaaaacgttctaatcactacacattttaaataagcacttgcacttaataggtgccagggtgccgattatacaactggatattatttcatactaagaaatgctaactattggaaatgtatcagtgaagttcatggaaatatacaaaatgtttgaagtgtgaaataaatgcaaacattaccaatattagatcagattatattaaattggattggggcgtgttagaatataggacagacaacatctctaaagtaattcaaaattaattcaccattactaagctgtgattcagctgcaaacaaaatggaaagcagagtgcaatttttttttcagctaagcagtggaaggattaaaaattgtaaacttcttggaaacaaaatacctcccttgctgtttaacataagtggtatttaaaaatgactttttagaattgccttaactgcttcttttttttttttttttttttttgtgacagagtttcgctctagttgcccagcgtggagtgcaatggcacaatctcagctcaatgcaacctccgccgcctgggttcaagcgattctcctgcctcagcctcccaagtagctgagatttcagttacaggcatgtgccaccacacccagataattttgtacttttagtagagacggggtttcactgtgttggtcaggcttgtctcaaactcctgacctcaggtgatccacccacctcagccttccaaagtgctgggattacaggtgtgagccactgtgcatggccaccttaacttcttcttaatttgaatacataaagctctttatccttaaagggaaattataatttgtctgtatagttgaagctgccaagactgaggttggatttcctaatggtgccttagtcattcatacacattattctggggccaaagggttccaatcagtattttgtttggggaagaaacttttttttcatcacgatttaatgaattaaatattgtggctagaccaagtggtttaccttttaacatcaatatctgttgatcaaatacctgtatattcagtttctccaagaaatgccaatttaaattcccccaaatatcgctacttagaaaaactaaacaaaagcaatcttagccacactgtcaacagaaagtttcaaatacattggataattgaacagtgcctttccaagaattctgaaagtttacgtttctaatgtgattgcccatggaatcccttatttgtccataccttaattcatatactattctagtgtaaaaattacagcaaggataaggggctccaggagatttctagtttaaactttcagtagctaaaaattgccattatttaaccagtttacctattttacatgctacatttaatggactaaaatgatgatattttgcaaattctttacacattatgaagttcatttcttttaaaaaaaaaaaagcccctatccttctaatgaagccactgtcagtagtacagtagaacattctgaagtttcatcattcagagataatttagagaacattaactttagttcctattattaattggattcaaatatcaatacttagtagttttctcttcctttagggcaaattttaactcttgtataaagaacacagttcaaacaacgcatttaaggagaatctatgactagggtttagaagactaaagatgttacactgctctctctacgatccattctaatggttggtaagatcaggtgctattagtgactatataaaggctcaaggagtcagcacaccaccattatctgactaattgctttgtgaagtgcttttagaaaaattggaactgaaaggcactccatactaccaatttattttctgttcttagtgtcagtgatgcatgagagaacagcatattgtaaagtgtgtttttctggtgataatatttttgtcaaagtgatgcagattttaaaatactctcttgctgaaaggtacagacttatcatctgtttttcctgatgtgaagtttatcttctggatattgatttcttcaactttcttcactcagataaactagtgtttttttttggcacttgcctggaatttaaaagaagctaaaaagagtacatggattaatttcagtggttgaattaactgagaagttttgcttttggtgatttcagggttttataatcctattttaagagcattctctactttaatcatctgcatgataaaataactaaaatatttaaggaaaaaacactgctacagttgcatagaaatgtttataggtcccttttataaaaaagtataaaaatataatgtttgtttctcatttctttcaaacaattaaatcaattttattatagacttactacaatcctttgctgtttaaaaaaatttgcagaaataacatggaaaaagtaagcttaagcaagaacaaagtgcatcaatgcaacatgctccctccccagtcgaaagactatgaaataaaagcaatcatggcatatgcttgctgctcctttattataattttcatttatgaacaacttacttgctcttagctgaaatttcctcagtaggaggaataacagcgcacttgtgatttcaacatgaaatattccttgtttggctttttgctcattgccagtatttttttttttatgaaggaaaattttgcttaaaataatgtctcatcatttcacatttttaaaagtttttcctaatgaatgaagtttggcttttgacctcaatttcggtatccaggtagggagctacaccaaaaatgttctcatgctgtttttatttaaattccctgaactcttgccctgagcttatttcatttatattccaagtctcctctaattgtgaatctagtttagcatcactaatgactatgtattccttgacgctcaaattcactgagtcactccattgggatccttctattgttgttaaggagatgaggaggtaaaataaggcagaatgagaaacataggagccccctactttgtttggaaatgattttatgagatttaaagttttaaaaatatgtgttatattaagatcagtatgtcgtttccttttaaaatgagtacaaggatcttttatttatgcagcacctttcttccctaaggagtgttacaaactatacaaactatacagagtgcagaaatcacttgacccaccactggagtagaacaaagcagctgtttaacagatcacaacaatactgcaaaatcatttaagaaaagaattcaatgagaaagtacagcatcccaaagaatctatagggagagtcagaaaaagcagactacagtctctcaacttagaatttagctaggatattcaagccaaacacttcattccatttttttccccttaaaaattgtagtgcctttgatccagtgattggtatctagaaatttaagtgtttctatcacatgacatctcctagacctagtcccttggaaattacttgtctagaactgatcccccccaccacacacatacacacaaattccacttaatgacttgcaatcttcactcttctagtgtacctgccttcctaccttcatgtatcctttccaaacacagtcctagtcaacattagcaatattgcaacacatatgttatttaaaacccacagtggcggagttgtagcttatcaaaagcctcataaatatgaacaggcacacacttaagacatcactgcaagattagaaaaaatttagagatattcaatgaagttaagtaaataatgtagtagtaaaataaacctagtatgcatcattgattggttgttgcttctttgtttctgattacaaaagggtatactttaattcatattatactgcagatctttctgaactccagaatatgatctattcatacttgacacgttgatgatgtagtctgttttctcaatttgtaagtgttgaacagtcccatttcattttacataattctatagaaactacttctacaaagaaaaaatgtaggctttgaagtcagattacagttatttttttttccatctggcaggtttgaatcatcactgtctctaaaaggattaatttcttttgttccaatttaaagcaacaattgccagcatcttgaaaagtatcaattatgtgggaaaacagccatgagcagaaccataagaaaacagttaaccttcgtctttagagtaactgtgatgccactaataattccattttctatgttcccaaatatctaatgaccctcctttttaaaaatctaatactctatccaagaaaaggtaatcacatttagtttatatgtataagaaatgataatgaaaaaacattcatattcactgaaattttattcgatttacagttattagtgaagctaccagttgtctaaaattcttaaaggtaatgtacttgggcattttaaagcatgctatattattattaaaaacaaattataaatatgaaagtgatgacaattgcaatttctgttaaagtaattatagcatgtaactaattcatctaattctcactgacttctcttatgtacctgatcaattccaagatttggatatgaagcactgaggacagtcttgggaattactgagctctacacaaattttgccatttttattatactatcgttttctttagttgcataagtaattgtataaattactttagttagcataagtaatttgaatgaaatttcaataaaatgtcaataaaatagctattttgttttgttggcttagggctaaagataagaaagatttgatgttgcaattgcttttggatattttattagtacagtagcaattgttcataaatacagagtgaaaataataatgcaattttgatacagatgtgagaagactctagaccaatattttgtatctaatatgtctcagcttcctttaagtactttaccacatttcatttcacaacaacattatcaagaaaatattatttccatatttagataaaggaaatggagcagaaagtgattcagtaacttgcccaggtcacatggttataagtgatagatcaatatagctaactctaagatcctttctattaaacaataatattggtttggtgaataatatgctcatataatttcaaactttcaaagcagagtttacacaaaaacttgaagcttaactttagttgtatgaaaccccagggtttcatagaaggtaacttgaaaaccataatagatagcatcttataaaaagatgcttattgtgtgggcacagtaaaactttcctttagcactttcagtcctagcaaataaggcttctctgtgactatgctaattttattttccttagctatatgtgaagtcagcggagaaccttatttcaagggtgcatccaacatgtgttataggccagccatagactttagaaagagagtattaatgagctcataatatatctgaacctatttattagtaatgtttttcatgataatattttattcatatcatgaaattcaattatataaatatttattaatagaaagtataccccccatggatattaagaacatggaatttaaggtcccacaaacctggattgcaatctcagttttccttttgctggctctagatctaggacaagtaattttaattcactcatctacagtttccttataggaaaactcaggccaataataatgtctatctcagggctgttgtacattaatcatgtattaaattagatagtatatgtaaaacacttaatgggatatctgagtataggaagcccttcagaagtgattttattatttttgcatatataatagcattattagtgatagatactagacatggtccttaatattaaatagacacggcccctacatagacatgtaggttatggactgaaaagagaggcagttaaacaagcattggccatgcagtttactaattaccaagccagaaaagaattaaaattgtcagagttccaaaagctttcactgagttcaaaagtaatttcaagttgagaactggtcccattgaaggtatatatgtcatgagggccccagtctaaactcacattttcaaattgtccttcccaccatggaaacacttcaacactcatgggttagaatcagatacccaaaggagtattgccatttggataggcgctctgtttgcctacatttcttttccctaattgttttgcattgaaagtgtttggtgcaccttttaagatgccaaaagaccacaggcctcatctcctaacaaccagatgtgactgtgaataaaaagtttagagaggcttctcattcaaggttttcttctagggaggaccaaaatcttgaaattgactaaaaatacaatttctattttagcttagagaggacatgatggcattcattactttcaggatttcctgtctctggcaggccaacttgtgaccatgtatgaagatcacttatatcaggtttgggaattaaagtattagattcggtcatcaaaggaatgcttggttaagactagccaatggatcaagtgactcctgtatggctgaaattgccaaggccaaagagtggctagtatgtaagaagtggttcccataatatgttgtcattggaatgctctatgaggggaaaaagcagaagcagcagtgactgtaaatgaggtctagacaacaggtgcttttcttgagaaactggtcatgttactaagaatgatgatgatgatatatatttggcttttcttatcttttggcagtcagtagggataagtatttggtgccatcttctgagagcccctgaaatgacatctgtcccatctgttttatttatttgtgtgtgtgaattttttcttttgttttgggttttgttatctgaaatatactatgtaggatcgttagatatttgtgagaagatattctcggaaagcttcagagctttgcgtagtaagtctgattgcaatgggggaaaaggggaggatcctgcaacacagttcctgctttctccactatcagccatgctgatgcttttggcaaaatgcattatgatcacacttaattcctttgaaacacagtttgttaatgggtaattaagatgtcttgcattgattattgactttggttgatatatagctcctgatatttcttgctttgtaaattttttccagccactagcagagttctaaagaaagaagtaggtctgtatccttacaaatatacccctaagctctctgcccattaacatttcagtttataagtgttttcaatgtgaaactattcacagttaccttgttggccatttttcagcaaaagggccactcctgctgctgacaggcatgacagccagccaggagaaactgggcatagaggagaagcaaatctcccctcaaaattatgtgaggggaaattatatgactaaatatagcaactgtttaaattcatccataattcaagattttatcaagtccctcctcctctgtgatgcttcgttaagtactccaagccatgttgaccaccttgtcctctggactttcatggctcttagtttattcgggtatttaaaatgaaaagtaagacacattagtcattgagcacatggaaactattttcctagagggtgaaaacatgcatgttttatgtgattattgtatttttttgtagtcagcttcattaccattattaggagattattgcctggatcagtcctgaccaaagctgtttaaccatcatgtggtaataacagtactgcaggaacttgatgcccttaaggacctctatgtcaaatatctagaatttactttttcttaatttaatagatcatttgaactcagaagttagtgaacggttaatttgggaatggaggacaaaagctagatcatacttatacccttttttgttcccatacgtcaaccttcatttcctgggaggtgtcaagaaaaggctttgggagcagaaggtgaatagtagatttgagagctcaattctcattagagaggtaatgaaataatttcagtgcaaaagttcatcaaaggcagaagagtatgtgggaagtagattctgagataggaaatgcatgtggataaaaagtatgagtaatggcccccttcagtcattcggcattcaactacaaatgctttctaagtgtctggcactggttttaggaagcacttggagatatagtaataaatatgttagccaggatcactgccctcaaggaacttatactctagtgaaataaaaaaaagaaaataaccaatatgcctataaatagtgattactgtggtgaggggaaacatgaagataaaaagggaataatgagtagtgacttgggagtagaaggtccatttgtatagcatggtcagagaaaggctgtctgaaatggtcacctcttagttgaaacctaaagaataacaaccatcctggaatatctgaaggaagagggctccaagcagaggattcagcatgtgcaaaagtcctaaggcaagagtgactctggtttgttctaggagcagatagaagtgtatggctggaatttagtaaaaagaagaagagaggattggatgaaataggcatgaccacagcatgtagaatcgtataagccatgacaagtggtcggacttaattctaattacaataataagccactgagatgttttcagcagataaatactatgatcccagatatattcaagaaatttactctggctattgggtagcatattgactatagggagaaaagataagagttaagagagtgaagagaataatggaagtgatttagactataatagtggctgtgagaacgatatgaagtagttagatttggaccactttttggagacagaatagataggttatgataatgtagagagtgagggaaagaacagaatcacagatgatttccaggatcctggaatcagcagtatgttggatacgtaaggtgctccaaatgccttctcagccacctccctttgcttattcctgctttttgctagccttgttttcctgcctaatgtccttctggacaagtgcccccatgtcttttctccacaccgtgtctagcatagcttgaagtacacagcaggggatcaattaaaactccatgaactgattttctctactacctagaaaagaaaatatgattcaagaacaattttcttctataggaaaaacattttggtaaaatttatagaaactttagctttgctctaaccatgtttatggttccaagattacttggaacatgattgttccatttagtggccttccatcaaatttaaaatatgagttgttcactttcattacatgtttaacttgcacgaagatacctctttttgttattatgtgacaacttctgttgtggctgttatgaaatacaaaacaatattttaagagctctataaatggttagtactttctatgagaaaaaagtctctatgattactgtgtatcgtattttcctacactaatactttaaatcttagtgacttcaccatttagataaagagccctctggtttttgtttgtttgttttgttttgtttttgaattccaattatttatgtaaggccatacactctgtggattgtcaaaagcagtaggcaaacctactttcagtcttccctgacctcagaataatctttggttgtctgcatacttccttatggatgagcattggcaaatgcaaatcatagctattaatattaaattataggtattaagttcttacttgctccctggtaccatgataaacacgtgtatgttttatttcacttaatcaatggaaataccctatgaagtaagtaacataattatccccgttttactgataaagactgaggcttagaaaggttaaacattgtgccaatatcatctagctgttcaactagaactgaaatgaataaaagtctacaactcacattcttaactgtttagattttcagcattttgaaatttgatgtgctttcacttgcatctcttctttgtttccccatcaatatcaattccatttgtttcattatcatcctatgtttcctttcttttatttttgtttctgaatctagatttggtgcttttctccacaggtactttgagcttagcacagacggcatcctctatgtttcatggcactttcccctcattgctgtcactgttctctctcccagattcacaatactgagctctgataatatttccaacatttcttacttgcctttcagtgtctgtgaatggaatactgctatgtgagtctgaggtttgtactggaggttttatgggtttcttgttattgctagatgaatactgtaggttattactattactgtaggttaatgtttctttatcctgttctttcaatatcttcctagtatgatggagagagaggttgaaaaatcaatagaattagaattgaaaagagaccatgacaagatgaaaattggatagaaacaaattgaatgattttttttccaagttgaagttcaagattagagtaaagaggtgtctccagcttctctcagaaaataaaaggtggggaatgtctcacatgtatctatcacatgcccttttctcactttggttgcctactatggaatcctccacttcattctgaacaaattctcctctcaaaatgtttccttatgtgttcacagcagggaccaagctgtttgtagtagtatttcctactgcctcccttgatgaagaccgcacctctttatatgaaagtggggagaggaggtatctatattttatcccctcacttattaaataaagcccactacactattccctactatattttttaaattaaacctggattcctgatttaaaatttcaattcctcctataatgcctccaaaacacccagatcttctgatcttttgattctcactgattatgcctttgttccttcactacagactcataaagtcctgtcctgctatcagttttcaagtcatccctatggaagttcaaaattttttctagaggtcatcctaatcatttcacctttctatctgtattttcattattcattttatgaagacaattttcttctaaagctagatcctctaattgtacccttcattttatatttacctaattcctgagcaatcttgctcccataagaatgttgtcgttttccaaacctattttatttcccctcaaagggaaggaaggacagaggtgtcttggtctagaattgtacctgcagagatggtgagaaatagccagatttaggtcattatgccaatcattgttgagaagttcttacagaatttgcgttctatttcttaaaagaaataatggctaaaaggttgcattagaatataatatgaaactttactcgaaataatataatgtcattagtgaagaggaagttaaggaagagaccacagtcttcaagtaatggaaacatttatttaacatttactgcatattttttcatgcaataagtatttattaattgctaggtactctgctagatattaaagattctcttgagcatacaataaacaatatctccttaagtttacataccagcttagaagaaggataattaatcagtttattacaaggaagtgtgatgagtgaccagattgggaaattacagagaaatatgcaaatttatagtagggcattccatctagtcaagaaggaaataacatttcatcagagaccctaagaataaataagagttaatcctatcataatattaaggagagaaagttgaaaaaaactgtccctgacctctaagaacttacaacacaggaatctatatgctttctgaaagatcttgctagaaatagttcaaataaactagggaagaatttttaaaacaatagctgccaattttgctcttaacattttccagagatttgtaaaaaaaaaaaaaaaaaaaacacctgtgaccaatcaccattttaaacctcctgaattaaaatttctgggagtagatcctgggaatctgcattttataagctccctgggtgtttcatatatatatgaataattaggaaactttgcctaaaatataaacataggttttcttaagaaccatctgtgggtgttttaggcctggcatggtggctcacgcctgtaatcccagcactttgcggggctgaggcgggtgaatcaccttaggtcaggagttcaagaccagcctggccaacatggtgaaaccccaactatactaaaaatacaaaaattggatgggcatggtggtgtgcacctgtagtcccagctactcgggaggctgaggcaggagaattgcttgaatccaggaggcgggagcagtagtgagccgagatcagcccactgcactccagcctgggtgacagaatgagattctgtctcaaaaaaaaaaaaaaaaaagggagagaatcatctgtggtgtattatatctgcatactctcaggctgtacctgagaacctggaatttgtagcggtaagaggtccagactctatttttgggaatcagcacagtcagtgctggttgaggagtagacagaccacacatggtaactgagaactctgaagtttcaccaccatattatctattacagaagacaactgtggactagacactgatttaagttttagaggcagattggatccaatcacctggatgatatcttactttttgaccatacatagcacaaaccatctcttactcaagcataattgagcaggtactattctggtatacaaaaggcaaacacttctttgttcacaaaaatgtaagtatatgtagagatttcaataagtaaggagagaatcacttttccaattctattatttgttattgtggtgcttctgggatctatgtggtcacgtcaccattatatagctcttcctttcaaaaagagctgaagggaaaatttattataatatttcctggttccttgtgaagtgtgtaggcaaaaacagccagctgtctacaaacaagtgttcaatgcttctgaaaacaggagagtgcaccctgtcgctgctccctgtgcctctttccggactgccactgctttgtagtcagaatggcattttccttctgtggtttctcattatgctttatgatgaggtaatgtccttaatgtggcttgctgtgctttctgggacgtaccccagcccacctccagatgcatccaccctctttctttgcttcattaactgtgccatgctcctttctactacaaggcccctcctcccatgcagtcccttctacctggaggtctgtgccacctctgcttgcttccacaccagcctagctaacactcgtctttcacatgtgagctcaggagtcacttaccaaagaagcctaccttgattccccatcaaggtcagttattaaacactatttctatcttgtagagtgcacttctctgtttgtttttgtattctctttcatgagtttatttgcttaatatcaccttaactagactgaatgcagggattgtgtgttggtgtgtgtgtgtgtgtttaccatattgcctaagcatagtaggtatttcataagtatttgttgaagaagtgaatgagggtttaaaacactttgagagcatcaggtctatgatttcagttcactgagtgggttcatcaaataattgttcaatatttgctatgtactgagtccagtaatgggcaccaggaactccaagagggattaactgtttataaactgtaactacaacttgcacactgaattttagccaactctcttacaagtagatgctgttggagcacccatttgtataagcggtagccctttctcactaactcatctccccatcttctctgcaagcatctgaagcatatttcactatatttcctgcgttttttcctctataacacctaggaggtcttaataaaaatatccaatccagtccagttatagaaaacaaagcaaaaacatcagataggttcttcatttactatataaagccacttttattctagatagttatagaatgtaaaggctaagagaaaacattagaagggtaagcttatgaaggttttcttcatgtaagaccaagattctatcattatgtccattttgttagaaaataagccttcaggccggacgccgtggctcacgcctgtaatcccagcactttaggaggccaaggcgggcagataatgagatcaagagattgagaccctcctggccaacatggtgaaaccccgtctctattaaaaatacaaaaattagctgggcatggtggtgggcgcctgtagtcccagtactcgggatcatgaggcaggagaatcgcttgaacccaggaggcaagggttgcagtgagctgagattgtgccactgcactccagcctggcaacagagtgagactctctccaaaaaaaaaaaaaaaagaaaaaaaaaaaaaagaaagaaaaaggaaaagaaaataagccttgggtatttttgacaacttctaatgaaaaaccagttcaaatattttcatcagtaacaagtctcatagttagtacaatttattttttctgaaatttaacctgaaacctatgttcagatatgattcccagtcttttcaaatactttatactatttagaataatgtttagaattcttccctttaaccattccatatcatgcctattttagtgcaaatatttcttctctttgaaaatgcattctcaaaagaagacatttatgcagccaaaatcacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtatactagttcaaccatgtggaagtcagtgtggcgattcctcagggatctagaactagaaataccatttgacccagccatcctattactgggtatatacccaaaggactataaatcatgctgctataaagacacatgcacacgtatgtttattgcggcactattcacaatagcaaagacttggaaccaacccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaaggataaaaaaccaaacaccgcatgttctcactcataggtgggaattgaacaatgagaacacatggacacaggaaggggaacatcacactctggggactgttgtagggtggggggagaggggagggatagcattaggagatatacctaatgctaaatgatgagttaatgggtgcagcacaccagcatggcacatgtatacatatgtaactaacctgcacattgtgcacatgtaccctaaaacttaaagtataataataataaaataaaaaataaaaaaagaaaatgcattctaaaactttgatattaaatgtaagttaaaagtttcaaagctaaacttgcactctaatataagcttatgctgcatagactggactccaatttaaatatgtttgtaatattgtccttttgttttaagtaataataagtaaccaacttttttatttgtttttcctatttttataggtgtgcacatcaatttataccatatattatctctttgacaatttgttttatctgattcatattgttgatgtctgtatcacttactactttgctaatgatttaaactagaagaatcagagcctaaatagccagaaaaataaaagtttatgcattaaacatattcatataaaaaagatatgcagccagaatatttcggtctaatggaccgaagtaaatataatcgctccctatttgcttaaacgaatccaaaatacctagttgtcaaaacagttctgaagttcaaatgaaagcaatttgtttaaaggcttatgtgaaagacacagtaatactcttatgccatcatgtttatcctttatatcaataaacttccatgtacatacctatttaatgtattctgctagtgtttatttttgccaagctaggtaggccaggattatctacacttcttataaatgaaaaatctgaggtaaggggaggttaaatgactttgccaaggttgcacagtgagtccacagcagatctaagatgaaaacaaagtgtaatgagccatggtgcctcccttcctggaaaataatttatcaagcacttatcccaaatcaagattaataaggtcagatgataacttttccttcactgaaacacattcagctaatacaactgagatctgtttaagttaccatttctaaattttgtgtgtaatgaatcgcaaagagaaagacagttaaaaacagaagttctttctgttctctaataatatcaaaggtttcacatcttttcactatcacagcatctgtgtgaggtaggacatgtatagtgaatttatcacacctatctccagataaaagctcaaaagaaaaataggtctatggctcttcaatgctctgatatcatacgtgtttctagaattaaggctgtgtctagtgtgtttccataagcattatgctttcctttggagtcacatggttcctgtttaaacagctgtcctcagtgcaactgctttcatactggttgtaattatacttcaaatgaaaaacattgttgcattgttatttataaattggggagggagagcaacttaaactacatagaggttagtttttcagatctggaatcagttaaattatttactaagggcgccagtgtcagaaagattatcctctggtatatttatacatttaaaggggaaaaactcaattacaaaatccctgagcattaaatgggtagcaatgcttactgcaacttaatttgaaatggatttttaaaactggtggaagttgttactaatgatgtcatggaggaggcatggtgattaagttaatgttcagtatatgcccaggatttaaatatctgcatttggtctcccattcagtttgtaacagtttaataaataactaccaacaaggtataaatttgggaaaattgttattttttatttgaaatgtagtgtagtttgatggatgaaggccaccataaatccactccactatgtactaactatgatgattttgggcattttaagaggcaaagcattggtctgtttaattatctgctcctagatatggacaaggggcttattgtgtttacacaaattttcttacatccatcacttattgacctattagaaatccctggtgggaatggagaaaaatatagtgactccctaatattccacaagatttccaaaggtggctttaaaaaacaacctcaagtcagctacctgagaactgggaagttctctgctttatgataggtagatattcactttaagaaaaatatgacttcagatcaggagacaagaatattagaaataattgtagtacattcattttatacttacttgtattaggcatttattttatatcaagcattatgctaagtgttaagaatagcaaaataattaatcatagtctttgtcttcagtgagctgtctaataaaataaccaagcatgtaagcaaataaccacaatgtaatggtagagtctctaattgagacacatagatcaacaaagaaaaattaactaggatagttcaaaaatataacagagatgttactgaagagataattgttcaatgatttttcaaagtattttatttaccaacaaactgatagatgaggagggggttgtgagcaatgtgtgtgatacaaaattaggaaatctaaaagggcatgacacattgtggggaggggacttcaacctagccagaacatgtaagagttgggagccaatgttggaggaagaggttggaaatataaaaagaggttaggctgataaaggtcctgcatgctctgctaagtaatttcaggaagcagctgttgaagatttttgaccagaaaattgacatgattagattgtactttgataaaatgtctctgtcaacgaggaaataaatagatagaaagagtaacacaagtcatataaagctagcagccaagagtttagtatagaagtcatggcatggtccaggccaaaggtgaagaggtcagtagggatggtttaaaaagactggtttgaaataaaattgtttattttggttagaagagtagtgtggcatggatggcaatggataatgaggacaaagaaggacatgaagagcagatctaggtttagggcaaaagacaatttttcttaaaaattgtgcactgttcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccagggacggttgtggggtaggggaggggggagggatagcattaggagatatacctaatgctaaacacgagttaatgggtgcagcacaccaacatggcacatgtatacatatgtaacaaacctgcacgttgtgcacatgtaccctaaaacttaaagtataataataataaaaaattgtatatttattaaagtctttcctcttatataaaacaaattctaagtgaaaaccaagtaccaagaaaggaaagagctgctagaagtggatttcccttggttggatgggccaaacctaagtcctataaaggcctaaagaaaaacatttgccacttgagggtggagactttctagagttgggcagcaagacattcctggaagaaaagttgctccttatgggtatcattatttaccttcagtaagcataaagactgggttctttgagagttaaagagtttccttctaataatttgggaaagacatgttaatctcagttccgtgaattagtagttataaaattttgtatgaatcagttggattctctctgaaactcagttgtattatgcttaaaatgggagaataatatctgcctcataattatttctaaaattaaatgaaatagtataagtaaggtgttttgtattctgctcagcacatacgtaatttgtaaatgatagctattcgtcaaattcctattgaaagtagtacatgtgtccattaaattaagggttgccaaacctcaattttatatttctttatatcttgtttctctcctttattcaatcaacaagcagtttttgaagtgttgtcctgtatcaaggggtcacagatttgctggctatggtctgacaatctaatggagagagagaagtattgtcaaataaagacagtaaaatgtgatttcgcagtctataaatatatacaaataatatttcattcatgagtattcttttaatgtccttcttaaaataacttaatttggggatttgtctttaaaactctcgcaaaaatttgaagccaaattaagttactcatgagataactagtttgaattaccatcaacattccagggttatactgcaaaacctatagatgatataactacataaaccaatctacacattgataatatcataatgatagtaatcataatgaagttaaaagttaatgcaaacattatatttcagagtgcctacctaccacagttgctatctgtatagatgtaattatcaaggataatcaacatgagagacattttatttatgattcatctgcctggttggtactatgttggttacttttaacttcgatgggaaaaatgacattggactgggaggagttagaagtgaagaaacgacctacagcatttatttatttatttattttactaaactcctttcatgtcagagaaacataaaactgctgattagagaaaccaggagtaaaatttgtcagtgaaacaaaacaaattctaatcaattcttgttacagtactaaaatgctttcattttcataacccatttaacaagtagatgtttcctgtgatgcaaaaatacattttttttccttttcacacctctacaaattgcttttgtgtgatacactgcaccacaggacacttatccaaagagctaatgtaaaaacctcattttgagaaacaaaagtagtgtcaatttatatgtcaagagaatgaatactgcattccaagttgatacaggatctgacatttcaaatccaacataaattatttggaagactcctgtctttttccctgatctctgtattaacagcttttgtgaccttgaatgcaaatgaagtacaatactaaggatgttcttcatcagtatgaattagaagttttttaatgtatgtttctgtgatcatcagcttattttccaacatttattttttatctccctaaatcagtttaaccagcagcatgttgcgaatgtgactcatgtcatctgtgcctgtggttaacattatgttgctgcaacaagtccacctgacagattttttgagcctaggaagttgtccatttcaattaacaggatgcccaggacatttccctggcagaataataaaagctcacactggttctcctcctctctgaaaaagaagaaaatattatgtactattaccataaagtcaactttctatttttgtttgaaagcacagtcttagcaggaaaccaatataaacaacaacaaaaaaagtatgtgctgaaacttagagaagtgtgatttctttattctctgcattatagtatatgcaccaggcattcctttcttaattctgtctctcctgtggaaaatagatggatacatccatgagtttatattgctgctattgcctgctgttccctgtccatagcaataggtctgggttttctgtgctctggaaagaaagcactttgaagaaaatgcatcattctaatgtttaaatagcatttactctatgaactctttgaagaaacctgtggtgtttaattcctagaccattgctaagcaaggctacctaatgggtggtaaagtaaaaacacagtgtgatgatgactccaaagggcttcaagaagaatttatgcagcttctcaataatactttaatgagataggaaactgacattttctcttagtcaacgttggtgctaaacttttaacaaaattgcattgtaagccataactcttttagtccaactcaatttctctctgttctattcttgataaatatttttaattttcatgtaaacctacatcagaaaagaggccaaaaaaagaaaaccaaactgaagcaaagctccattcagctataaaaacatccttgcaaatgtatgcaggcactccttagatataccattttgtatggttgagcttcacaaactcatctctgcagcaggctgcacatttggctaggagacaactgagttataaaattggttttggactgttgagaaaagaaatggagctaaagcatagagattctatcatgagcctagtaaaataggaaccatttcttttagtaaatttttcctctaatattggtttattgtctttcataaggggcctgatcattatcaagctgcctcaccctgtttctccatgcacagtgatcctcaattaaaattgtgcatatatagatagtgaggagatgagcctaaaatactgaaaatatctcctttcttaaaaaaatcaattattactgaaaatagtatcatagcatcgtacaattgataaattatagcattatgaaaaataattataaaaaaagaaccatagcatcatacaatttgagaactgaaaggatgatcagttaacccctccaaaaattattttaaagatgaaaattgctgtgcacaaatgttgatttgcaccaaatcagaaagctagctagtattggaagaatagaagtttagaaaatatataatgcccaaacctaggctttttaagaaaataatttagtgtaattctttttatttgatttttcaaagaattgaattctaagcagaaaatttaactcactcattaacatttttattctgttgccaaaataaaattattttttatatttgtacgcccccttttttttgaaagcatcttcaaatctattatttttgtcttcatagccattctgtaagttagctataaaaatttctgatttacttttttcccactgaggacagtgtaaaacagagataaactacaacatttctaagttcacaaatcaatgtcactacagacattgactatataattatgagtgccaatgaatttgcggaagaaaaaaaaaagaggaaacttactttcactgaatacaaagttatttgtgctgaaaactattgagagaagttttatatttattaggtaattatctgtggagagccattatctcaatttcccaaacaacagactgagtctcttagatagggtaaataattcaactgaggctttaaaactgcttggagacaaaggtgggattcaaactcagtattgttactccaaaacaactacatggtctgctacgtcagtggctctcaaagtatgatctgggtacctgtagaccccaagacgtttttaaagaagattctaggattaaaactattttcattataataccatttaaaatctcattctctaacaattgtacactggagttttctagaggttacctccagctgcttgactgaagaagcagagtccatctgttttctcttaaatcaaacatttaataagatttgcagatacaaaaaataatgtcatgcttcttattatttgttttgttttggaaaattgttttaaatatattaattatgttacatgttagaggtttattgtttattttaaaataaattaattatatttttattttttacttttaatatctagtaggttatatgtctgtagatgcagctcacacacataaaacctctcatgcatccttaatttttaagagtataaaggagttctgatacaaaaaacattttgagaactgtgctaaattaagcttctttactgagtaaaattggaagctacaatatacagcaaaacaacccaggatctagctttcgaaagacaagcaaatctctgtgtaccttagttttagtgctagaaataacctttagataaaatcttgcttccatgccggttttttatttaacttatcctagaaataaatcagtaattattgttctttgcttggaggtcatgagttatgaattgtcactgtaaccaggtatttaaatcagactcttttgacttagtttgagcaaaggtctaaaaagccaaaaaggaaaagatgggtgataaaacttgcacgttccaatgtgaggggctagagtctccacagggctttcaaagacaactttaaaaattggtttgacaatgctgcttctacctgaatataaaagagttgaagtaggaaaagccaggtttttggaaattaaataatttatttgattatggctgtcattgtgctctgaatcttcatagaggagggaagaagaaagcttctgtctcccacaaaacctgaggggtggggctttagagagaccatctggagatcctcatctgtaacacatgacatttctggggctccacagaggatgtctgacccacagcaggaaaagtcaaaggtggggatattgtgactgactcagccctcaaatggaggagcatgcattgggagcttcattgagagcaatctgtgcttacagagactgagagccaagaatgatgtttcctctgggaccagatattgagaaaccagcctgtagtcgttgtttttagtaactttttattttttattatatataactgacaataatacattcattattattacataattatattgcattatttcatgcctacagacgttacaagacaagcacaaaaatccccatatactctttaccaagcttcatcaattgtttctgttatctcatttgctttattattccatctctctctctctctttctctctctctccatgcacattcatcacacatccacttttgttttctgaactattcacctataggttagagacatcatacctctttactcctaaacacttaagtatgtacttcctaagaataagcacattttcttatataaccacagtacagtggtcaacatcaggaaatttcacattgatgcaataggattacctaacacatagctggagttgttttaaattcttcgcaacactgcctggaagagcatcctaacctcacggagggagagaactgctgttttcccaaaggttgaaggaggaagtgtgaagggcaaacagatggaaatgcatggggttctaactcagtcttgagtgtctagcaatgattctaggaaattggggctggaaatagaatagaatcatttactgaaggacaattcaaagacgtatttgctgggtaatgggattgagagaggcgtgtggccagcaagcagcaaggcaaattcgaggatgggttggagagcacctatcccaagcttctgtttgtgcctattgactaatgtcagaattggtggcagaacccagggttgtgctgcttcaaaaagtaaagcacatttatgttagctgctgtactcttatccaaatccagaattttgcttgacagtatgttaatataatgtgtaatgtatctttaacattctagggctataaactcatttattcatttaataatcaaatattaactgaatgtctaccttgtaaagatacctgagcagtttgttcaacactcattcattcaacaaacacttacagataagaatgatgtaccagagtttctaattgctaggaaaacagtatttgactaaaatgggcaagacccctgctctcccctggaaagtactttctagggtacattctgttgtccttgttgaacttagcaatatcatttctgtagggggatgctgaaatgatgttttggtatatctgacatactatattttttatttttgtgattaaggaaagatttggattggagaataacgctaaataaaattttgatctagctttgttcctcagaatgatctactgtcttcttaaagtcctgtttgttggctacatattttgttatttttaaatattttcaggatagcaggtactttatgctgcatttattgtgacctttgatagtctaaagcaaagcagaacacacttatttaaaatgtgcttataagatgcttctttaggcaaatagaatttatacattcatgagcaaaagcttacagatgtatacattaatgaactaattattgtgaataccaagtgttgattttatatccaaagttccatgtgtgtttttaatatttaggaagttatgatttgtctacaagtattttgacgtgatacatgtattaaacactcaagcctgaattcagagtaattttcctctggaggcaagaaaaaaattatctgaaccatcattagttttacttcaatgtgaatcatgactccacatcaacatgattccatttcccctaagctgactttaaaactcttaaactcaaagccaaagctataatgacatttgcttgttgagctttatagaagcactgggaagcctggaaatgatgcttaaattatattgaaccttgttgtttctagtagccttttttaaaccatgagaaactaagtttagtagcttgctttggggatattatttctagacacacaaatctagtgaaaagaactcgaagtacactgtgtcagatttctggctattatacgttgtagaataaaaacatgattgatatcttaggcatacacacacatataacacatatgcatatatatgatatatgtatgtatatgtgttttatatatacatatatatttcttctatacatatgtatataggctctgtattttgttcttcagtacttgtaatgtatgcattcatatatatgtttatgtgtgcgtgcataatagctattaagtggtagcaagttataaagcctgtttgactctagagcttttttaaaaaataccagacattgtaactgtataagtgaccttttcagaaggttggtaatattgacaacctcgttgggaaatgtgttttgattttgctaaatagaagtagattatgtttatatatgaatatgaaactactttaaagtgaatctttccctcagtgctagatataagatactgaaaatagatatttaaaaagatccttgaaatgcaaatgcctttggcataatattatgataaagcattgtgtttaaagcctgatttgttaattttatgcatcatttatttgaattttatataatttttaaaggaaatattactattcaagtgttttaaatcacttccttttataattctaagttaacagattgcttacagcagtttatgcttctgttcaaacattttaaaggaagaagaactttattaacttgttgggcatagaaattatatctgttccataaacatgttccaagtacagtacacagttattattgcttcttgatgaaggaggagtgcatgtcctagttatagaaatgaggaagtaaagatccaaagagttagttgcattctctgaatgtgtaatgcatttatatattgaacattggaaaaaatgcccattcttatccatttaacatgttctttcttgataagaaaatgcaattttgcagttaagaaaagcgaaaagttataacaaataaaacactatgcttttatgttattggaatcacgtggtttatttatttattggtttttagctattagaatatatttaaagctaattgaaattccacagaactggatactgacttgttccttttatacacatatatgtataatattgtgtgtgtatatacatatatattttatatatatatatatatatatatatatatatatatcacactttcattgtccattcactatcaatggacacttaggttgtttccatttcttagctattgtgaataatgctgcaagaaatatgaagtggagatatctctttgagatactaatttcttttcctttggatttatcaagaccacaatgagatttcacctcacacctattaggatggctactacaaaaaaagataagcgataacaagtgttggaaagggaatggagaaaagggaatcctgtacattgttgatagaaaaacaaatgctacagccgttatagaaaacagtgtggaggttcctcaaaaaattgaaaatagaactaccacacaatccagtatagcccacttgtggatgtactctgctttattaagaggactgaggttcttgctatttcttgaacacagagaactatctgctgcctcaggccactgagccttcagctctctccaccttctctccaggaagtttcttacctggatcctcagctgaatgtctttctcactttactctggtttctgctgaaatatctttccagagacccctttgctgaccgcctactttaaataggctctcctccctgtctcctgcttacttccattaagctttacctgcctatatttttcttcatagccattattactaccaagagttatattgattcactttctcaatgagtccatgagagtgaggacttcatcatatttaacactagaaacactgtctatcatattaaggaggtgtcaaaaaataaaatgtcaatgcatatataaggcatataaatatataagtatgctttttattatatataagtataacaaataatacatagatattatgtagatatatataaacttgtcaagccctctgtggaataaatgcattgggcaggttgaaactcgaaagcttttaggcatgtgacaaccatacatactcgaagccaatttgtgatcttaaaaaaattcatttttttcccaaagaagaagtcaaactaaaacataatattctatggatattttaatgtggaacaatagaaataatttatttaaaaccataaataagaagctttattaagatacattctatctgcagcaatataaaagcatagcaccacatcaattatcttgagtttgctttaaacagatagagaccagtatagccatagacttcacatcaaccaccggccaaattttcatggtctgatagcctttctgtggatggacatttctccttatacattcccaccttgtgtgcatttgaacttgtctgtctctttatgcagtcatattatggactgataaagatctccacatttgatcagattaaaggggaaaaagaggatattgaatatgaccaaatccataagatgagattatcaattgcttgttcaagtaatattgtaaaaacacgtggttaattttgtcatctcaaaggtatttctatggtgaatgtgttcaaaaaccagaaaaatcacatactgtgtactgaaagcctcttcaaattttctgtctgtcgagttattttttgtgttctactaaccctgtcagaccttatcagatatttcttcacttcaatacaaatctgtttttaagcataatcttctcttatgttactgttcttctaaaattttaagtgtaaatgctgcagaataatgcatgttgctgactaatctaatactatagaagttcaaaattcaaaacacagaaataaaggaatattgatagagctaagtgctattcaaagttttttctgtagagaaaattagagcctgtatattcgttacagagactgtaaacactaggagagtaaagtccctgtgcgcactgtgggcctcatatccagggcacttagcactatataggcactcaatacatctttgttggataaacaaaaatttgaggctatgtaaatgatcccttttcccccaaaataaaaataattataacacagtattagccatttaggtataattggtaaatagttaatatagtcttactttggtctaaaatgtgcctgtttttctggatgtggtattgggaaggaatgaattatattcaataaacaatgaaatgtataagtattatagttgtataattgagtgacaattttatgccgttccataagtaaaaacttcactttacccatgaccttgtctcaagagcaatagaatagttgaaatgggacaagacatagaaaacgtatgtagaggttcctgccattcaaggtggaataataacagtaataaatattctaagagcattatttcaaaagagtcttttatgttaacaatagtcacaaaaatatttcatttttctatatcttgtggttgggacattagtctcttatgcagaaatatgtacaagatatatttttgtttttgaagtcctacatggtagtaggatactttcttgttcctgggtaatttctactaatgcaggtatcagttatgccttcaaactattcaatacctcacccttgcatactatcggtagtgcagatttgtttttgttttatagcctttgttaatgcatttgcagattgcactgaaaagagcctgagaaaattactccatatatcagcatcaacagtacaaattgtttttgtttcttttcttttttaattcacacactgtgctagtgtgccatattgtacaaatcagtaaaaaaaaaaaaaaaataggtaattaaagctgttctggaaagttgtagtgctggagcaaatatattttttcaatgtttctcaaaaccaagcaacagaaagggtaaataaaataaaacgtgaagccaaacatacattctgccctcttccaaccacaaggattcagaaatatttgcaacttctgatttggtgattaatttagcatcacttgtgaaattagtgaaattaaaatatttttcatgcatgtaatgttattctctagctaaggaatcctgaatgaaattttatttatgtagatatgctaagtgtggccataggaggttacatggtataagttaagtaattaataatagctgtaataaatgttattctaagaattctcacagtaacattttacaattagagattattttataatcaactgtattataaagataatgattttcttctttactcaaatgtagaaagaaaagttagctgatttgtatgttgctagccacatgtattatataaattctaatacaattacatgtcactgtgcttagtttttatgtcagacttgcttcaccattcacagttttcctttttctccttgaacacagatcatcagtaccatataaactacatgaaattttgtgattttaagtcaatcatgttttctcttcaacatgtgatgaatttcagtattaaatacacttctatgaaagaagcaaaaattctacatacttcataattcactttctaaattttgccttacaatattttattttattcaagtactgtgacacattaaatgaaacattacctgatcaaataaatgctaccaaattcttgtgctatattaattttctgagtttatcactgttctcatgagaaacctgaatttgctctttgttgccctttgtgaccttattctaaggatgtctacaatatggtccaatcaactttttcagtcttctttctctctccttcccatacttaccttattctcctgccacactaacctactctctagaatccaaacattcccagtgcttttctccctccataacttttctccttcataactgaaacacttttctctatcaaaacgcatagaaagaatggtcacccttcaaggaccaaatgccattagggcttttactattccattgagctctaatttgtatgcataaaaaactcattatagtctgccttgggtagagttttaaatgggttgaactctccttttcccactccatcttctggattaaaaattcttgaaagcagaaatttcttgagatttcttgcttttctattttaaacagcatttgggaaaatgctttgcccaaaatagtctatcagcaaaatataatgaaccaatatacattatgagtgaatggcaccaattactttggtgaggccatcccaaaataaaaacaatagttctttatacacttttatgtttaaattaagtgaaggagtaaggtgatgccatcagctctactttgtcttagaagtatacctacattgtctttaaataatgatgacatttagatgagatgggttgagttctcctcagagatatgttatgtctccagtagagttatagtattctccaatccttacctccaatgcgtactcactcccaacaaccactatctaaacttttggagctgctgctcatttatatatattccagaaagaatgaaatgcgtaagtttaaatagagaataaacacataattttaaaaaatgatttacataaataacatctattaaaattagctgctcaataaaatctctactagttgaaataatcatcaaaatagtattgattatactgatattaactattaatatcacaattatttgacttctctcatgttaaaactctattctagaaaataaataagaacattttccttagtatattaaataaacgtaaattttattttatgccttctgcaaatacttctgatattcccttttaagtaatattataaaatttgaggttgtagtagattgtgcctaatgtattcatcagggcttccatgttaagttattttcttagctttggcttcttcacaataaagaaacatgaacaatgtacaacacagaaacgacctctcaggtttgtggataatctgttatagcttgtcagaaaatgcaggggaattttatatttatggcttgaatatccctaaatcaccaaatccatccgctcttacttcctgttaagatgctaattcttgttagaaccctattatgtaactttcatattaaacacatcacagaattaatcctggctcttccttatagaacttaaaagaaaagcaaaggcatgcatagttaatgggcaggaggttagtaaggtttgaggtgtagtaattatcagactgggaaagaggaaaaatgagacatagaataagatataataatattctacttttggaaatcctaatcatgggaaatgtctagaatatatgcccacatatggcaaagtatctcctgtacccgttttttctttctattaatggtcacaaatcatgtttaatgatgcaagctggcatgtaagcctttgtgaaaatatatatatgttattaatctaaataaataaatatcatgggagataattgaaaattattttatgtcctacataataactaaatatcctgtagaaatcaagtaacttttttcacgtttacataaaagtcaggagcatagctagtattaagcctaagtgtaattgtagctccatgattcaactgtaccaccagattggcaaggtaaattctgagtgagaggatgctgtgttgggaaaggggactgattgtgtcctttgagcttttagtttaacaaatatttatttagaaccttatatgtatataccaggcaatgtgctaggtactgtgaactgaagattagttagatagcatttcttggggagcttctattgccctaaacaacaataacaaaaacaaacagtgtaatgcactaagtgatatatgatagagacatgaattttataggcagggaccttatcttgtactcttttttacaccacacaactcctggaattaaacaatttgttgatgtttgcctgttttatagaaatggaactttggcttcacttggggctacctccagtgtattgacataagaatacaactcacaaaaatactgtgatttgtattcagctagaagggctgagcttcccatcaacctctgccaaccaagtttgctagtcttaatacagttagcatttaaacgatttcattatgttgacattttaggtcatgttacaattgttagtaaaattaaaaatccacatgtgatagatggtgttacaagattccagtaaagtctgttaaagtgaattattttatgattattttctgattattccctatttcaaggatacaaagtaattgtaagaaagacagtttcttttcaaaagtgttacaaacttaaaccataacaagagagaaaatcacaacgctaagggattctatggcaaataccacaatgatgacattgaaaaacaaagcaaaaaaatcacttgaaatcacttgctatagtatataactccaaaagaatttgaatttcaaattgaacttcagtctctttagttgagttttatatcagaagaccaaaaactcagatccttataatctgcctcgagttgtacctcccaggaaatttgcctgttctaaggaattaatctgatatttctcttgaatatgttcttttgtcagtaaaaattagttgccattcacattagacacctaaaagatcaaagattggaagctgagaaaacagctcatccatgttattgcttcacttgatctgctgttattctattcattgtatcatttcatgggtgaaatgagagtctccttccaaccaagtcaaatagtgtcaaaattgtaggtgtaattagattgaactcttccccaaatctctaaccatagtgcacccaattgcttcctctagtgaaaactttagtatgacttaactatacgttcctcatgtaatttgttgaatgctgtctatttctctcaaatataattacattactttaaaaacatctttgaattctcctctgaataaatcattgatttagaatttcataggattgcatttatgctcattttaacattaaagaataatttgatcagaattaggtggttggttcttaacttatggtgagcttctttcttgcatcgtctcctacctttggtcttttctgtttatcagtatgtttcatccattgaagggggatctagagtctagtattctgaaatcatggcttcataagtactccaacttccgaacatctaaatctaagaactagcttttaaaatgtgttttaaccaaagtaaatttttaaaaattttacttctagggcttttagaattaaagaaatgctgtccatttaaaaggagtgtggctatttgggttaacatggtcttttgtgatttcaagtctccatataacatatcttacccatctctctagtacttacctcttcacttagattttcactcatattttatagactataattaagacaaaacatatctctagacctccatagacatgtggttttgttttatgcctaatgtaattctatgtgaactatgtagaaatagatgttctggagttaaaagtagtatgacaaatgttttgaacttctcataaatttatcctgaaggcaagcccacaatattaaatcatcatgtgtagaggaagctgtcctgttgattttgaattttttaaatataagaatcatgctgttcaggcaaaagccccaggaaaactgatcaatttaaagatgttttatcttgaaaattctttggaaagcccttttgttttaaggcttttgttcctctaagattagataaatgattttcagaaatctaagatacctcaataaattagtaaatctgttctctttcctttgggtaaatactgctttctccccattttactgatgaagaaattaagatgaagaaaacttacattaatatgaaggtaatatatctaataagtagtaaggaatgtctaaaaaattgatttactaccctctcaaagtccattccaaaattacagagacttttttgcaagagaaaaacaggatttggatacaaacagaattgaatttagatcccagctctgatacttattaactccaaagaagttatgaactgagtttgctcatatgtaaatagagataattaacgcctactgaacaatttccttgtgaagctgaatgtgataaacatatgcaatctgctgaatgcagcttattaaatagcagctgtaatttttttaaactatgctgcttctccataaataggcatatagcctcctccagtgaatctctgaagagggcaattttcatgtgaatataaaggtccaggatacctgtgaacaaagctgtattattttttataatctgacacctttttaaaaagttttattctatttttaattgatatatgcccttttgatatacctgtaagttggtgtcttaaagacagggataaaaaataatggtgtctttagagtaatttagcatgagaagttgattatttcctattttatttctacagttgttctccacatggatgcccaacagtggaaaccaaagaccacttcctctaggctgtaatttttgtccttactggtcttgcatttccagcttggcaccttcccaccattgtcatcacagggtatggtactgaactaaactcagaatatagcaaagcacctaaagatgagccgctagtcagctcagaactataaaaatctcacgccgaaccccaacataccacttacttgttcaatgacacactgctgggtttgaatatggagcaaaccaaggtttaaatacataattttctcttcttcagtcttaggcgtgtatagagaattgctaccccattctctctacctcacttccccaaaagttgggaaagctgaatccatttatgttcattgtttgtcatttcaccaacatcctccatccttataggaaatgtgcagagtttaggcagttaccttagagcactttgtaaagatttttggttggcttctcctttttatgaagccaacaattatgtatctgttttatctcaacattctccagactctaactgttgcagcatcagaatctgtgtagatatcaataccttctggaaatgaaataattcctttgcattctctttccctcatgccttcctcctcttctgtagtcccctttgtttacccaccacttcctgcccacaaagccacccattctgccatcactgccatgccagcttccttataggaatattgccatggtggtcttgatttgtacatagaatcataagagacattctgctctgttttgatatagctgagaaaatgacccctgctcacccctgcagactcaactggcaaggaaacttgaagctgtagcttcagttgcttgtaatgctttttaaatagacctttctcattaaagaactgtacatctttgaacctcatgtgataagtgccctggcctctctttccaagaacacctaggagaatatgacaatgagaaaacaaaacaaacaaacaaacaaaaaaaaaaaaaacaaggtagaggcatcacagaagtcccaggaaccatccagccttcatggctgagaagtcatctttggcagctgccaatcaacattcctgtccagtttttaagctcagagtattttctgctcatctccattcattgatgagagtttatctaacaactactcattttaagtaccagcttattacagggaagcacaaatatatagtgcatggcctcctctagttgtcaagactaaatgagcattgatgaaactgggaaaatagagagatcatgtgtaagtaagtgttgaattttgtgttacagaatgtaagtacctgacaagcttgtaggaaaaaaaatacctaaggaagccattgttggtatggaaagcttcatggaggtgtcagtaattgccagatgggtattgaattagctcttcatggaattaaatatagatgctaagaatttattcagctccttttcctctacaatgagtagtctcaattatatgaccctgtagtaaaagaatgtttacataaactcctaccattttgtagcatcttttgaacactcttcatatctcttcacttggggatgctaaacgtggaagcaggaagtgtgtagagtcactctgactgtaataaaaagaaaagataaagatttctacatctgcatacctatatcaatagtacatgtgaatgtcagttcatgcatacaaaaaccataaattacctttggcattctctcctttatattaaagcccctttcagtggtacttacttttcattatttgaatcagtgcattgatcctttattcatcttttctatttttctcatttctctttatataattcatatcaggctattctctttcacgagagtgttcacaatggcccattttaataaacggacctgtatgcagaaatatttaaagctggaagtcaccttggagaatcaacttctcccactctctcatttcacagctaatgaaatcaaggtcagaatagatgaagtgatttgcctaaggttatggactaaatagaggcatcagaaataggattataagatacagaattttacttttgtcattatgtaaccttattaattgaacatttatttatgtgacaggtactattctaggggctggagaccaaccaaagcccccccaggtacaattctgctcctgatattcacatctctgcagatttcagttagatgtgctcaatgtgactttccgttatagattttggtaaatagttttgtttcttcatgctttgatagtgcccttatcgtcactcagtcccaattaacttccccaagcttctcatttaattaattcccatcctttttttttcaaggtacatactagctctcctgacttagtgccatcctgcctcattgtcatcccccctttctaaaataattattttgagtataatgaaatgttaaacatgattgaacccagtatgtgattattgtaactctggctgccaacagatgttttcgtatttgttgacttgtataataaagtgtcaaaacagaaaaaatgagtagttctttcatccctgccccctttccctttttaaaatctttgttactaaacatttgttctgtcataatgagagcgggcttgtagacttatgcctcttacatggttgtcaatggttagacaacaaaagagaaaaaataggaaaattcttctgccctaaatatgaggtacaatcttttggccttctaccttcatttccaagaaagtccatattctgaaccattaccttccatactgttcctaccagcaaccccacaggtacttctagtggttacctgtaaccatagaacatttctttgtttactctattacttgatgaattctttttctttcactacctaatactctttagtagttatccaggtaaacattattatcttctatagctgtagacacaatcagataatgttgtgcttaatgaacaaaataaaatagccacagtttcatgtaatacagtattgataatgaaaatggcattttatttttgtttaatatttttaaaggatagttgtatggtctttttttggtaatgtttattgctctataattttaagttctcacaaaaagctgcagggatagtacaggttctcatatgccctctaccttgactcactaattatttaccttttgtcatatgtcattttttctctatcttctctctctctgtgaatatatgaatatatatatatatacacacacacatatatatacacatatatatacacacatatatatatacacacatacatatatatatatagttgtccaatacaggcaatttatctttaatataatggtattaatataataccattatctaaatcacaatctatattcaaatttcatctactgtcctaataatgttcttaacagttaattgttttatttcccactggtccaggatccaatctagaatcatgcagtgaatttagttgccatacagtgctttatttttgtgttgaaaagcttacattaacaataatgatctggacagtgtccttttaaaaataatccctgcttactgactgctgttccaataataagaatttaagtcaaaagatatgtaacaaaatcccttaggattagtgatatctgtgctgaggatatctgtgcacatcaaccttgtaactattttctaaccaccagttttggcatttcaatgggagagggtccaagacagaaaactctgagtttattaatattttacagttttgaaatttaaaccttaggactaggattctactgccattctagtccatcatgggttaaagggatagtgtttataagtagccatggaacaaggattcacagtgccctctttaaagccaatcctaaataaatatttagctcagcactatgctaccgaagcctcaaataaaatcaatattctcctcaaaagaaatgcttgatatatttaaaacaaaacctggatgtaaatatgagttgtcattcttgaaagtaagttatctttttaaaaacatacagctatgcacttttaaatgtccaacattaaaatgaatataaatagttgtcttcctccccaaaaatgccgcaaaaattatttgtatatttctgatgcctaaagcatgcagtgttttgcttaattctgtaaatagactatggttaggtctacagggtgtgagcagtttgctttctagcctctgtcgaagcaacaataatccctaaatctcagatatattttctcaatgtcaagcctgtttctaaaactagatacaaaaaaacactaaaaagtcatcagctttaccaactatgaatgtatataatattttgtgaaaaacacacaaccctacctaaacagattaatgttctttaaaagtattgtacaaaaacataaaagtatcaagccttgataagagaaaattatctgagtcagttaataccaattacattactgaaacatcagatagatgatggaaggtgcaaaataatcctttgctatgttcactttctcctctaaaataaagacaaggcatttatacatgcaagaaatagaaattagctaccagaaaaatgctgtgcccatccatattcagagcatagattaagaataaaatagttttttaattgattctaccacattttttatttttttattttttatttatttttatttttttattttttttattatactttaagttttagggtacatgtgcacattgtgcaggttagttacatatgtatacatgtgccatgctggtgcgctgcacccactaactggtcatctagcattaggtatatctcccaatgctatcccttccccctccccccacccaacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgagtaatgccgcaataaacatacgggtgcatgtgtctttatagcagcatgctttatagtcctttgggtatatacccagtaatgggatggctgggtcaaatggtatttctagttccagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggtttcgatttgcatttctctgatggccagtgatgatgagcatttcttcatgtgttttttggcagcataaatgtcttcttttgagaagtgtctgttcatgtccttcacccactttttgatggggttgtttgtttttttcttgtaaatttgtttgagttcattgtagattctggatattagccctttgacagatgagcaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtactgaatggtaatgcctaagttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccctgctgttttggttactgtagccttgtagtgtagtttgaagtcaggtagtgtgatgcctccagctttgttcttttggcttaagattgacttggcaatgcgggctcttttttggttccatatgaactttaaagtagttttttccaattctgtgaagaaagtcattggtagcttgatggggatggcattgaatctgtaaattaccttgggcagtatggccattttcatgatattcattcttcctacccatgagcatggaatgttcttccatttgtttgtatcctcttttatttcattgagcagtggtttgtagttctccttgaagaggtccttcacatcccctgtaagttggattcctaggtattttattctctttgaagcaattgtgaatgggatttcactcatgatttggctctctgtttgtctgttgttggtgtataagaatgcttgtgatttttgtacattgattttgtatcctgagactttgctgaagttgcttatcagcttaaggagattttgggctgagacaatggggttttcttgatacacaatcatgtcgtctgcaaacagggacagtttgacttcttattttcctaattgaataccctttatttccttctcctgcctaattgccctggccagaacttccaacactatgttgaataggagtggtgagacagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcaactattgagataatcatgtggtttttgtctttggttctgtttatatgctggattccatttattgatttgcatatattgaaccagccttgcatcccagtgatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagctcctccttatacctctggtagaattcggctgtgaatccatctggtcctggactctttttggttggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcctgtgggcatttagtgctataaatttccctctacacactgctttgaatgtgtcccagagattctggtatgttgtgtctttgttctcattggtttcaaagaacatctttatttctgccttcattttgttatgtacccagtagtcactcaggagcaggttgtttagtttccatgtagttgagcggttttgaatgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagggttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtgggtcactcaggacttgctttatgaatctgggtcctcctgtattgggtgcatatatatttgggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatatgccagtctgtgtcttttaattggagcatttagtccatttacatttaaagttagtattgttatgtgtgaatttaatcctgtcattatgatgttagctggttcttttgctggttagtcgatgcagtttcttcctagtctccatggtctttacattttggcatgattttgcagcggctggtgccagttgttcctttccatgtttagcacttccttcaggagctcttttagggcgggcctggtggtgacaaaatctctcagcatttgcttgtctgtaaagtattttatttctccttcgcttatgaagtttagtttggctggatatgaaattctgggtcgaaaattgttttctttaagaatgttgaatattggcccccactctcttctggcttgtagggtttctgccgagagatccgctgttagtctgatgggcttccctttgtgggtaacccaacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccatcactttcaggtacaccagtcagacgtagacttggtcttttcacatagtcccatatttcttggaagctttgctcatttctttttattcttttttctctaaacttcccttctcgcttcatttcattcatttcatcttctattgctgataccctttcttccagttgatcgcattggctcctgaggcttctgcattcttcacgtagttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtacgctgccgtgtgaggtgtcagtgtgcccctgctggggggtgcctcccagttaggccgctcgggggtcagggacacacttgaggaggcagtctgcccgttctcagatctgcagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcccgggcaatggcgggcgcccctcccccagcctggctgccgccttgcagtttgatctcagactgctgtgctagcaatcagcgagactacgtgggcgtaggacccgccgagccaggtgcgggatataatctcgtggtgcgccattttttaagccggtcggaaaagcgcagtattcgggagggagtgacccgattttccaggtgcgtctgttacccctttctttgactccgaaagggaactccctgaccccttgcgcttcccaagtgaggcaatgcctcgcccctgtttcggctcgcgcacggtgcgcacacccactgacctgctcccactgtctggcactccctagtgagatgaacccggtacctcagatggaaatgcagaaatcacctgtcttctgcgtcactcacgctgggagctgtagacagcactgttcctattcggccatcttggctcctccctgattctaccaccaagaataaaatagttgtttgtcccctacagtagaacaagtttgcccattcatccttgtgatagatatgcatgcaaaaccaaaatgaaatcaaatccccacagatggctcgtaagtcaaaaacactgtttaattctttcactgcatccctttgggaagcctggcccttggtaagtagtaatgtacaatgtatatagtgtcaactattctcttattttttaatagaatgtctttgtcttatttaacaggtttttttcccatatttcttgtaagaagctctgtgtcactgtttaccttaatgtgtatgtccacagaatcttgctctagtttttgttttaataaaaaagaagtgtccgtatactaaaactatacaaagcatatctaaaattgattatggctctaagtcatgtttttagaggcagtcaggcaaacctaggtgcattttaacattgctcttccaaatggattttactaagaaacagttgagtttcaagcaggaataaaggaaaagcagatcttggagatttaactgttgagcagatgcagtaaatgaggttttggaaataccgctgtcactttagatattttatgctgagttacctatgtgacccaatagctagagctgctgatattaaaatatttttgtaattctgttgaaaatagatgccatgagaactcttaaaaacagagtaacatacttattataagacctattttaaatatttcattctttcctcattttcatgatacctaaattttttgaagactgaaaatgatgagaacttatataaaaaggtacttgtctgtagcatcatggaaattttcatttatgagttgttaacatgtcaaaccaaatcagaaattcctgatatctttattacattaaagcaattcttaatgttgcctcttgagaagggtttaatttttttactctttaaactgaaagtttatcttttttatgcaatgacgtgcaatcatttttctcttaattcctgatgggcttgtaatatatacatatttatttgtgtgtgtatgtacctacatatctattaatatgtatataaacatgtatatttaaatacatgtatgtttatcctatgtactagaatagttagtaggttatatctagatattgattagcttctgaaaataggcaaatatgtataacatattgaggtgtttctaacatcggtgaaaaatataaaacttaaaagtaacatggggctgtacaaggttgatttgtaatagtcatattggtaattgagacagcaccagatatttaattgactaagaatcatgtgatttatttcttaataaatgtaatattctctaatgtctgcctagattagtgttactctaatttcaaattaaaacactatagaaagcataattgacttttcataaaatcagtatataaactatccacagactctcaatctctagctcatcaaacaactttaaaatccaaactatctgtattatatatactaaatatggatatatatgacattatttttattggaatatatagtaaaattttaagtagaaatattaaataataaaattaacatatttatgacaaaaatgattctgaactatgtgtagtcaagtaacctctgtatatattgttttccttttagaaaaacagaataattctgaaagaaagaaaacaaagaaaaacatactccagaattcctaatagaacagtaagtactttaatgacacaatgatgataataaatctgtaaaattagagcttacaaatgtcttttatagaaatactaacttctattttctaagataataaattagtagaggaagcaagttgagccttctctttcaatttactggagtaaactgaaaatcatttgtcctataatcctcttacataagagggcaaagtactcgttgtgatacatttatggggcagaaaacgtttatgatgactccatcatatcttttgactagcatagtatcatcttaaattctaaagaagaaaacagtaataagctagatgtaatcaaagtgcctcattttctccatatgtgataaaaagtttttacttattttgaacaaaattttaaatactattgatgtgcttggtttatttataatcactaaattgggattattaaaaaatggcagctatctgcaggcttaaaatctacaccatattctcattagtacatttgtttctaatctcacaacttaactaaaagtgtatttcctagaaatgtatttccttgctattgtttgatgataatatagttttcctaaatatgttctcactaagcaaagtacatgttgatgtcaatctttatggtaaaattggtgacaatataaaattttcaagatgcaggcaattataaattttgaatatgtgaatatgaagaacaataacataaagatagaaaagcaaaacccatgttgatgacccacgttgtatcacatttaatatttttgaaactgcatttgaaattgcatttcaaactcaatgtttcaaaagtttcaaacaaatattagagtaaaacatagtataataaattaacaaaatgaaacatctatatcttagtacatatcaaactagagtcaagttcaatggaaaaaaatgtaagtttgatatataaaaagtagaaatttctaaataattttataggatatatacaaattattcctgcataataacattttttagccccaaagaactttgatgcataaattacatcttaactttgaatgattgggtataattaatcatcatcacgatgatataaatgaagtttatctgaaatatattttatttatttttgaggtgtgagaaaggcagagaaaacacatttcttttacctgcctgtctgaaggttatgtatgttacaacttcacacaaagcactctgccacttactttttgttgtagttatgaacggccatatattttaaacagaaatctataaaatttataattcaaaatgtttacacttttaaaaactactctttgatttaaaaaattaactctaaatgtatgaaagtctattttgagtattcagagcaggttacgggcatgtttacatagttctgggtacagggataatttaagaatcagatttttctgtcatatataacaatttttgaaacctgcaaatctgcgtgagttacaagatatgaaataagtgagaaatttctttttgacatagaaattttttatcatcttaataccctaacatagacaatgaaatcattcagccaaaacaaacctttttcaacatctaaaagactagactgtcttaaagttttgtttttatatatataattctgtttctaaacataatttcaattctgtacaatactcattggaaaatggttgaattttttaaactgacaggactgacataagctctttatgcaagaaccaagtgatatctacttcactccctcacaatttctcggccctctgagtataatttcatgtgaaaagccatcaatgactccttttctgcgctgatttatgtataagttatttgatctattgttcaggtgtgacctatataagttatttgactggaactgtaattttcataattgtattgaaataggatttagcctagcatacctcggagacatctcattcaagtaatgagatctcctgttcatttgcagtaatcttagaaaaaaataacatacatgtttccaaagaagaaattatgcctcttttcatgcatttttatgtggtttggagcaggttttaatctcagattttaattacctattatttaataattatatgctaaatcactcataaattacatgcaaaaaaagactcttcttattatactgtaataaaaagtataatttatcctttaaaaattttatcagatattgtgaagaggaatactctgacttaaatgacattgtcaaaacataagagttcttaaaatatcttagccactaaaggctcgtgagttagtgttagacaatacatggaataaaacatgatatcagatgaatataatagataatacagtgacattttatctatagattgtgcatgtgtttctagcccatgaatgagttttatgaattgtattggaatcaaaactttataaatgaaagctttttagcacaggaaagctctacaaacctcttacaattttgcttttaaatccatagcttaagaacaagttgataattgattaaaatattactataatattgctaaagacgcttagagcacattgcatttattgcttacaaaaggtttttgtgcttaagaaatataaaagataaaaatataagatgctttcttataagaatagaaaaataaaagaccactggaaagtgtattctaaaatacagttgactcttgatcaccaactcccacacagtcctaaaattccatggttaacttttaactcctccaaaacttaactactaatagcctactgttgactggatgttatcaataacataaatagttgattaattcttatttttcatgttatgtgtattatatactcttcttaacaataaagtaggaaaagtgaagaaaatattactaagaaaattgtaaggaagagaaaatgtatttactattcattaagtggaagtggatcatcataaaggtctccatcctcatcttcacattaactaggctgaggaggagaaggaagaggaggggttggttggttttactgtctcagcagtggcagaggcagaagaaaacctgtgaataagtggacctgcatagttcaaacccgtgttgttcaagtgtcaactatagtcatctttcttttgattgctgaagctcagtaatactttcaagaacttcatagtctcctccttgtaaactctgatcacactggatactaataataaagagggtgtgtttaaaaaatcattcagatgctcagacatccgtgttagaaactcttcatattatcctagatttcctaagcctctttaataaaactgggagttgatacactcactcaaagtgtgacaactattaacaacactgctttcctgaaaaaacaaatatagcaagaagtttttagtaagagtgattctaatggaaggcagattttaaccaataaaacatcttgtggctcattagagaataaatattatttgcaaatatcccaaatgttacctgcaaatgctcctgacaagttttacttagtcaatatttccctattagaagtaataaagtcctgcaataaaaaagcataagcctgtgagtgtgtgtaatagtggcataaagctaggagaaaatttagaggtcacctattctaatattttcattttatagaggttacctcctctaatattatcatttatatatggcctgataggtcaagtcatttgcctaagctcttatatctagtgatagaattgaaaaaaaaatctgtgctaattaaccacccaccatttttttctatctgccatattaactgaaagtgctgttattaaaaaatgcatgtgtcggaactgttaaaaaaaaactcttctccaaatttaatcttttttcaaccaaaacactagtgaaaatttatgtaaattattgtttgtctaatctctagtagtttaaaattgtattttgatatagtttattagaatgatgtttataaaagttatatatctccacagtataacctttataaataaatatatatatacatatatatgtatctccactatgtatgtataaagagagctcatttatataggtatttatttatttatatttatatatatctctactatatatgtataaagagagaggtaatctgagtcttggcttaatccatctccacctaatatttattaatgataagtagtaaagaaaaataacatatgcacattaagttttcatgtgcagcgaatccataggaaaatgtgaggacattcaagattacacagtgaaaaaacaactagataataataatatgtaataataatacataaaagcaatctgccatcagcaacacttaagcagttatctcaatgagtctcccttttctcatctgggtaatgaaaaatgtctacccagcatacttcccaagattctctgagattggattaagtatatgaagatctctatagtgatatttaatttaaaattcttatatatattatcctttccccattgcttgtttttgtcaggtttgtcaaagatcagatagctgtagatatgcggcattatttctgagggctctgttctgttccattggtctatatctttgttttggtaccagtaccctgctgtttcagttactgtagccttgtagtatagtttgaagtcaggtagcgtgatgcctccagctttgttcttttggcttaggattgacttggcaatgcaggctcttttttggttccatatgaactttaaaatagttttttccaattctgtgaagaaagtcattggtagcttgatggggatggcattgaatctataaattaccttgggcagtatggccattttcacaatattgattcttcctacccacgagcatggaatgctcttccatttgtttgtatcctcttttatttcattgagcagtggtttgtagttctccttgaaggggtccttcacatcccttgtaagttggattccctatttaataaatggtgctgggaaaactggctagccatatgtagaaagctgaaatgggatcccttccttacaccttatacaaaaattaattcaagatggattaaagacttacatgttagacctaaaaccataaaaaccctagaagaaaacctagacgataccattcaggacatatgcatgggcaaggacttcatgtctaaaacaccaaaagcaatggcaacaaaagccaaaattgataaatgggatctaattaaactaaagagcttctgcacagcaaaagaaactaccatcagagtgaataggcagcctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacgcttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttctacactgttggtgggactgtaaactagttcaacccttatggaagtcagtgtggtgattcctcagggatctagaactagaaataccatttgacccagcaacaccattactgggtatacacccaaaggattataaatcatgctgctataaagacatgtgcacatgtatgtttattgcggcactattcacaatagcaaagacttggaaccaacccaaatgtccaacaatgatagactggattaagaaaatgtggcacacatacaccatggaatactatgcagccataaaaaatgatgagttcatgtcctttgtagggacatagatgaagctggaaaccatcattctcagcaaactatcgcaaggataaaaaaccaaataccgcatgttctcactcataggtgggaattgaacaatgagaacacatggacacaggagggtgaacatcacacaccgaggactgttgtggggtggggggagcagggagggatagcgttaggagatatacctaatgctaaatgacgagttaatgggtgcagcacaccaacacggcacatgtatacatatgtaacaaacctgcacattgtgcacacgcaccccaaaacttaaagtacaataataataaaatttaaaaaaattcttatatatattatataaattcttatgtataaaataatgcatattaactttaattaaaattattttataatattgacaattatttaaaatatatatcaccaataaaatatattgatttttaattaaaaataattaaaatttatatataaataaacaacacttatttttaaacaaacaataagtattattacataaaacttagactatattattgtaaaaataagttgtttttgtgaacatttgccttaattgtttttggagtaccatgcatcattttatgaaggcatgtttctgaaacaaccaaagttgttggttgatttttgctttaggcaataatgatcatccagaaaaaaaattctctttttcttgaatttataatttatctttaatcctgatctgtgttcccacacataagcctaagagagttcatatatagaaggaagggagttgggaaaggaaaggaagcatttattgggctcttgttttgtgtcagctgtttagtaggcattgaactaaatttcatttaattattcaaagaattcttctgatgttatagtggttttgcagatgatgaaaatgtggattgaaaggtttataaggttagcttacttagtatgcagcagagttgccatttaaactcaggtctgtctgatttctccttttcaagttaggactcaactaaacggggacaactagtgaaagtaaggcatatttcaccttcctatatgaatgtctatgcaaaatacttaatgtgcacacgttacttttcttttctacttatcatcaataaatattagattgcatcatgcatatttgtccttcagatgctaaaaataaaccatggtaggagaatttaattattaaagacagcaatcttttgataggaaaagtagaacccaaatcaaaatggattatagccataagtataaacattcacctaaaggagaaaaacaatatttattttgtttgtaaataacaatacagtggacattcaccatatatacttagatttttatacatgctacattatctggacttattttctttaaaaactttggtacaactttggaaattcattcctttatccttcattctttattcaacagctgctattgattacccactgtatacatagttccaggtgttttagatataggaataaataaagtatagtctctgtcatcaagtagtttatatttttagtaattacaaatatagaaaagtttgcttcataaggagaataaaagttatattgactataagtcatagattttcttttcaagctactcgtctgtttaaccatgatcagattaaattatgtttttatttgtcaaatgattcagtgttttgtcactttccctggaaattgagtaaaatgggtttcccacaatcattattattcatgataaatctaaaccatatttcatgatttacagtattttttgatacactaacaaaggagtcttttataatcttattatagcatagtactggctttgaaaattctctatattcaaatgccagctccaccacttattaactatgggatgtaggacaattttttagacctctgtgagttttgatttctccattgagtaattgtgatattcaaatgagtcaaatataggcaatgtctttgtttatataagtgtcttgttgattgtagttactgtattcaagttagctattataattagttgatagaattcagttcattgtttctaaaacttcttattaatctttgatttgtaagctctcattgatattagtctttattttattctgaaaaacattatctttcatgactctgatatgtaagttgtctagtcaaaagagataaagtggaaattatttaaccagcatttacagttttaaagaaatcatgtaaagtccaaagttaataagactttaaatcaaatgatttagctatatgaattattagttttgatctgctataacattatgatttatttacttggctacaccagggttttgccttgggttgcattattctcctttgtaattaagaatgtttgcactggataaaaaactgtattcaagtgctatttctgccacttactacctgtgtgtcagcaggaaaacaaaataagctgcctcaatgtcctcttctataaaaatgaaaatgaatcctattttatacgtttcatatgagaataatgacatgtttattaactgcttattacagaaattaatatagtaacataagtaaaaattattgttgttatatttgttatttaaaacatcttagtaatatcaaaggggcattcttttctttcaaatttatttatttattataaattgacatcttttaaattataaaacatagtcatgtaccacctaacaaatttcagtcaatgatggactgcatatatagcagtgacaccttaagattataatatcagatttttactgtaccttttctgttaagatgcacagatacttaccaatgtgttataattgcctacagtattcagtacagtgacatgtacaggtttgtagcccaagaacaaaaggctaaaccatacagcctaggtgtgaggtagactgtaccatctaggttagtataagtacatgctatgctgttcagcaacaacaaaattgcctaatgatgcatttctcaggatgtacccctgttgttgagtgattcataactgtatatagaagtctagatggaataaagaggaagggaaagtgtgagggaagaaagaaaaggagaaaagtctggttggaaatctttaacacaagatgaaatttcgatttgatagagtaggatgcaggcttgctttgggaggagtccatcaggagccctctccttgaaggcctcttccttcttaaagcaaacacagaaattagacaatctcaatagcatgactcacttccagaaaggtggagagtaaagcttgagacattttgacagtcttcgtggccctagaagtaggctgaatcagtatgcatcacgatgtgaagggtagcaaaaatgctttctatcttatcatgaaattattttctttgtaataacaaaggggaccacttcctccagagaaaatagacctaaccaaactctagactgaacagatgtccagaaataaattacatcccacacattgttattacatgcaccattttaaagttaagggcagtatgatgccattacatggcaactctcattttaaaaaataataaaattttgtatgtgatgtctgaaattgaaatcacagcattattcttttaccaaagaaatctcagttgacaaagttgcttattttgctgcatttttccctcatgatacagaatactgtttctcctcattttaaaacctcaattaattatcttcaaatgaaaattttcatattcaccattttaagtggttttgttgtttgagtcattcttttgcaaacaccataaaaatccctttacagtctgacatgggctatcaatcctaacaccacttctcctttcaatgtaaaatcttgttatgcctctaaagatgagtatatcccagtcttagtaataactattcctgtttcagcagaaagtaattcataataagtatcttagcattttcctcctttccttggaattgaatcattacaaatactgacaattttatttcttttctattctgaaagatgaaaaatctggttcagcatatgctccattgtacatttgagcaatctatatcctctgttcttatggttaatatgaattgcttaatcctgtgattgtttttgttttccattttcaaaggaatcctggcaaagcctatgttcatgaatttgtacaaaatgtttcagactaaggaaaatgtctctaaacaaaagctcaaaatacattggtttctaactcatatgaccccccccaaatgatattatacaatttttcaatagtctgaaatatattataagaaataattcttagcagtagttttgcaagttgctcaggatttttgcttatccattttatatttgcatgtggcattgacacaatttgctataacatctcctaggaagtaatatattttttttaggcatttactatttgagctgtgaaggttagtcttagatgttctttctcttttgtactttaaaattttttttctaattttgcacaaggtaaaaatgtttttaataccctctatgtcttagactcaccatgcaggggtgtccaagggagagagtacagtcatgggttcttagtttctgtttctggttgggccagtaaaaccccttcctcatccctccttcctgcttacaattagacacagaaaccaaaaattatggcttcaggctgctaaaagcctgaaacaaaacaaaataaaaacaacaacaacaaaataaggcaggttggacaagctcatgagcattacatatgtcacaacctttataataaataccattttattacagaatgcaacaaaataattatttgaattatgcctagtaacataattccagaaagaaatgggtttggacaattgtatatttatggatatatccattgttcccattttaagaagtgaacaattattagtgtgtttttttgaaaggcaaagccagatttgtcattaaatgagacagctaaaagaatggaagcaatacaagcagtccccaacttatgaatgagttatataacaaaattccttttaagatgttttctttccattttataagatggatatttatcgacagtggccacacaaaaaaacctgtgaaaacccacagcttatgctaaatgacaatatttttagcattggttatggtgactgtgtgagtgagagggacacaaggaaaaacatgtttctccatttttcctgatactcagttgaccctgcccaatatgtgaaaaataactaaagccagcttttcacacagccttctctctctttgtcacctttgttttcttcctgaggtaatgctgtttcccaactgatattctctagctgccttttctttaaagtggttttggtttccaattttctaacccaacttatctcttgatcaaaatgactcagtacagctggtatggggaaatgtctaagaaaaaataattgggccaaagtgtccacaccagccctgcatcttgcatcccctctgcttctcacttcccgacccccacaccacaattgttaatttaaataaacaaataacttaaggaatttctggcagtgtggggtcctggagtgatacatgtatagatagtatgggtgaagatatttggagacaggaactgggataggtgggaattcagccttaaatgcagcatcccctgcactgctcttgaagtgatacattttcttcaatactatacttaggagcctatagtttctttattttaatacatacacattttcccagtgggtcttgcaaagcttgtgatagaagatttgttaatgaggtatgtattagtctgttctcacactgctaataaagacatacccaagactgggtaatttataaaggaaagaggtttaattgactcacagttccacatagctggggaggcctcacaatcatgccagaaggtgaatgggggtcaaaggcacatcttacatggcagcaggcaagggagcacgtgcagaggaactcctttttataaaaccatcagatctcatgagacttattcactgtcacgagaacagcatgggaaagacgcccccataattcaatgacctcccattgggtctctcccacaacaggtgggaattatgggagctacaattcaagatgaaatttgggtggggacacaaccaaaccatatcaagatgtaataagctagagataactgcttcattttttctaaaatgtaaaagtaaatgtaaaatacatgattatataatattgtttacctatattttaattttaattcttttcaatacctcaaatgtaaaaccatccactcataaagtaaattttaagagttacctctatatgaaagaaatcgttatttgtgttagttataacattccttatacctggccacccaaaacaagaaaataatcaagttttcaattttcaatttttttatcataactctggatataaatataactaaaatgttttcagtaataactccatgcacaatgatcaaacaaatgctgtacttgttgtgggctggcatcaacaattatgaaagtggcttggtaaggccaggccagacctttgtaaccagttataccaggctactgttagacagccccagatagcccatccctctgcctcagggcttatggaaacagtggatgttggtaactgaacacttactccctgctgcatgcttcccatgtcatttcattcctgtgaagtgcattttcatatctatatttcataaatgaggagacagattctgaaaggcaaaccaacttgctcaaaataactagcttatatattttgagccagatgcagactaaagtctgtgtaatgctaaaacctgtgctcctagacattatgcaaactgtttcatgggcttacactgaaataatatctgatgaatttctctttgcataagagagtgagctccacaagtgtggtaggcagagcatcctcctatctcagaacctgacacagcgaaggtgctcaatgctggttgaaccaaagtgacaacttgtttatccagctctatcatagcagtaactttactaaaagttctctgttcccttactttttttcagaaaagttatccacgtccccaaacaaaacctacgtccctgtaacaaaaagcttttattttcaagagctgtatctttagccatttttttaattgtggtaaaatatatataacatcaaatttaccattttaaccatttgaaagtatacagctcagtggtattaagtacattcacactgttgtttgatcatcagcatcagccaccctcagaattttttcatcttcccaaagtgaaactccgtacatattaaacagcaactccccattccccctccctgcagcccctggccatcactattttaccttcagtcttgatgaaactgactattctaactacgtcatataagtggaattaaacagtatttttccttttgtaactaggttattttgtatattgtcaaggtttatccttattgtagcatgtgtcaaaattttcttcctaaggctgaataatattccattgtatgtatatatcacattttgtttatccatttatctgatgatttattgagtaatggagttgtccaaaatgaaatctttttgccaattctttgatggaaagataagatgcaaatatagaaatgcaatgagttcatgatttttagaacatctctctttttatatcataagccctaaaattaatcatggaaaactagttcagtttaggcaatcagcaaaaaaaaatagatgggcttaagataatttaggatttatgagttataaatatgccacattttaactactcaggctggaattagcctgtcttcatttgattatctgttttgatacattgactgttcttcagaagattcgtgaagttagggtatttaaaaattgccatttctctaaaattaaatagaataatagggaagggagcattgattctaaataagaatgcaaatttatagccatcaagttttctactactaccatttaacttctaatcagcgtattatggaatattcttgttcaagaattggtgtctgaaccttaagtcaataagaaggaaataatctatacagtttttagtattttcagcagttttccttatgtgctaaccaataattttttagctggcatttatcaatgccagagacacgctcatatacacatattatatatcctataatacacagcattatcctctaatcctcacactgaaaagtagacatcatcaccattttacaaatgaggaaggagaggatcagaaaggttaagtgactttctcagttaataactggcagagttggcatttgagaacaggacttctagatacaaggctgctgctctgtcacctcacacttcccctacatgttgtgaatggtgctgggccacaaaaatgaatgggacagtctccaccctggaaaaatttatattatactggaatggatgggcatttttaactaattaaaatataatagtatgaagattagaagttctttggatgccagcaggtagacatagcttaacagtgcctgaaaagctttgcaaaggaaagggcattccatcttggccttacatgacttccttccatgctggttttccattttaattagtaaagaatttagttaagcacatgggatgattggttaaagttgaagctgtaatgagatcatgaaggttaaattaaagtgtttgaagtttatctcttagcagtggaaaacaaatgtttttatgttttcattcttgctacttttttctgcttaatctaccattctgtagaagccttagtaatagaacaagcgaaggagaagaaaaagataatttttttaaaaaagaatccttttatgagcttatgctagcttattttaatgttcttgcattataggcatgattaaagattttaagtgtatgactttgcattttgatcagagttatcatctccctcaaggctgctcaataacatgatccataatgacattttgttgttattttctgacctgttgggtgaggcactaaagccagcttccctaggtctatgtagctttaagttattgcagtgaggaaatttcacagtgctgtcatgcttttggttaatacagttttgtgttttgcttgggaaagacaattctgagagtgtcctattgattcagatgttttctgacagtagctgcctaccaggtttgccttcattgacttttcaatgttctgttacaaataacttgcatgtacaatttgatattgaaaagcctagaaggttccccactgtgcatgaagttagagcagccctgagccatggggtggtgagtgcttattatcattctgaaaatcatccacttgtcctaggctgttgccataaaagggttgtgttttctctgttattcttttttgttctcctgcttcttttattctttcagacattccaatgcacttcttattctttaaaagtttaaacttcattcttaaaaattccccatggtgactgaaacttgaaatataaagtcacaggtgttttctgatatttttgaacacacggaatgtgagatggcttggattggaagtacttattttgttagtacaatttaaaagaatcacttctgtgagattttcctaaaatgatgaatggttagaaatgttcttttataatcataataaaaataactaccatttatcgaatgcctaccatctgccaagatctgtgcttagcaactttcatgctatctataatattgacaactctgtaaggtaggtatcattaaaccatttacagataaagaaacaaagactctgagaagttaagtgacttgtccaagacaagaatgattacttctatctttctaattgtggttgacttctacttattaaaaatgatggtaatatcatttgggtttgcagagcacgtcacggtttacatagcagtttcacatatgccacctcctttaacctcacaaaactgataactatattttgcatttcaccttaatctttgtgagaccatcttgaggctttagatcagaaatggggtatgaatttccttgtgctgaaatatgaccctttgttaagttagcatcatttgcaaaaatgtcttcttttctaccattactagtttatgcttctattttatcaggggagaaggcagctggagaacttgtctgttgatgcccttgaagagtttgtgggattatgtttacccagaaaatagttgcctgtagcaaaagcataataatgtttttgagacccagctgctctgcccctgaaaactatgtaggaaatacttacatagctgctatttcctgctctctcctcccaggatcccagcccgtggcatctctgcctttcaaagacattccactgtgcagtctgtccctatgtctgcttgtaaaccaaagcataatgttcatttacacataagtggaggagggggaaggagaaccttatagaattacaaataagataatattataatgggtaataagtacatttctgccttatcaccagtatttccaaaacccaatggcatcaaattctctgaaataatttagggctctgaaatgggaattgggtaaagaaaataagtaaaaaagttgttggattcaatagggaaaaataataaaacaaatacagtaacaggtacactaccctcctctatcccccttgggaacaccaaagcaaacccactcacccttccaaaaagtatcatttctttcaaatatcagagctttgacccaggagtctgacctcacttttcctgacctaactcctcctaggcgagattggtttctccctctcttctgtattctcaaagcacctaggacatgcctctgcttcagtatccatcttctctactggacatgagcaaaatgagccccctccttatccctaccattccggagaacagtccatcacttggagcataaagcttagtgcacaagtagatgaatctattcagccatgcaacagtaccagaccttctgttagtgctgtgtgctacactcagagaatgtttaaagaaatgaggaatgaagaaagggagtgaagaagacagggaatgtaggaatgagagagacagggaagaaaagactgaaggagaaaggaaagagggagtaaggaaggaaggaaagaagaaagcctggcccaagatgtgaataagagtgtaatgatttcacttatcacatagtatttcacataatatctattgtttactttcagcaaagaaatttattttgagaatatgaatatttcagaggaataattcacagtggagatggggtagatagttttgtagaagactagaaatcagtttctaaatgtttctctttccactaatttcaaagtctatttttcttattactaaaatatttccacttttatatatgtgaagataaaacttttgcttactccttagctaatgaattttataaacaaactcttttatatgtttttataatataatatgtgaaatgagaagactaagggattttacctaccacctacatattaccatattaagatattcctgaataaagtaaaccccaccataaatgtgtgtgtgttggggggtatgatttttctttttggtctatgaaacagattatgctaatttacaccagcacttccaataacaactaactattctgcaccccaaacacacacacacacacatacacacacaacacaccccatctactcttctctctcctgctccagtactctgtagcattagtttagtttctcttattccctcagccccactctttagacaaaaaaatagagagaaagaaagaaagaaagaaagaaagaaagaaagaaagaaagaaagaaagaaagaaagaaagaaagaaagaaaaggaaacctttccttctcatttctagggctctaagggtttgcacgctgccactctaccattcttcacacattccaattagaaacttaagggaggccagcgtagtggcttgtgcctgtgatcccagcactttgggaggctgaggtgggtgaatcgcttcagcccaggagtttgagatcagcctgggcaacatggtgaaaacccgtcttcacaaaaataaaaacaaacaacaacaaaaatagccggcattatagcacacacctgtagtcccagatactagggaagctgaagtgggagggtcgcttgagtccgggaggtgaaggatataggctgcagtgagcctttagtgtgccactgcattccagcctgggcgactgagcgagactctgtcccaaaagagaggagtggaggggaggggaggagaggggcacaaaggtgccatgcatatcagaggatgctttcttgtctgcttatctcaaatctggccatacatttgaatatcaaataaagctgatattctcattttcttcctctctactgaaaaataatctatcccagtaacaacagttagcagtcactgcaggcaagatgataaagaggaaaataaaaaaatcttgaggaaaaaaaaagtcaaggatgattttgaatatttattatattatcttgaaacccatcataatcacttcacaaattcttaatgaaatctgaccaaaatgtgctcccactatttgttgagatctataggaaagtcaaaatgatacaatttctcattttatcattattttttgtgcacttatgcgcacagaagatactgtgtgaattggtttgaagttttccttcttttcactatcttatagcttaattggtaatgagcagcaaattttaaaagattaaaaattacgggggggaagggaagaggaaagttagtgccctagatagagtgaaaaaaattacaaaagaacaaagtaattattcacaagatgggaaaaagatataaatgaattgaattatgagtcagacagaaaagaccacacacatatatacccacatgcatgaacatacacaaacacaaatacacatgcacacacaaaaagacatgcacacacagtctacactacacacatatcatccacccacacaaatgcagagaccacacatttgacacatgctcacaaacacacttatccaaacatggcaaaattatgctcccaatttaattagcaaagaatacattttaccagaagcagggtaaacaccacataggatagtagcatatatcagagtagcttcccttgatccccagagtccttgtgggggctcacagctgcctatgaactggacatataagcaaacctataaacctgaattctttctgcaacaccgaacttttataagccagaggtacaggatgacttcagaaaatcttaaacttacaatttttatgcctctgattaacattaagcatcacatctcttggtttgaaaaaaaaaattaaaaaaaaaaacaactcagtgacatggaggccatatcatcatctggggagagagagcagagtcagtgagcagaagctatgagcaaaatggcattaccttgcagtaaatattgtgaattatacttaatctaatattcaatttacaaatggggataattaataattagtgcctaattagaaataaatgaaataatattggtaacatagctaatacaatgcctggcacatcaaagatgcttaaaaaaacagaaatggggaaaggtgagacagattttcacttccttgttataactgatgattatccagttgcttttggtctagttggttccccttgcataatccattagcttaaactaattgcattttccaacttgatctccatttagtgtcctaacatgtattaatatgggctactgaatctgcattcatatgtctctgagacctgaataaaaccttaaaattttcagggataggttggaaatacacattacatgaatgttactatacattgccttgatgcagtgttactataattgcctccacgcagtgtgctttgggatcatagatcaaaatgatgggaaaaccttcctgccacaacaagccagttggcttgtcccactgtgagattctcccccagcttacaaaatagacatgctttttcaaaagtgtttcttttaatttgttgaaatgtcaagaagagcctaatgttatagattttggtgaaaggtagttttcccttatcaaaatcatatagctcatacctatctatttttttcaaatgtccattgtacaaaaatacagtctttatgggtatttaactcctacagttgactttaagttctgctctctatattgagcagaaaaatagtcatggaactgtggaattggaatttgaaggtatgtatatcaatgccatttaaatattaaaagtagtaggaaactatatctatataaatatagtcattttctagagtcagttagtttcaagaggcttttctttttttaacatttaagatgctttacttggagttccttagagaaaaatttcttcaaatgctaagataatataaaaaccatagctttccaaaaacttttacattaactttgaaacaagtaactaatgcaagtgaggccaagcaattagtttgtaaggagaccttgtaatgcagaggtgtaggggattccaggtaaaacatcaataccaactgtacttttttgctgtgtggtgtagaaaggcagatgagagaagtcgggatatggacacaggtcctggactttaaagattcacttaaatttccccacttctttatcctggcatacatcctcccctaggatcaagctgccatgggctagaaataaagactcagaatatatttgttcaagaccaacagatcaagtagaaattgttgtagaacatatatgtgctgctgcgtttcagggttgaatataatcatttggcaatatcacctctacatttttatttccacgaagacacacccatgagacaagccttaaagaaggtgacagcaatagatattatttccagagctcctaccatgctttggattacaatcttatcaatttgggttgaagttgcaaaaaattcaggccaaaaatgaactttgagtagtttatgaaacccaaacacacttgtcaaacctaaccatgcaaaacagcacaaattaagtcaactttcaatctggttttgtgccaaatggaatgaagcctctggtgggctagacagctctatttcctgctttcaattttggagattccaattagtaaattaaactttaaaaagctgtctaaaataattaattaggtcataattattcagaagcatattttatagtgtactctaatctagtgtctagtctaaatacttgaaaacggtatcaatttcattattaaagaattaattataattgggcctaatcctttgctgatgaacgttgaaaaaatactctggggataaactgttcacatatgcgaagtggataaattctttcagagctcaagaataatagttatgctctggaagtgttttctgcttatattaattcctttgttaaaattcttacagatatcacccaacaaataaaagtttcataggaaaaagagccctctgtttaaatgagtttatcacatatggacaactgattttcctcctactctattccaaacattttccataatcagtacattggtacagaaaagagaaaagaaacagggagaagtaacctgccgggcatggtagctcatgcctgtaatcccagcactttgggaggccgagccaggagaattgtttgaactcaggagttcatgagcagcctggacaacatcatgagatccatgtgggaaaaattttgatatttctttaacttccttctcatttcttcctaatgtccttttatgatctagcaaatcaaatttaaaaactcaacatatcataaataatgataccagagatcagtatagcttacctgtttccatctatgtcagagagaagaaataaatatagaccatttcaatactcttcctgcatatacaggccaaatagaattataaagccaaagctctagagttcaataaaggaaaggcagttaatgattatagttttatgggtaaattgttgtagtgaattaatgtgtttttcagaagagagagaacaggaatggcaggtgttcatctataaatggtgatgaacaatgtgaaaccaagaccacaggtaatatttctggtaaggatttcacaagagtgtaaaccacagcagctaaaaacaaaacttaaatccataagtagacaagttaatcagaaacatattttatgcactgtttcttctataattttaggcttcacaaaatacattacatacataactaaggccataatgctgacttaagctcttatttaaatgtatttgttgaaaatattcacagactttttcagaacatatgttctttttatatttgtctatacatgtttctattttttttcaattgtgtttggatgttgagactctaagtgatttttctattttatttatggatattataatattaattttaatactaattcaaaattttaaaaatataaaaaggaatctaaaaatccctgtaatgtagaaagatggctactaactatgacttacatgtgacttgacattgatagaaaaatactcgtgtgtttacaaatgaacacataataagtatgaaataaggatatagtcagatgttaaaatccctttctggatctcagtcctcttggcaaacataactgttgtgttactctttttattttaatgggagtaaagtgtttgggtgaaagaataatttttacttttatgtttccaaaaatacaaatactgctgttttgagatgcaaaatggaaaaattgaatagaatagaattaagtctcattgtccaacagaatcaataaataataaatgagaaaaataaagagatgctcaaatataaccttgaacataatgctttgcagggttataagagtgttcaaatgcctttcattttcatcctttcaaatttttcaaaagctaattaaggtgtcataggtaaataataatgcttctattataaccaaagcctattctttgaaggcggtttatcaagcatttctgctagtttatataaccgtagtggatctaccaatacacccaatgagtggcatacaaactgatcaagatagacccaggaatctagatacatgtccatcagtgtgagaatagcatttgccaagtcaacatttttgcctccaaaatgctttatagacctcaagaaattctaacaacactcttgagagaacatttgctcttattaacaatttctagtgagaaattaatggctaattaatttgcccaaggacaaagaaagtcagattatggttttcaggctcatttttttttagtctaattgattattagcgttgcattatctctttttttaaccttgaaggtctttttgttttcttaaaaatgcagcattctttgctattgtgaatccatgttgtggctatacttgtatttgaggttacacttctattctaagttcctatttccaacaccaattttttaggcgtttttctcttcttttttttctttttctaaagttttactttattctgcaaagctaaactagaaagatgtactaaagattgtttggcactgggtacacttgaacataaacacgggaacaacagatactggggattactgaagaggaaagacagcgacaggggcaaggctgaacaactacctattgggtactatgcttactacctgagtgacagatcatttattctcgaaacctcaatatcatgcagtatacttttgtaacaaacctgcatgggtgccctctgaatctgaaataaaagttgaaaggaaaaaaaagaaagaaaattgtttggttttgtttcaattagccaaaatttgagataagtaatagctgcaagtagtaaaaaatagtctacgctgtgtgtacataagagtagataactcaaacctcggttcccctctaaacacaaactctaaataaaggaagagggttctgcccttcaaaagtgaagatatatagacaaaagaaacaaatatcttgaaatgctgagcctcatccttttcaaaaaatacttaaataactagaaaaacaaaataaaaatagaattcagggtgtgtgtttgagagcaacagatccttcttcagtatattattggctggaagtgtacagaaatctttgtaaattttatttaaaaataatttattggctaattcaagattttatttactactttctatgccagacactattatgagttctgaagttacaataacaaatgatatggactttgtccttaaaaagctcacagtctaagagagtgggggaacccaaatataataaatctgtgctaaaagagtacaaggaaagaagtaattattaatacttctgtggacaataaacactactatagatcagaaaactgtatcccaaagcctaaatgtggttaaatgcctactatatttgtttgctaccataacaaaccaccaatttgcataacctcaacaaaagaaatttattctctcacagttctgaagactagaaatccaaactcaagatgtcagtcaggcagtgcttcctctgaactcctttagggaaggctccttccttgcttcttccagcttctggtagccccaggcacttcttaactgtggcaacataactctaattgctgcctctgtcttcacatggctgtcttccctcattgtctttgtctcttctgttcatttaagaacaccagttatgttggacttaaggcctaccctactcaagaatgacttcaccttaattacatctgcaaagaccctatttccacataaagtcatattcatagataccggggattaggacttcaacatatctttttaagaggcacaattcaacacaaaacacttactcagctaggtgctcattaaaacactggatttctgccattctgaatttaaaaggtaatgatttaattaaaacatcagagaataaaatgacatattgttttacagtttacagttctatatataggcatatatatacacagctgtcattatttcattgttatctgtagaatttcttattctgtctttaaatataaaaaggattatcttctatgaacaataaaaaagataaactaaatttaattaccaattaaagatggggtaaaaaagagcaacaacactctaaaacagaataatcatggatattgtgtaacctctctctttcgtagtttgttcatactgggagactaatgaaatagaatgataaaatcttgtccagagatgaggaggagtattaaatgacatcctgttcatttaatgtgaatataataaacttcaaagtcaaaaatgtgactataataaagtttgaaatttttgaaaatatgacacataagcataaatacgtacataagattaacacattttatctataagttatttaaatttatatacatatccaacctgaaaattgtttaatatttgagttttttatagtgtctaagaatgcgtaaatggtatgcaaaaatattttcaattttttgcttaccatagttgaatgttacaaacttactgtatccagcaaattccaaactatatgctagaacttgcagagaaaacaaaatgttttccatgacagcaagagactctatttaatcattatattaagagatttaaacaagatgagaattaaggatgggatggatattccagagaaatggaacgattaattcattcaatttatatatgttgagtttctgctctataccaggcaccggtcaaggtattgggaacacagcaatgaacacaatgttccaagtctctgccctcaaataggttaacctcaagtagcttaaattctaggtgaaggagtaaggggaaggaagggaaacgggatgaataatagataaacaacaaataaatttttagtacaagtatgttccatgaaatatttgggacacttaaataattaaacaatgaataagttgtcagaataggtaatgacaaggacaagtaataatatttttcatatgtctgatgcaatagttagaacataattattcttttttttaaaaaaagacaaggtctcactctgttgccatgctggggtgtagtggtgccataatagctcactgcagccttgaactcctagactcaagccatcttcccacctcagcctccctagtagctgggactatgggtgcatgccaccatgcctggataggatataattaactaaaaagttttttgttgcttgtctgaagttcaaatttaactgggtgccctgtattttcatttgctccatcaaaccatcttaacaggaggagatagcaaataaaggcatttttaaaagtagtatgttatatggtgataaatgctttggagaaaataaggcaaggttaggcgaattcggaatgttgtgaggagtggggaatccctactccatacatcagcgggatgacctctccaataatgaagcatttcagcagatacttgaagaaagtgagcatgtggtccaagccaccggagtcttcctggcttggctagaaggacagcaggtgaaaatccctgaggcagaagaatggtaggtctctccagaaacagagagtccagtgaactggagtagagggaggaaggagaaaagcaaatttttgcttacccttgcagtatttgttgttggccagaattacttcttcgacattaatcaaaacatgaccttcagctgtatgtatctgctcacctctgtctacctgactctctttttctgtctctccctttatctctgcctctcagcacaggcacctatctgtcttcatatatagcttacttataaaccaaacacaaagcaatgtctgctgcaagaaaaaataatgagcaacttaattcaggccttatttaccctcacgttgtcaattttgatcatttgcttatttaactaaattgttctgctttcattccagtcattagcttccatatataaaaaataatgtgctcacattccataagtatgttagatattcacacattttgcattttgcaatagagaccaagactctggagtgtttttatttaatgaaacctctaatcagatcctgtggatttactagtaattaatctttaaaataacaccatatacaggactttaataccccaatatgttaatctcatcttttgttttgaaaatcgtcctctatttaacattctatcacactgtatgctgcctcactcctgcagccctcatctccacacagctgtggtctacatggccccaacatgtgtattcagtactgccctgccaattgtaaatgagaggtttaaaaggctccagatccaagtgacacatgcagcatttgtgttgaggttctgcctccatctttgtgcctaaatctctaactgtgtagcttcccacaactagtctctagaagcctggaactccacctttatcctctcattaagtcttttaaaaatctacttgttctctgatttctagcccagttgctgatagaatttcacctgctgataaaattttctgaataaaatgtcagaatatgaatcatccttcattcttgagttttgcttacttatgaactgcgacatcctatgtcagcctctcagactcctattcttgactttcccctcgacctgtaccctgctattatcatgcttcttgacacaggccaaggtttgcctgatagactaaatttctctgagcatcagctgatgctcttgggcttcattcaagcccaattctgaatgtgattccagattttattatccctgtcttccctctttggatttggcagggctgagacacttagggataaggtaagttctgccctcttctcaataatgggattggttggatattgctttttacttcttgttttccatgcagtaggaatataaccaaaaaatactatgtacttcactgtgaagtcctgaaacaaaaatatcatcgtaaataccctggatctcaaggatctctaattagatgtaccatacacatattgtataacacttccagaaccagggattagaagaacaagccctatatttgcagaaatgcgaaccttaactaatatatgtctaatctctttaattttacatactgatgcaaaagagatactaggagttcccccatcagttcgttcaatctcttgcttcttgggcaaaatcttcaaggctcttgaatttcatagtgaatttctctttttggtctgtgggcctactctccatctttgttacttctcttttgaggctttcaccttatactcactacaacttctctctctctctctcttttttgtgctaatccaaatagactttttggccttgccctagcagacatttagattttccttcccagcaagtgtctgtctctaaagcttgatgaatagttgccaaagaacactttcctgatataaggaaatagagccatgtttggttgggctttaagatgaaacacagaatcgtctttttcactgtggtgaagtacatctgatgctttaacatttatattctagatctaacatttagactatcagttgtgtgaccttaatccccaagtcttggtttccttatttgtaaaataagaatatcggctatttgatcttgaaggtcacctacacctctgcagtttgtgatacaactattcatcacatttagcagatgcccttctctttagaaaaatctcaagcctatagaatcggatacaatttaaacgatccccagcataattttgccctctcaggatttctatcttcatagtcatacacagatttttttgaaaaccccaagaaaagaaaaccatgcaaattagaagtgaatatatattagatgattataaatcacaaattatatcaaccttgtagggaagaaaagatttcttttctaacccatagctaggtttgtagctgaggcctttataacaaaagtcattaacaagagaaaagcacacagattttttaataaaaattttatgacatgtcataaaattacattacagaacacaggaaccttcagaagtgaagagcaaaggaacggggaaacctatgacctttttgctaagtttgatgaagaagtggatagttgtggagaagtatgatgtgatctaatggaacaagctgggggaatttaggagggcctatttgttcagattctcctctgtgtccctgttccttcagagataaggatgtttcttttctctgggtatagcgaggcacctctagaatgagggttttatgacctgcttcaggggagaaaaatcaaaggaaggtgaccgtgaccttcttgcttctgttgtttcctcaaatgccaagatacattattttgtggtagcgtgttctgaactccatatttaaaaaatagaatgttaccaaaattttctaaaaagaaataatatactattttatatgttgttactctcatactttctatccattctttactgttttatttgtaggtgaatacataaaaagtttcagaattttctaaattaaccaaatcaggtgaaatgcaattgtgacccctggtcctctgtttttgcttttcatagtagatattataaatataaaacattcagtgcgagcatatttataagaatataaattgttgaggcagggtgcggtggctcacacctgtaattccagcattttgggaggccgaggcaggcagggatcacgaggtttttgggaggattttgggatcacgaggtcaggagatcgaggccatcctggccaacgtggtgaaaccccctgtctactaaaaatacaaaaattggctgggcatggtggcacgcatctatagtcccagctatgcgagaggctgaggcagtgggcttgtcattgcagacttccatgcctagatttcactagtatttacagagatgttttttagcctgtcttccttcctacccctaaccccaactcttctctggattttccacttgctggatctactgtgtcaattactgagccagtcttgacaaagttcaggtgttttagtgcaggctgcatctcagcatgcctttattcccttgtcccagctgttgcattaaccaccatgaattttctactttggtctgctgctgccctgagctctcttggataaagccttattcctgcttggtttctgtcagccccacctctagagaatgagaagctatttattcctacaacattgctatattccttccagaaatgggctactttgcccagatacaaagcactgccatccacctaattctgatattaaacatactgcttattcttccatgatacagtgcattcacactattgtattcaatgctcacagtaaccacacagagatctaccatttgacactggataggaccaagggaaggtacactttctagtttccagtttcttgcccatttcctttccattgtctcttgttgatgaaatggctctctggcccattctgaccgatccaaatagtgagggaaattaggtggttatttgggtaagttatcatgttcttgggcaattaatgggaaaggaattgaggcaaattatgaatattcttcttttaaaataaagtgatattaagcaatgtattgaagggtcaactgtgcagtatttgcaagaaataaatgacaattaattaaagacataaattttgacaagagcattacatactttctgcttttcaatgtgttgttgcttttcctacaaattgttagctgaagggaactatgaaaagctgattaaaaataatgtcacataaaaataagcattgggccattcagtattatcatgtctatcttgctggccctattagaaataccatgccctttttaaaaaattgtatgctttttttttctggtttgataaatttttacatttaaattttaaatcattaaaaagtactactcacatttttttctgatatgttttctgaaatatttttgcattagtttttatgttagtaggtacagaggcaattttgtaaaactacatttaagaatacatttttggtgtttaaaacttgttttttatgaaatggttttttttctctaaaatttcaataagcttcactagaactataaaattaaggttgcctttttccctttactcactggtcattgtccagttgtaatttatcctactgactatcacttgagagccagagcaatgttggggaagaagcaagttgactttagacttagagttgggagctgagcgtgccttctcccctcaccttcactctgttcttggatctcaccctcttcagcccccaaattttctcatctctaaatagttaagaatatcagtgtcttctctagcagaggtcatttttagggcttttataatagccaatatatataaagcacttagtttagtgcctgacatacagtaggagcttaataaaataattacttaataaaacaacataattacctatctctgaaggaattaacctttttatattttccattattttttttctaatactaacaacctccttgtttttttcttcaacttttaaaattctggggttcatgtgcaggatgtacaggtttgttacataggtaaacctgtgtatggtggtttgctgcacagaccaacccatcacctaggtattatgcctggcctccattagctattcttcctgatgctctccctccctcaacctacccacccccaaaaggccccagtgtgtgttgttccctccatgtgtccatatgaaaaaactgccttttaagagaagaatacatcagtttgtgtatacacacacacagaaagaaacgggagcgttatttcctggtttagagtttcaagaaggttttatacatactgtttgcccctggatgcaaatggatacttatgatgtatggtgtgacttcatggagagtccattgtactcaatggtaagtgataaatatattcagctatattaagaggaagaatttaaaaggcacattaatttaaaagaatgcatgagatccacctaaaaattctgttctgacaggggactaatttaggctacaaccctgaatccccagtatgtttagcgcttgtgatgtttggaataccctataactaaagaatgaatagaaaatatttaacttgcaatcatggtaaaatataagtctaataaactattgtcacaagttggcaaaactattgtcacaagttggcaagaacatgagaacgatttcaactgactttcacctctccctacacagagattaatacagtaataattttactttgatgtataatccatattaaaaatacactgagtgatttaaatggttcctatgctatatgaagcattaggtatatcaaaagcccctgaatccaagatgtaaaagccttggaactttataagaagattgacatgtatttgtgagattatttttgtagaatgtaaaataggaaattttatctagctaaatttaaatccccactaatacagattatcatctcatttaaattatgatatatatgttgttatttaaattaattacctagatattttatacatagatatatcaaataaaattaatgtatcaaagtatgatagtagaaatgacattttcagatatttgaattcctttattttttctttcattgtagcaatgttctatatcaaccacagaacctttgaaacatgcacgttatgttatgaacatataaataaataattttattcatttgaaaggccacaataatttcaaagaactatttgcagttgacattgaccaaaataaaatacactgaagtgataaaacagattttagatcttaaagttgtagtggctgttaacattgaatagatccataaacatgaaaaatgggccatctgtcctttgtgctgactcaaggataatactttaaaaataagatcagtacttttacatagctgctgattgttatggataacaatcttaaattcaaatttaagattgaatttaatcttaattcaatcttaattaatttaaggagaatcttaaattcaaagtacaatattttctattattcgccagtgagtcattgttaccaaagtaaaaccttcacttcttcaatagcaaactttctgctctttcaatgagattaagcatttgactaatcctcattttatgtttaatattaacttattggtcctataggaaaacagcctgaggatttagtatatagacatttatccaatgatataaaatctgtgtatttggacaagaaagaaagaattatgcaaattacttatttctttttatattatatcagacatctgcatatttgggacatctggatatttgacaaccacgaacctcaatatgattaactgagcatttcattttttatctaaatgatttggcaccaggcaaaacagatttaatgattattaattaaccttcaggtccaaggagagttagagaaagttctgctataaaatataagaaaagccattcactacactaaaattattgtccctaaatctgaatctgaaaggaatcacaatggattttggtggatatacatataaatacattttcttcaatctttaagacaaaaaaaaatcacaaaaagatggtggggttgaatatataggttttataggctaaatatcacaagcaaaaattgatgagaatgtactggctccaatataaattagcagcaattacaccagacaatttttagactctattatcttaaaggcattcagatcttaccaagtccacaagccatctacttggatataacagctcccgagaggctgcctagcagccacaaggatgctgtagactaactaggttagtaccttccactttcaatacttcgtcaaaacagtttaagatgacagatgggacaaggaatttaggaatcctgtaatggatgtgagattggagagtgtctacagccaagacatgggtttatgataaaagcagattaaagaggatactattgtgactagatgggggatttaggtcatgctgtaaaactcttcagatggtatagagctatatgttaggtcagtgcagaggctgagggtggtgggaatgggtctgtaaaggaactgataaaagtttgggactgaaaagattttaaaaagacagagatcttggaagagctatatgttatatcaaaagctattgtgtgcctgtgcatatgcatgtgtacgtgtgtgtgcaccttgcacacataacctgctgcttactactcagcccccttgtgtcttctccccttccagagtaggccatatacctatgaacgttttaacgctcatgtataaaatctataaagaaaagaaaaaagcaaattactacatttttacctccacagtggaatctgagacactgttatgtcacacaaattcacttttttttttttttttgacagaatctcactctatcacccaggctggagtgcagtggcatgatcttggctcactacaacctctgtctcctggttaatctgattctcctgcctcagcctcccaagtagctggggttatatgcacctgccaccatacccagctaatttttttattttttagtggagacgggtttcatcatgttggccagtctagtctcaaactcctgctctcaggcaatcagcccaccttggcctcccaaagtgctgggcttacgggtgtgagccacggtgcccagcccaagttcactttttctacaagtgacatgtgaggcctattctgtatctagtcattcgtcctcatttctctctgtattccacagtttcttcttcctatcaaatttaaaattaacaatttgtttctctgatggagcatattctctgtcaattcaagtacttctgctctgctttccccaggagcttctaagagcacaagtgactgctttaccattgaattcatctcactgtaaaggagtatttgtcacaataagcctcttattttcaaacctgaaataaatacaaaaatatatagaaaaaatagaaaattatttttctacaaaatagaagtagtacatacattgacattaaaactttttcctactgaaactattgtggccaagatgaataatgtagtaagctggacctcaaatgcccatctattgaaaggcttgtgtgaattcaacacagattttggaaggaattttgaccttttatagatgctttcttagagaggaagttatatagccttttttcagagttttgtcattttttaatcttttattatttttaaaaatgtttgtgggttggtgtcctttgtcttcttttctgtatgtttccacaaaggcttagagacccatctcccactcaacagtctgcaagaagtagcttcaataaacatcacaggatagcaactttccagggagaataagaaaatctaatcattcatttattagttcatttaccataaatttttgtgcacctactatatcccaggaagtaccctaagcacaagtatgttagctctgaacagacatgatccctatcctcaggaaactggtacaacagagcagaagtcagacaataaatgaataagaaaataatatatacataaacatataccttataatatgtgttacgaagaaaataagttgagcagtgatggaaaatagctatcagagaattatgggaagaggatggcttgaatatatccctgaacccttgctgcttgctgtatctgagccaatcagctgctaaggcctcctgccctgctgaactattgaaagaaagagctaaggcaagaatttttacttcatgagccaaggaagaggcagggaccagttaggggaggtccaaggtgaggccccagtgcatgtgttagattctgagaaaagcctggcctgaggggtatatgagctaaacctgcctgtgagaatggtccttgccaggtgaacacgtcttctcaggctttgagtagcttccaggtaaaggaaaaattttttaatgaaaaaacaaaaataaaataagcaataaaagaaatgattgtcaaagataactccaagaggattaaaagaaacaaacagacacaaatgaaaaaaaaggtaaaaaacatgaaagaacaagtcaagactaagaaaatatatttaaaaaacaaataaataatccagaagaaaaataggtaaaagataacatcagatatttcattgaggaaaaaattataatgtcaataaatatatcaaacgttaaagctcactagcaacttctgaaatattaataaaggaggttgattgaaattaattaatttttaaaaaccaaggtactagtgaagatgtgaaaagataagacttatatacattactgactgaagtataaattagtaccactgcaaaggagagtatcttcaaaacacctggtgaatttgaacaggcttatgagctatgactcagcagttttagtagatgaatcccctagagtagctcccacacatttccataaggagttatgggccaggatgctcaggtcagctccctttgtaaaggtgaaacatagcaacaacataattatttttagtaagaaaacagataaatagtattggctgaaaaatactatactagccatatgatttttaaaaagcaaattgctaaaaataagagtattaaagtatttaaagttgtaaaacgtatattaatgtaaaaaatgcatttatatacaatctttaagtctagaaaatagcattacatatattgtttatatagatatccatattttatgaaatataaaattatgtggagatgtaatatacaccaacttcagcaaaatgattgcatttgagaaggaagggagggcaaaataatagaagaagctttagctgatatctaatatttgattcttggagagagagaacactgatgcaaagatgtcaacacgaacatctttgtgttcatggaagtggacatcctttgtaatattatttttgtatttcataaaatcaaaatcacaatggaagattcacaaatgagcatatctcctaacaagaactaaaacagcagtttgtcaaggagagaggcaggttgagggtgtcctatgtcacagaagtgcatatgtatagagtagctgttggtgtgctttgagatcaggtgtggagcagttcagatgtaactatttaccagatgtgaattttttaaaagagttatttctccttttaaagattcattattttcattaataaagtggaatctacttcacagtactgtgatgcaatgtactaatattgcctatataaaacaattgtcactatgcctagaataaatattccataaatgttgatggacacatagtttattcattcatctagatattattaaaatttcaggaataaaaacataattagcataaagatattatgagggtaaatggtactttaatagtgagaattagttgaacatacactagtctccaactaccttacataattaacctgataccctccaaataaccatgcagtggtgactccatcattctatgtaaggagaccgagactccaagaggctcagtgctttgcctaaatctgaggtccagattaaagtccatatctgactgctgcactctttcacttttagtgatattcacactggacttgcagaggatatgacagcttaaaaacatttgagaaccataattctacactacatgctctttatgaatactagtagatgttttctaaggttcagaggaaggcctgtacaattggccaatctataactttgataccagtgtaatatatcaattatatactacaagtaaaattttaaaaagaacaaaattgtttaaccttaagcttatgatttaatttttttgatgtgtattatagaatttgatatagataaagtagttaatcagatgtataaagaaaataatacaggttgagtatcctgtagccaaaatgcttgggaccagaagtgttttgaattttttgatttttttcaaactttggaatatttgatatacataaagggatatcttgggtttgggacccaaatctaaacacaagattcatttatatttcatagagtacttatacacatgacctgaagataattttatacaatattttttaaaatttttgtatgaagcaaagtttgtgtatgttgaactatcagaaagcagaggtgtcactgtctcagccacctatgtggacaacctgtagttgtttggcatcaccatcattcctgactctgaatttatatgctaatgataagcaatcattttcttgcagttactcacacataagtattagcagtaagaaatatgacataccattactacagtgaaaaattaatgtggcagaggtggaattttccacttgtggcgtcatgtctgtgctcaaacagtttcaagttttgaagcatttcagattttggatttttgtgttagtgatgctcagcctatacaaaaatgactcttatgcttgaaaatcttagtccgtctcttctggtttttaagtcatccaggaagtttatatgtggtggaaaatgcaactggccatgtcccagggcagacacctcctccagtgctcacagtggaggccactgaagtgttatgaccatgttctgtcagtgatgtgtacctttctttgggctcacaatggcatagaaagatgtaaccaaagtctagggaattgggtcctaattagagaactgccagtaaccaggagtaggaccataacacctgggactctgagcttcacctctccaggctccagtttcctcatctatgtaaatgaaaacattgaacaagaacaatacagcagttatcaggtctgttttgactcctacagtcctttattcacttgaaattttaagcaaatgttaaatatgtaaacctgagcctgagatgggactttgagtactctccccaaatcctcagagacatttcaagaagcactttggaacaactcagagaaatctttgtaaaaattagtggacaagatgaactctaagattaaattaattaaggagaaaattgagggtcccataatatgatcaccaggtttgaatcccagatcttccagttactagtcagtctgaatattgactaaattacttaactactctacaagcagtttactaaccttacaggattattgtgaatattaattaagataattcatgtgaagcacttagaaaagaatctagaacataaagaagaaatcaataaagtgatctgtgatcaatttaccatcaccatcatcatcatcatcattgttatataaatgtgatcaaatacatgagaaaaacctaacacttgtctggcacaagggagctgtgtataggtatatgtgtgtgtgtgagcctgtgactaattttttagcctccgtcatttttcctactttcctgtcaagatatctactctctatcaggcactagaaatataaaatgtgattagtttagattaaaagatactgaggaatgaagtaccaatctcagaacacggtgacgaaaaatattttctgcagattaaaatgaatattgaactaatagcatttttgttagaaactttctttcatccccagaagtttagtattcccttttctggacattttagtggttgaatcattcctggcttcgcaggatgtgaaatgttcattaaaagaagcatcatggttactgccttgtaaagatgatcctaacagcttagttctttgtgaactatttgtgtgttggcttgccgtgactttgcacaagttagccactgaagcagaaaaatcactgccggggttgtcaaatatcattggtgcaaggtgcctttctgtgtgcctggctgagcagcttccaatgacatgtgatgtggggttttctcccaaggctgttgcgtgctgtgtgcagcatatctaagctgaaaaactaatgcatggccgggtattcttggtaggcctccaggcatttcacattcatttataaaatgccttttttctacttcaaattaatcttatgttctttccaatcaccattgtaatactcttttgactttatattctgacaagcttgaaatagcctgataggattgaactaaagtataaaaaaccagagttacaacagtcagaaacaaatgaaaaactgaaaccgagtctgcagcgttaccttcacagctgtgttagtacacaattcgggccttttctagctttatgattctaaaatatgtctttgttttgaattaagttgctggcattatgtttgcagagcagttaatccatctccaaaatttgtaatagtcatggttattctgtgactttcattgcaaatggaacttcagtgtcaggtttatgggacagctattaaaaaagcagaaggagagttatcacaagtctcttatggaactcgttaacttatggtaattaatctaaataggacatttatttgaattctatctcaggaaaccaaatgaactttctcttcttgaatgtgcagtttaatgctcatttatgttaatattatatttctttaagttgttagtcacaatttgtgttgctgtctcatctattcatctaacaagcatgtatttggcacctcctgtatgtctgacttgtaattgagtgatgaataggactagttcctgtcctcagagagttcctagtctggtggaggggaagctttgcaggcaaagaatgagtaaggtgcatcaagcccagtggtgagtaacatacaccaggcagagggataacagaagagaatggcattaactcattctgggagttgaaggaacactttctgaagaaagtgatgtctcagctggatgaaaaggagtaaaatagtgacaatccatgatagaagctcaggtatagtaatttgttaaccaaaatattccaagtgaaagtaattgaaatagggcatctgaacaatttgcatggggctttatatttaacactttcctgctttcaactgttcattttttcctccctcttacagaaactccctgagatacacaaactgatattcctctgagttttcaagttggagaactggcccttagggtacactcagtgactattagttgaatgggataacacaaccaatatttattgagtgcctactgcctctctgtgccttaattctttatttgtaaaattagcataataaccaggcctctctcctatgattatggtaaggaaaaaatgagattaatatgttattaacatagactagcattggtctcaaaatcagggttatataagccagttattattactagtaactgctactggttattaattagttattattagtaactggctagttactagccagttattattactagtaattttctagataacaagaagttggtttaggggtgaagggaatcttccttacccccttcggaaggttcaataatttgagtctgtaaaacaaactgacaatagacaggttaacaggaaacaggcatacaaaacgatactagtaataataattagtagagacatgccacgcactgttttaggcactgaacgtcagcagagcaaaggctggctttcatgcagtttaaaccgtgtggccagagcggagtggctgaggaagggagtaaataaaaagaaacgaagttgaaagacttgctggaggagggaaaggcacagattacagagggatttataagccatggtgagacttcaaaattttaagccaagaaggaacctgatctaacttaggttttaaaagaattacttatgcactctgaatagattggaggagcgcaaacatggagagaacagaagaatcagaaggttattcagatcacagtggctttgggcctgtgtgtgtgtgtgtgtgtgtgtgtgtgtgtgtgtgtgtgtatgtgtgtgtgtgtgagggggcagagagaagtggtcaaaatctggatatattttggaggtttactaggcagaattcactaatggagtagatatgtggcattcaacaaagagaggttccagaattttggcctaagcagaaaaatagaagcttccatttcttgagatgggagaagatttatgaggaagaaaactggcttcaagaatgaaaatttccattttagacatgttaataataaatcagtgaatataatatggtattgcaaaagaccaaggaattaacctgggttaggaaagatggatagagataaaagagaaaagaatgtgagaaagatgttactatggcttcaagatccaaggtgagaaatgggagacaataaggctcataaaagagaaatctgtttggatctgaatcagaaagatcacacagtatagtaatgagaattaaaactgcacagaaacaatcagggtttagaaggctaaagtggacaatttgaactcatttactagtagcttggcaacagttaaaattttcaaaacaagctgatttgagctaagtctcttagcattcaccacattatactgagttatctatttctgtgttttgctatcccaccaaactgtaaattctgctgtgttttattcatcattttactgcctctgcctagcatggtacctggtacatgcttgccactcagtaatcacttgtggaagtcaactgaaaaaaaaaaaaagaaaagaaaaaaaaaaaggcttgtgcccaaacaaggacacaaattgaaataacaggctccattggttcaaattcaaactattcccttatgcaaaggattcaagtttgctgagaccccagatccaaggccctatatctgtcttaatatgataacaaggggtaacactcacctcacatatcccaaaaataattttcagtatcctgctactacctcattttgtctcataccagaattgagagcaaacactcaatgtttctttatctcttgcgtttaatttgctaaactccaaatcaaattgaaccctggtctatttgaagaaaatacactgtagtagtttctcctcccctgtgcaggttcatttatctgtaccctaattcactcaaaactcagaggaaaaacacatctgtattgaaacatttttgtggcattgattgctccccatgtgattattccaacaacaactatgtaacaacgtgagggtgaaaataatctctgtagcttgttttgtgtgggctaacaccctagtgagatggaaaaatagcctaaaactatgtctactttttcctgagacttgtcttttcaataagagcttatttactatacctcctgcttgcttttagtcagtaatatgttttgaagatagaacaaatgatcttttctacttgaaaacacaatttatttttattgtagtaaaactatcccattaaaaagtttttaagatgtggagaatagatctcattgtaagttggtacagcctgttcaaattttgatacaataaatcaaactgaaggtgttgaaggtgtaggatagcaaacttttttctccagtcccacttaacagccaaaactacatcactccaatatatctgcctccatttggtttcttgctctttcgtatcttccctcaattattatggtatctcaaaacacctctcacactttcctgttttgcccatccagccaatactccctcattcctgaagaattcgccccatcagagacccataagcagtgctggggttcatgtacatcataattttctagataataagttggtttaggagtgaagggaatttttcttaccccttctgaaggttagataatttgagcctataaaccaaacagacagattcacaggaaaaagcatacaaatttattacatgcacgtgcacagggagctacacaaaatacaggactcaaagaagggcctaaggtttttatatgatacagaaagaaaaagaggcctgaagctcctggaggctgtggtgacaggttatggaagggtaaggggaagaatgcactgtgaacaaaggctgttgtttcattgtgcagagaaggtctatcaggtaatagccctcaaaaagagtagatggtaacctgtggtaatagtttctctgtcagacctttaaaagtgtcaaacctgtctttagtcttcttttcctgtgagttaatctttcctagattcaaataaaaggacctcagagaaaccgtctgcctgcatcccttgtttgctttattaatatatacatgtaaatttattttacaaaaggataaattttcagagccatgctttgtgtctgcagaccctctgaatagccatctcaaaatatgccaaagaggcacgctttggatggcatattttggtttcccacagtcccctctttgaaatttattttcagaaagttttacatattaaaataggattgataactgtggaaaatttgctttagacattttgagataagacattagcaaagggaagaaaaacatatattggaataagtagaaaaatgtctcattttaggaagtggtgttgcagggttcccacagttaagtctctacatggtgtaagcaaacaagtttttaatatgaggcttctctaaagaaacaaaagaaagacaaaagttaataattgaagcagcatataaactagttctgagtctagcagttgaaaagatttctagatttggcctcaaaacatcttcagttgaagtgtggatagacagtgacaatctgacagattttaagttgttattgtgatttatctggagtcaaccagcttcagctttcagggcttcaagaaaaaggcacatttaatttcagtgattccaagtcagaaaaaaattggagaaaaaagtgaaaatgttattttggagagttgcagtcagacattagaggaaactaacaatttcagaatccagtctaaattgtaggtaaataataaaatctcaaaaaaatgaacagagctagaatctaataacagatacactgtagttttcttttaagtcataatttttctctctcgagttcccccctttttaccaaagttaatcacaataaaactaatttgtttgcaaaataagttttaggcttgttatactttgcctaataatttacagaagtacagcaaaatgatgattaatcatataagctcattttcaattttgctttgctggaacttttcacaaggaatctcagattaaacttttgaaagcctcttgaggctgggaagccaatccaaggaggagtcaccctcaaattgtgcctgtaatacctttaaacttgagtgaatacttctcttctcaaggttcccaaaaatatattcaggttccagggcctctcaggaagtgacattttttctcacctgtaaatcaaccatgttaattatttatccaagatatcaagatagattttccaaggggttttaattggctttataaagtcaactttaattccttagagcaatctggtcatatctcagaataggacatgtcaggcaaagccttggtaatatggccaatgtttccaattgtgtcctattagaaagagaatagattcttcttaaatgtaagcaaataactatattgttattgaaataagaatactcacaaatagtctccaaactctggagggatcaggtagggagaaaaaaaaatttcaattctgcacacaaaagtacaccttcccatattcccgtaaactgtagatagctgaaagaaaaaaaaaattaatgtggaaaatgaaacatgaaagaataagccatgtgccaaacaaaaaagtcataaaatcataatctttcattgctttagtcccatgtaataattcttattctgcttgatgttgggttagtagttttttgagttcagttttttcactgaagttcggaattcttacccagtcaaatactacgatctcaaaatcatcagaaaactatattcaatggtacttgtgagagtcttttctataaatttcattgaagaaaagcaatttggggctataactgactgcaagatgcttttagagaagaagcaaaaccactgtctgtcaatgacaaaaacttacaatagccatggttaaaaacctaatgagaattcataacaagtcattgacaaggaaatgtgttgtggcacacaacgctttaacataataaccataattattactgataatgtacactaggatataaatttctagaaatttcatacaattttggaatacatgtgaataacatatctataaaattataactcaaagaaggttaaacatacatgtgaataacacatgtataaaattgtaactcaaagaaggttaaacatcacttgctatttggagtgcttcccatataacttagcgtattaaataggcctaacttgtttaatatctctcttttgtactgctaggggtccttctggaatgcccaaaagttagtctgaggtcaaaaagacttaattttgatttggagaaggttgttaaaaaataaaggttcgaagcattcgatcaaaaataagatcacaggttactgttaaattcatttaaccagaatggcaatttaaagacttcaaaataaaatgcaggaagttacataattatagaaacagtttaattctttaacccagtttttctaagtaatcaaagacctaataaagacagtataaagcataggaaattattttgataaaatgcaaaatctatcaatactcttgtttttaaaagagaagaccaaagtttagttttttaccagtgcactttttctattaaagctcatttctgaaacctttataataattttattcaactttagtcagtttaaccttacaatattttctctcactctctttacccaactctcttgaactgtcattcagctttttatgtatcatttcttcattctgaaacaacctttaaactagaataattatttttcttcaacaacaaaaaatccttatgccttccttataactttcctcaccaaaaacacatcctagtttccttctacacttacatacagaattttttatcttatttctagtagttttaattacatatattaattagaatttcaattcttagtaatcttattttccagtgaaaatctaggaagtaaacaatcttgaactggcattgtaccaacatgttatcaatagatttcataatttctagaaacaaaagctttctcataaagtaattttacaatgtggatcaggacatatttaccagccaaaccaaatatatttagttctcttgtaacaagaagttaaaagtaaataagctaaaatgtatgattaacaattaatgttccagtattatatcttatttggaaatgatctaattatttaaagaatattcattatctaatttagtttagcaatactttaagggtgtagttacctgaaagatttgagaaacctttgaaagtatatattataaatcataattattgttaaaaattaaatttataaagttttatctcacttacatctatttaattactttaaaaccaacagcattaagctagtcctatttgtgaaagatttacccaagtcacatgaacttgaaaagcctttgagtttgttaccatatttctagcagttttaaaagtatttaattcataagaacaaatttttctttaagccaatttgaaattcttccaagaaattttatcccatgtagatacaacttgcaccatacatgcacacatgtataaacatatacaaacatacagataggacacaaacaaaaatattatagtttttattgtaaaactttagacagatacaataatataaaactcaccaatttatgaagtattaaccaagttaacactacctgtttacaatggtcaaaaccctttatcaatattaatagaaaagacctttaagatttttcatttgttttaaatttttaaatagctttttttccctgagtatatagttccattttagcttaggagagaaggcaaagaaattcttattatgctctgagtatgaaccacagccctaaaacaaaggtatatctacaagaaactcaacagcaaaaataattctcatgacctaaattaataagccttttaatggctttaaccaagtgtctaaagttagagcaaaaagatacaggctgctgaaaatccaaagccactcccaaaagaaaggcagtcaaaaagaaagaaaagctttgcttgccaaaaatggggtacaacccatatttctgtccagccatatttgtgggtctctcaaccttttggtaggccacccatacatgagggcctaataacctgtgtgccctcagtagacaaaatgtttaaaaaagacaacagttggtaagacaaacaggaaaacaaaagccattcatgagagggaagaggatcattatcaaacgagtaccccaaaagtcaagagttatacaaattcaaaacaaataattcaaataaattcttataaactaattcttacaagtatttatctcctgagctaaagaaatgtactgaaaaaaatggaggtggattcagagaagggaagttttaaactttggagcccagagatccaaaaacttttctcatttaaaaggattttaactttgttctaaaactgatttttattattttaatattgccaaaggagtctttaagggtaacagttatatttacgtgtgtctcttcttttttttaatttgatcttttcatagatagcaatagttaagatgagagtttttctacatataaccaatttatttattacaaaagtgattcaaatcaataaaagacttcatttatagacctgttttcaccagcaactccaaatttgaaggaaaaagagacaaggagtgactcttgccactcttactcaactgggctctaaaggcagagatctgggaatactgaccttggtaaaaattcttacctttcttggctggcttttttgttagttgtcccagggtcccatttacagcctctaaactgagcagagtgacttgttctcctgcctgggctcaccaaaactgttagggacaaaggcaactttcctccctcttccttctgaagattcaataatttgtgtctataaaaccaactgacaagagacagattaacagggtaaaaacacatacaaatttattatatgcacatgagcatgagagtcacacaaaatatgagactcaaaaaagagcctgatggctgacgttttcatattgtacaggaaggatagagtcttggcggtcctgagggctgtggtggcaggttatgggaggatgaggggaagaaatgcactgtgaacaaaggctgttgtttcattgtacagataaagtctctcaggcaatagcccacagaaagaatagatcataacctgtagtgataatttctctgtcagacctttaaaagtgtcagacctttctttaattcccttttcctgtgatttaatctttcctaggtttagaaaaaagggacctcagaaaaagcctctccctgcaacttttgtttgctttattaatatagatagatgtaaatttcttttacaaaaggatagatttttcagagctatgcttgtgtctgcagcccctctgaatagccgtctcaaaatatgccaaagaggtacactctgaggtgatgtattttggtttcctgcattggtcaggtggaacaatataccagctagcagggatcttttgatctcctgagagacactttgctaagtgtgattaatgctttaacagatgtagtccagaagatacgtttcttaacacttcctggggcagctgaggaatattacactgcagagatgttgtttagttgaaccttgaaggatgagacagagtttccccttgaaaggaggcattttaggtgaaataagcagtatgttaaaaggaacagaggaatgcaacaatatgacccatttggaggaaagaaactaggtgtgattggaaggaagaatcatgaaagatcagggtagatactggtggggcagctattaaaggagtttgagcaggggcatgacatcttcacattgaaagcaatatgggagtcgaattaaatttagtacccagttgagataaaagtccattgccatattcacagtgaggtgggacaaaagcagagtcagagagattaagaggctgggaaagattgaagtgatttttaggaatcagaatccacatcagttgatgacaagtacagaagggcacaatagcaagaagaagaagtaaatgataattcctagatgccattagtcacaatcaagtacggaagagacattattgactgaggttgaatcagggcagagaagataatatacctgattttggaagtgttgcatgtaagggggcttcgatttcagctacttacatacttgggaatctttacaaaagcaggaaggctgaagccacagatgtggatgtaattactaaaagtagaagaggtagagtgaaaagggacatgggatgaagcaaaagcaacatttgagactgtccaaagaatacaggtatattcccttactgcagtagtcaaagtccacaagaccctgaataggcctagtccgtcttaactagtctgagggctatcagccatacatccggtacataagcatatattccttggtttaaataattaaaataatatattgtcatcctctaagatgcatgagactgccagaatgacctgttagccagaggtcattgatatcatctatccacaagagattaaacctctgaggtattagaaagcagtttttggagggcctatagaaacacatgtttcccttttcttatgactccctatagcagctggtatcactataaaatactgtgtaatctttgaaagtccctctagaaaaaccaacacgctcacaaactaaagctaagattttgtcaaatgaggccttacccagctttattcaagaaataagcagtcctattgacctctggaaaatgacctatttgtcttctcctccaaggaatagtagtaaaactataacaactgtacatttatatttaataatgatagaaaatttaaactttcaagtatcctgcttagagatggaaagccaggactcccaaagcaacactgcttgttcctaactagggaaaagcttagtttcttcgccttctttagtgtgaaacaagagcccatttcgggtgtgtgcatgtgagcatgcatattactcacacatacacatttacctgaaatctaccagacattgcatggtcttttaaaaacttgttttgttctcctgaaatgttttctattttgttttctcctagtctctctgggcttatgttttatctcagccaccatttaatgagtttctatgctgttcaaaaccatagaagtttcacattcttcatttcattttatttttcaatatttatatgaatgagatgttaacatccacttttatacacgaatctccctctgcaaaaggctcaacaacttgcccaaagtaagtctttctgacactaaagccatcacttcttccacgacactgtcatctccaaatgagctggggagaaagtggcccctaataattctaagttaccttgaacctctttattccagaattcatcatctactaacaaaattttttgtatgtaaataataaaactagaaatgaaaaatctcaaagtattagcaacaagagcccaataagtatgaaacacccagcaacagaaactatttatattggctagatctaaatttgtctatgtcagttaatattatttatgttacctcatctcaaagggtatactagaatttcaagttataaagatgtggtttcaattaaatatattaaagtagttctcaaaacagttattttacagtgtccagttattcactaagaaaaaaacatttaatgttctggttagtggtgacttagtacgatgtttccatccttgggctcttggccccagtccaatcataaacatgttgtaccctgctgtggtacaacaggagaaaaccacgtgttagcagaggctcctatcaggacctttgaggaactgaatctctttgtgaataagcagctcctaagaaagatctgatctaagcataacatgatctgaaaatttttgcctctccacgtgccattttagaacctgtgaacagcacactacacagattggtagcagagcaacttcaactggtccaatgtatgagtatcgactttttatcctttagagctttactgctgccactcaagggcaaattgggaaataattccaaaaaatgcagccaatggtaattttctacattgtaagcacaggaaaggaggaaataaaagaaaagataaataggttaccttagtgctatccttagtaactctgttcaatcttggcaatgacaaacctatataaactttaactaaataaaggcaatgcagccagaaggtgaattttgctacttggcttacagtcctgatcctgagaaaactgttaattcccctgatgtcactaaatactccctacaattaattactccctcaactaatacattgagaaatgtattaattcaaaaaatccattttccacataaaagagaagctttagcacaataacgttttgtctaaacattatttattcattgccactgagagttttaaaacaatgcaatttggaataaacatatgcctggttaatgttatcctttagagagaaataaaaattaataatttaaaaccacatagttgtaaggcatctggtttgatagaaatgtactcttgaggtagaacagtgaacaattactcaaaaatcagaaatattggaggaatcacaacttctcagatggttaaagtagtctatctgtaaatacaaagtagggtttttaatccttaaatagcttgtcatttctaacaatgtgaagaatatattgataaatatctttaaaagaatgagttttttttttaacttctgtgtctgtgttaaaaacaaacactggtatactttgaaataaattgtcagtaatgtactgtgtgattttataaaaatagcatagacactaattcctaattatgacagtgactggcttactggattcaattggagattaatctagttcacatttttcaaagcacagcactaatactctgtactcctaatccggatcctctaaattagaatcccaggggaagcatttccattcaacattccaggtaatcgtaggcatgctaaagctttagaatcacagtaaacatattttgccatagaaatttctgaagatttgtcaaattatttaacacttgattaaataattgtacatgttctttgaactttaaagtaatagagtaatatattattcatacgttatatataagcatattcaaaaatagatgtatgttaaataataataacgaacatttggagtgcttctttggaggtattgttttaaggaggagttcgttaatattattttgttgagtactcacagcaactgtacgaagtattatgtttatcgcccattttatgatgaggaaaagaggtaactaatttgaataaattgcctgaggtcacacacctagcaagtggcagagccaactttggactcatgcaatctagctcccaaacctcgtcttaaccaccaggtcatactatatcttaaaggtttttcagtgaaaactggtctgctaagaagtcataataataggaaatgcttttaacacattattagttgaacaagaggaaccaaggtaaggaggagagaggagaggaaggaaaagaaggaaaggaggaggaggagagaaaggatcttacaaaacaatatagacacaactgttttgcagtgaaaatatacatagaaaaaaaagactaaaaaggtataaaccaaaatacttattatcagatgatggggtggcagtaatttactgtgttttctctattttccaaattccctataataagagaatgaatgatcatgtattgctcttatagtcagaaaacaataaatgagtcattttacaggctgattacatatgtcttagttgacctgtttcgtaaatataggaattgatttagatttttaattatacttattacttagctacctttagaacacataaatgtataataactgttttttaaaaactttgaagaatggtttaatccttatatgtaaattctatatttttatattatgtttaggtgctctgtgaagaaaaaaatgcaaaccacattgtggctttaaaataagtatgttatttctacctcactgcaatggaaaacattccaatcttattttgttctccaatattatatacataatgaaataaataagattatttatcaatacattttattttacatttgttttattattctgatcagaatttattttgttagaattcagaaaaactgtaccttaaaatgtaaggtaagaacagatatttgcacactggcgttcatagtaccactattcacaagcatcattcacaagccaaataattcatagcactattcacaagtaccacttatcagtggataagtgaataaacaaaatgtggtataaccgtacaatggaatatttttcagacttaaaaaggaacaaatttctgacacatgttacaaaatggatgaaccttggagacattatgctaagtgaaataatccagtcacaaaagaacaaatattgtatgatttcacttatatgaagtgactagagttgtcaaattcatagagacagaaagtagagtgctgaaggaagggaagaatggagagtcagagtatacaaggtacaaagttttagagaaggtgaaaagttctgaagatggagagtggtgttggttgtacaatgtgaatgtagttaatggcaaagaactgtccacttaaaatggttaaaatagtcaagtttgtgttatatataaatttcctcaataaataagcttggtgtggtggcttatacatgtaatcttagcactttgcaaagttgaggtgtagaaaccacttgagaagagcctgggcaacatggcaaaaccccatctctacaaaaagtaaaaaaattagccaggcatggtgatgcatgcctgtagtcccagctactcgagggctgaggccagaggatcacttgagcctgacaggtcgaggctgcaatgagctatgatcatgccactgcattccagcctaggtgacagagtgaaacacttcctcaaataataagtaaaattgaaataaattaattaataaaataaaagatattaaatagtatttttcatttgttattgcgttcaagacagatcacattctcaaaatcttaaaattacctattcataagggttgtactcctaaagatgctttaatagacatcttttttagaaaccttgcatttatcgcctcctaattggtctttgatcataatatatccctgcttattgaactcctcctgtgggtatcattcacattataaataaaatccaaattctgcaaaaaatgctttataatattgatttctgtgcatagaaatatacctacacatatgtcccctctccctctctttccttctctctctctctctttctctctctctctctctctgtccttcctacagctgcacaggcttcttgctgttcctggtacataccaactttttaactttgacaaagacatgacactcaatacttccacccctggaaagcttcccctagacttctgttgttccttttcagcaaggtcattcctaagggccccatccaaaacagtgctgcttctaagatgcagccactctacgctttagccttctctctgtgtttcctccttagcacttcaataactaaaatgctgtatggttcacttgtgtgttttctttctttctgtagtggaatgtgagcaccaggacagcacacatctcaactgtcttgttaccactgtatctccagtgtcacagcacttagcacagtgcctggtacaaagtaaatactcagcaaatactgcgtgtgcaactgtttgtataaacatattcgaaatacctcattggctgtcattgatatttgtggtatagataaaatgagattgaggtttgcagtagtaaggatgagccatttctgaatcaacaaattttaagtaggtggtcatttgttctctgagataatatcctgattttaggtaatagaatttcataaaatggacccaacttttttctccactgagaaataatttgaatatgagcatttgtcatgtattttcttaaatgctttacattcattgtagcatttcatcctcacaacactataaggtaaatattattattgccattttacagatacagaaactgaggtacacagagccatttaccccaggtcaagtaagtattcaaattggatttcattattagcaatgattcccaagctaatgcctttaagcagtattgactgtggctttccctaaacacagataagttttacttatcgtggcaattttttattacctattacatttaaaatgtgtgctcattcaaaaaagtgaagacatgaatattcaaataagaaaataatataaaaatcatccctaatcctttaattagacattaccacttttaaaataaattttccttatctttgggctttgcatagacaacttaaaataaataaaagtgaaagaggaatgaaaatagtgaaccagtaaaattccagaataagcaaagtcctaaaagatatttttttcatttaacatgttaaatgtttttttcaattgtatccattcatcttttactttatgatatggaatgaggagtgaaagtttccttactaaaaattttttttaaaaaactgacctggcagatagtaggtatattcttttatgtaagtaaatatgaaattatttaaagggtattcaaaaagttttaattgaataatatagcataatatttattccataaaataaaaatattttaagtagttataatattagattcatagtggcttctaatatttttagggaaataagaatgatgtgacctcttagtgtccaactcaacttccctggttaaactgtatctgtgataattaaccatattttgaacagatttactctgagcaggcatttttcatatgtgtgaaaatgagccataagagcttcaacagataatgccagaggatggggctctcttaagaatatgtacttacccacaccagcagtgcaaccttacccttgggtctgtaaatttcacttgatagatattccacatgcatactgtaagaacataaggcaggaaatatagaaaaattgaatgctcccacagtgacaaatagtaaaattatactaaaaatagctgcacagggattgttttacagtattattatatgctgttgtcactggaaaatagtgtttttcttgcaatacattgcaatgttatatgatatgttattataaaaaaattatgttgacatcattcaatggagtcaatttttttttttttgtaatttggtctactctatcagacaacactcatctcaatgtgtccttcaaaatacagagttcttttttcaaatttaatagagatttagtgaaaactgtagaaagtatataaataaggatttctgttgcttacaaaactgaataaaagatcatacctctctttagggaacttacaaattaggagggagagggatttttaaaaacacagtacatgatatatatatacaatacatatatagcatgttccctaatcgctacaaaatcctaaggcaatttagagaaaaaagtgaccataaaaattatgattaggaaataatggggagatgcataagtcctgatgtttcatcaggataatggctttaatttggatcctgaagtattagtaggctattaataggcaaggatctctttattccttacacacatattaatttagcatcatactatgaacttgtccaagggctagacagatcaattgaacagcactaagtaaaccctactctaaaggcttctggtaaacgaatactagataaattaggtaagttcagatactgataaattctattacaataataagataggataatagcaagttgcttgaaagagtaagttgcaagcaaacttgaaagttgtttgaaagaggagagaatggggcctttttgtgaggtagggctttctggaaacacagtatctgaataaatattaaaagccaatctcaaatagagcatttcagaaaaaggaaatagatttattagagattccgagattgaaacaatattggtcatgagttcaagaaacaataactagaacaaaacggcggtgggacagaatgaggtcagattagagaggtagacacagatcatactgtgcaggatcaaggagatattcaagacagaaagaacagctagagccaaaatacaattcaaaacacatagagcacaatggttgaacataggtggctattgggatcaaatggcttggcttcaaattctagctcttccacctcctgtttgtttagcgttgaccacattatctattttttcgagcttcagccttctcatttttaatgcaaaaataatgatgatgcccagcttcccatgtgtgatgagtacttcttggtatgatgcatgtacagggcttagcaacgtgtccagcactaacaaagtaaccattctagagtattttgaagaacagaattgagtccagtttaattgttacatataaggaagagtaatggaaaatgagtctacaaataaaacaggaactagagttaagcagaatatgaaacatcagactatttcataatcaggagaaaatccttgcactcctttaagcagggaagtgatgtgtcagcagtaaactttgggtagattaatatagcaattgttgacaaagtattttggatattggagataagaaaataagcagtttggccgggcgtggtggctcacgcctgtaatcccagcactttggtaggccgaggcagacagatcaggaggtcaggagatcgagaccatcctggctaacacggtgaaaccccgtctctactaaaaatacaaaaaattagctgggcctggtggcgggcgcctgtagtcccagctactcgggaggctgaggcaggagaatggcatgaacccgggaggcggagcttgcagtgagcctagattgcgccactgcactccagcctgggcaacagagctagactccgtctcaagaaaagaaaaaaaaaaaaaaggcaatttaatttgttctaagatagagaccaaagagaaggactggattgaagacattgtagaggttaacttggcaggactttgtgactaaatgaatgagtacaatctcaggagcctgagagaatatataattgaaatacagacggtggggaaggaaccagtttgagtcagaagaaattgagtgaactgtagacctgctgctctgagattcctgcagctatccagcaagcagttggaaatgcaaaagtaaactaaggggaaaagtactggctggaaatgtaggctaacattcagattttagctgcagctttcagattgccggttggattgtcaagagaaaagaatgaagataaaagagcagaatactaaggatataaccctaaggtccaagtatagttcactaacaagactagaagaatgagtttatgaatgagataggcgagtgatccacatggtcaaaggaaagccagaagaacagggatcatattctacatgtcaattgctggatataaatgatacctaaataatgaatttaaacattttaactcagatattcagtttatggcatggcaaacaactgatttaaaaattgtttataatgctttttttttttttgctcataatgaaaatgatgtaaaaattcctgaactctgtgtgtttttcctgtatatatctaatttacttacaaaactctcatagggaacttttttttaatgttccatttttaaagcctagaataacttcctaaggaaagtgtgaaatattcagacccataatagcttcctagaaagtagttcttactttccatatgaaaaaaaaaaaattctttgacataatagctaaaggtgatgaaattgtttcttctttaaatgactctagtcttatggtggcatttagaaatgcatcttaagtgaggggttatcacaaagtcttttttatctgctagtttttcctctactttacctttaatcatagtaggaacaaagtataaacaaaatcagcaaatataaataaaaattgtatacattgttctattttatttgttatccaacatatgtctcactttgcattgtgtagaccagaattcgggttcatagaaaaaattctttcttcaaatgagcatgcttatctatataaataaaattataaatggaattaagaaataataaaacttatgtaaggtatttaattactatgaccaactatatattaataaacttgcaaatatcagtgaaataaatatctcaaaagctagaaatgatcaaaattaactcaagacatttaaaacataaagagttcaataaaccaggaataaattttattttttatccaagaactttagggccagagagtttactaatgttattttgaaattcaagtaataacttgatatagtgtttgtataatataaagtgtaatggttatctattattgttcctgatgattacaaaatttgatcaacaatttgatcaacagcatgaaaaaatgtagtacaatgatgcaactattaacatagatgaatacaaaagtataaaatatataccaacaaggtatttccaataatacattaatgtattgatgacataagataggtttgttccagaagtttaaaaaatgttgtcaatgaatttgataaagtttaatattcacattaaaagtattaccgttaaaaccaaaatatagcatacttattctctccattattttggaataagaaaaaattattctttgcagagctcatgcttatatgcatagaataccccagagagttatctgaaaactgtcagacattattcttaaagactttagctacaagaatttagatacaatataaatagcctaaaaaccagtaacttgatgttgtatcactgatgactgcttacaagatggaaataatttattatcaattaagaaaaaagctaaaacatacccagaaacaatcctaacaaatctgtgggaactttaccaataaaactataaagcttcatttaaaaaacaaaaaactaaataaacagagagatgtactagatgggctactggatggaaacaaatattgtaaaaatataaattctaaatttagagatttaatgcaatcttcagcaaattactagaatattgttaagaacttaacataatcataaagtacatttggaacaatcaaagtagaaagacagctacaattaaatgacattacttttttttaatacaagaaaaaagagcaaagatgaagatatgcaccaagctgataacaatataatctcttgggggtggaattaaaagggtttgatggaggggtgaggctatttctttttttctatatttctttagtgggagtgatttttactttcttctgactgtatttttttaaaaagttgttaaagcaataaaagctgaaaatctagggaaatatttacatccaatataacaaatgtttaatatctttaatatgtaaacatatgtatcacttataataaaagtattctaatagaaaattttataaatattatcaggtaattggcactgaaaataagaaattaaaaattcaatataacaaaaacattttaaaaatagagaaagcttttttatctctgtaattttgtgatttaaatgttaagactgataaggatacagtgagagagaccctcccatgccccttggataggaatgcaaaaggggaaatgaaaatctctgattgctgaatcataatgcatttttactttccttctcatacatttgtggattttaaaaaattctataatactacacattatttctatattaaggaaaataaaaagtatttcaaattcaagaaagttatgttttatgtaaatgcagcaagctagaacttttaaatatagtacttctttaaaacactgctttttaaaatttatttatgagtactgaacatggttatggtctcaatttctctccccagtaagttcatgcctaacattttagtccttgaaatggaaatacacaatgtcttctcataaggatagtagatggtatatatagtaataactatcataacattagtaacgttgcgggaacttttccttagttcagctaaagatgggtgtccacaagaaattaggcttgcagacaatttgaagcatgaggagggcagggttcaaggaaaagagggaaaacagggactctccacaaggccaggggccctgctagggtgcttccagcctggcagattgaatcccaggttctactcaggaagaggagggccaggctcctccctgctgcaaacagcacaaacttttatggctccaacccagtgcgcactcctcccaatgttcaggccagttggaggctctgccagggagcccttcccacctgtctcagtaatagtcaaaatattgaactttatcatatgccggatactgtgttaagctcttcagaggcattagcccagttaatcatcaaaccctatgtgatggatgttactgctttcaccattttgtagataaaagaatcgagggtcagagaagttacatgaatgtccaggatggtgggacttggaggaggaatgccaacacctacgcccagctagatcacttatttatttgctatcttccctgagaggccatttaacttacttgagccaaaaggttctcaactcagctataaaatggaaataataatacttggcaatgttgtgaaacccaaatgatgtactatatgtgaacgcaccctgaatagcaaattctataaattcaaagcataatagagattaagtatttacagtttccttctttaaagtatctttcttattttaccacttatctttgccccaaactttaaaaattgtgatatttcataggagaaattatttttccttattgaatccaatatctgaagctttgtctacccagtgttgctagtcagtgttttattgcagactaacctattaatgacctctttaaaagtaaattccaaccacagaacctgtcttcctgtgtaagactttaggtgcagcaaatcatcatgcatctacagcaagttttccactctatattgctactgccaaagaatctcagatgagatatgagagaaaataaattagtctcatatgattcaaaatgtagtgaacactttgcaaacaagtattttttagcatcttaaataaattttggttgaattacgtctcatttacaatatcacatttcatcctaatttcagttgttttccatattgtctcctattgacttctactccatttctcaagaagagtaaaccttactttaatttatctccgaatagaagattgaaggaagaccctgctataagcatagcgtcctacacaaggaatagctagagatgtaggaaaatttttattgattggaaaaaaaaaagtgagctgacctccaatattttctgttaggttttctctgtaatatggcacaggaaaaaataaataataatttgaaaaaagaggcagctttttcatattgctatggagcaatttatgaataggacataagtccttttttcctcctaaaatagggactttatggggttttcatcttcttttttattagtggttggattatctgatcatttacattataagaaacacacgaaaatctagaaaacattttacattttgttacagatttacaaatagcatgttttcactttcattctaaaactaattattgatatcagaaatttgtatcttacctagatcattggttaacaagacagatttttaattcataaactttaattcttcatatggcagtctgattgaaccaatacattttttaaaaatttatagctaattgaagtataacatgaattaaacacacatagacttcaaaataaagcataaatagaagtgcatggaaagatgtaccgatgattggttcttaggaaattaataataaaggctaacatttgttgaactcttaccaagtacgacctgcagttataatatgcgttacttcttttaatattcacaataattttataattaagtaccattgctactttatagtcaaactattaagtgatttgcccaaggacatgccacaaaaaaagtgatgaagttggattatgcaggcactggtcgaactcaacaagcagtgttcctcacctctcacctacactctgggtaacatttatttttcaaaatcttaactatataaagtatagcaatgaaaaatgaaggatgttctaaatgtaaattgccctcacttaaaagcttaaaaagaaactagctacaatgaaaggagaattcgtatatgtcagcgtgatctagcgcagtatttgtaataaagctgaggtggggggcagtggaataaagaagggaaaatccctaggggaatatattagaattaaaaaggagcattttaatactatgcacacaccacctcccaactctagaatttcccaccagtttttctcctgccttacgtagcctttcaaatactctttctcttcctggaacaccctttctacctctccctcacttcagggctaagttctgcaagttgatctcttctagactatcagaacctttcaagcaaggaccatgagtttttttattcatcttaacataataataagttgtaataattataataaattataataagttataacaacttttaaaactatcacgatgcctcccacagactcaacactcaagaagtatttgttgaatagacaaatatgatatatttcaaagtatctcacagtttgcaacgcattttcttataatacctcattctattttcatgataagcccctatggtgagtatttaaataagaagaaacctgagacacagagaagctaagaaacttgtctagattcacaaatcctgcaaaaaaaaaaactgagactcaaactcatgcctttcagttctgcatccagtgttgtttccctcacagctcagacaagaaattggtcttctggtaaattataaggccttcctgtcatgtacctaatttcatgttctaaaaaattttactacaccgaagtgtttacattccacagaaattttttaacttttcatttcaacttaactgtttattgcagagcgcagtggtagtaaataatagatacaatctttgcccttgagagaacttaaagtttagttagaaaggatcaggaaaaaaaaaaaaacacaaagaactgcaattcaaagcaagaaagacatggtataagagagtcaacagttagttggacaaattttattaggtaattaatctatgcaccagccttaatacaatatgctagtacatgaggaatttaaaagaggggattgtggactcaaaagaaagagatactaacagactcatgggtatggtagaatctgagacaaaacttgaagaactggtttacttttagaagacaaatataaaggtagtcattctgagataataatgagacgttgagtaaaagctacgatgtggagacgtgtggggcatgttttggagagagccagtttagtaagagtgatacaaaaaaaagttctatttcttagaatataagagtgaaatattaggaccttaaatgccagactaaggaattcattcataatttgataagccatgtggagccattgagagttttgagcaggggaatgacattattggaggtggggtttataaagattgacctaccagtgaatacaggatgctgtaagaagctcaaagtagggacactagtcaagttttcaaagataaaaatgataaagtagcatcacttaattacaccattgtatctcagaaaatatttaggtgatctaaaataaacatattcttttagtttattccctcaaatagataaaatgagtttaagagagtccctgatgatgagtttttatactaaacaaaatgcttatttgggtgagagattgcaactcagtatggttaaattagatttgttatttcttagaactacattccctttggtacttgtagagaacttctatttctgatttaaaaagaacacaaggcatatggcaatttttcatagttattacaggtgacatctaaactggcagagtgcagacaaaggaaaggcatataaattagacaaataaaagtttctttagactcatacacaaacaccaacagaagtgtacaaagagataatgaacttgcctaggatcactgcaactgaatgaacaagcccagatatctatcaattccaaaatgtattcgacataaaagtcaagttatgttttttattgctgttttcaaaagcagccatttttaggatatttgtgtttctgatatgttaaccaaaatgttttatgtatggtgtccattttaatggtgtcaatactgagtatattgtgctaataatgaccataacaattggcatctctaaacaacatagaaggtcaacttcattgatttaacttgaagtttttagcaaataaaataggaaagtattttccttgatgctggctattgagtctggcacttactggcactgaataagcagttttttaatgataactatcttatactagagagatatgactttgaaactacgttgtattcgttgaccaaaaaaattcttagagttataaattctgtgaaatgatctagaaaaaattatattgtcaattgaattttggaaatttgtgtatttttttcttttggagatacatactgtgtagtagcatattaaagtctaacatgtgctacctaaaaataaaacctatttaactttctttaacccagtgctttccaaacttatttgaccatgaaattgattaatcttccttgaacatatattcagattccatgctgactttaggaaattttgccagagaacaaggaaagcagcattatataccagagaaatgtgaagttttaataaaagatctgctcaccactaatcccagttcccacaaaaactgctatagtgtcctgtaacctcacccaacacctcaacccaataggtgttcaaatttaacctaagtgtttacaggattttcatagtcctatctaattctgcctcaaaaatagaaaattatctctgattattttatctccccatctctgctgcctccatccgttcattcaaccaaggctttctatgttctgactccacaacaggaagcatgacatatgttgaaatgaactcatgagcagacctcatggtcctcaccttcactaaacaagcagggtagtagaagaaaaagacaaggaaagagcctgatatgtctttgctaaggaaaataccttgggttgtgggaactgccttggtggataaaggtagttctgtgaataaaccaaaatctgaaggatgagtaggtaagagggaaggaagagtttcaaacaaggtctttgtgtgggagagcacggctttatggggaaaaataagtgcagtaattcattccattcatgcagtacagagcctaagggaaaatattttttactgttggatttcccttgtcaggaaagcttagaaacactaagcaaaccctggtacatgtaggataatctggaggcagaatgagtggcatcacacctcttacaagctttacctttggctctttaatcaggtagctacaggtattgggaggtaagggggctgatgctcaattcctccaacccctaactcccatgtcttaagcccagagttgcaaagggtgacccacctacatcataactcctacagtgctttacctctggggttttatccaactttggagaaattccttcatgcagactctgggtcttgattgcaatcatatcttcaggccagagcacttctttattgagatagaacacagctctttgaagtatattcccaaaatacaatatatgttagaatacttctggccaggcctatattgatgtgtttacttcttgtcaaaatattcatttgtctttgaggagaagaccccccagattttgaaatcaatgtgtaagccatatagaagcaaaattagagtttctacaattgaaaatttcagcatttttcacataatctcaaaaataccaaactggcaacattccagtaaaatgaagattaaaatgttttaaaaaatgaaaaactggaatatgttagtatatgcaattattctacatttttgaaaggaaacattcacaggacaatgtgctcatttatcatcctgaccagacctctcccactcttttctctttaaagttgaaaatgctgcaattattctgttatgcctcataaaatagtaaattatctccaattactgtacagtcacagtagcagtaaaaagcttgtgtagaacaacatactccccatagtcatcttgaaatttattagaatatcataaaattataactcagaaaggagtttcaaaaacatgtctagtccatttttattacctctgggcaggactgagttgcacataattccaggaaactatctaaagagaagattcaacaattattcttgttagctagagggttcaatcacacttacatagtgagaaatatttttcctatatgatacatttcttaaatgtttcctcatgttcatatgcagctaaattctcaaaattcacttctaccacctcaacccaagtgaatggcatctgagcaatacataaacaacaaattttacccttatgaacttaggaaaaacctttcatttatttgccacaatattttcattttcatctgaaagacagcactacctagacaaatttttaacccccttaagtgaaatatcaaaaatagtgttttaagagcaggaggtaaccttgcctctgcacaaaaacatcttgttctttccacagaaaccataaagtaagcacagctttcaccactgatattgtagaatattaagtaatttttttaaattataattactaatttttgttgggaatcagggcaatgccagatatcctttgtaaaattttaacacagtcaactgttcctttattgctcagcatgccatccaggctccattccagggcatgcccttccacagtttagggttgctttgaatatttctacaggatttttcagacattagcctgtcaatcaaatatgcagtaagttctcataaaatttctcacttccccacaccctgaaagctataatgagcaaacagagtagattctaatgatgtgaacaagatagcatacaacctttgaacttagatatttgtttgatacctggttctgtcactaactagctggatgaccttggaattatcatttgtcttctctaaatttcaggtaccttgtcattaaaatgggaatcatgatggttgcctcataggttagagtaggattagttgagataattaatggaaaacaaataataggtggtaaagaaaactggccctcagcccatgtttgtagttactatggctgatatttttgttgttcttagtactactatgtctattgggagtgccagaggatgatggcccaaaaagcctaacgaagacatttaggattggtattagtgttcagtaggagaagtgcttggggttttacactggcagggatgtacacaatattcaatggaggaaaagataggtgaaaattaggaaggcaaagtatttcctgcacgtgttggtgaggtgttgacttaggatccacacaaatcaagcaaaacactctcttatttgtgtcttatttcataagtgaggaactcacagcatagggtattaatataacatgcccaacgtgggtgaactaaggattcaaacttcagatttcaaagtccaaagtgaatgctttgttcacttttaccaggcttgccctctgccatttacaagagcagtctttcccatattcttccctaagcagacaacaatttagcccttacctatattgaattctcatagtatgctatactcactttattataggataactatttgctgtattctgtcactttctgctaaattgtgagctctgggaggtcaaggagaattttccattcagctacatatctcagagcctacaccaaaatcctgagtttcacctctgaaggcctgagtaggcaagttgctcctctccccctccagtgaggagggcaagtaagattctatctgggctcctctgaaatccacgagcagctctccaaatagagaagcactgatgtagagattgttgggtaataaaattaatgaggaagccatggtacaaaattttaacacctttcttttctgaactaaagttaaattcttgagtgtaggcgttccttcttgaaagtcctgttactggagagattaatctaccagcaatatacaaagacagattagtgagagatggtggtcccaataaaatcatttataggctaattacattccttcttcactcagttttactacaattaaaatgtaaaaggtctgtttacatttttggtgcctcaatatgtattgagaaatacaatattgttaagcaggttttcactttgcatttctctgctttaatataatgaagtcattatccatgcggacccacaatgctccgtgttaaattcgccaactgctgttctgtacattccctcagccaatttatttcaatttcagaaggagcaaccaactccacagtggatgactgctgactgcagttccacaccatcactcttcaagagtaaactcaaatcaaggaaaaagcttccacatgtgagcatgggtgtgctcaatctcctgttagctgcagccacagtttcaggcctgatagaccccagcttctgcccatggggtgcagagctacagacagctcacctgcctctaccacaggacagatcacaggacaggctgtgtgtgtgtgtgtgtgtattacatcatatatatatatatatatatatatatatatatatatatatatatatatatataaaataaataggttgcatacagaagattttcaaaccaatcattaacacatgtaagagctaggtcatattatttatggcactgttggtggtagccagatatcataaatgcagtgtcataaatacttttgtatgaaattatataattcttagggtaacaccttaaaactcataatttgcagagttccagggttagagcctaaatgttcagaaattttccacaaatggctatcatcaatttaaaatagctatgtttaccaaataaatttgtactgagctagacacgtggattagcaaatctgtagcacagagccgagaaaggaaccccttggtccttttgacctccctgctcttgtctcttattttctctgtttgctgattccatcaaataatttgatctttttagagctgatctagcctgttgtttgacaagacccttttttcttgaactacattatcacttaacccattaccttgtacttgtgaacagcatattagaatgaatcattttgccatttaacatgtgtggttaaaaattattggttatgtattgaactccactaaaactatgattttaatatagaagctgatgtttcaagaaatcagcagtctctactgggttaggtttttcaaagtttgggttgtgcatgatcataaggttaaacatttttcaagtgtaacattaagaacaaatttttcatgtaatttggatagataagtcatttcattcaagtctatatacaattttcttgtgctaatcttgatgtaaaaactaatggtagactgtctttttctgcttttgttgtttaaaatgacagtaatcaagtttaccatctccaccatttaataaagcaaacagcactagtatagaaattagaaaggaaataaaaggagcatttagtgaatgtcagtgttgatctagtcaatcattgtacatgtgttagctcctctagtttccacaaagccaaaatgaagtcgttattatctgagttttacaggtgttaagaaattcaccaaatgtgccctggtagctctttaaatgttgtgttccacaggctccctatcctgagcactctaattttctatggtacataatttacctgggtgatctcatctctttacttggtttcaattgctacttatatactctgattactctcaaatccattattttccactgttacctttcttctcaacttcagatccagatatccaactgcctactaaacatctcttccttgtccctagacatataatccttcacttacccacttttgaattccctattctctatgtttcctgtggttgctggtaccatccagccaaagtaggaaagggctggtcgttttcttcttctccattacccctaatatattcctacaaattttatctcctctataatgtacaaaagcaactagagaatctgtgcctgtcctctccactctcactaacttcttattgtgtctatcatcatatcctgcctgaacttttaacaggtcctcctgccttcagttttagcctcctgaactttgtcctccatactactgctggagaagtcaatagtaaacaatgcaagtatgccattttgctttttaaaaacctttaatggttctccatttcctggagaaaacaggccaagcttcctaacaagtccctccttgatctggttcacgctttcttctataaaactttaccgctcttcagttttttgacccctgacttttttctccagacacacaactccttacatattttctcacataaggtgttttttttttagtcataacttttcttcagctgagaaggtccttcttatctaccctttcactttttctatctaactcctcctcaccctttaagattcagtaaatgtcactatcaccagaaatccttttctgacccagtcttacaaaaatttgtaagggtcttatattttggaatttgttaactaaatgtctagagagttgacgtgacagcaagaaagatattcttgtaaatgaactcaagaaacccaggactcactgaaacaaagaggaacatttcaaatcattttggaagattcctttacttcctgaattaattcataagttgttttttttttctaagctaaattacttaaatagctttattctccccttgagtaaggacagaagctaattaggcattctccaaggcacagatgggaaaaatatcatctcccttcctcttttcttaatccccagtatagccagatgtagtgaaggtcccagctgcctcctaaagacctgctgtggaacaacaggatccaagagactgagggagccaatcaagcttaacatttgcatgcgaaggcctcccagaagcaaggaattcagctccctggctccctatctgttctgctgcttgtgggcaatagcaccacacaaagaaatgggcctgtgcttaggaaaaaatatatatatatttacccaagtcagaatgttcgtatgcggcgatgagaacccaatcaattcaagaggacagagcaattaatttatatatcagttataaaaatacaaattgatataaacatgggaacaataagacactgtggactactagaagggggagagagaaagggaggcatggattgaaaaactacctattgggcactaggctcactacctaggtgtaatattcccatgtaacaaatctgcacccgtacctactgtatctaaaatcaaagttaaaatttaaaaaaaatatataaaaatgcaaaatttgagagggagagctgcttaaaacagcttcaaggatttttatctttcttgaatttctatttagcagtcaatgtttcacactcttagtatataagttatcaaaactaacacattttcagtaaaactggacttcaatgatgtaacttatgcaaagtatcctctaaaacatggtttttcccttatgtagatcagctgagtgaactgtaagcatcaaagaaatctatatgaaaatgtatgtttatcaaaaagttatatgatgtttcatgtgattaaattctaagaagatgttcctaaatgtctcattcttacagctgcaaagcagtgttgacatcatccgatccaaattccctgctttacagctgaaaatccaatgcatgtagcagttcagtgactttaatgatggcacagccagtgttagcctagaaacccaaggtgcctgaccttgaaggaagttcatatgtatacacatatttgtgtatgtatatatatctatatatatatatagatatatatacacacacacatttgtatatatatatacacacacacatattcgtgtacatatatacacacatatttgtatatgtatatatatgcatatgttcatacatctatcaccaatcacatacatatatgtaacctgaatatatatatccaggttaggaatctgtttgtcttccttcagattactcctaacccctgccttctgtcttccttctcctctggcaaacccattttccaatcacgagcatcccattgcccacttacacactgctcaccacccagaatgtagggactgagtcttactcccaagagactcacttcaagccacctccttcccagccattgctggacttggcatctgaatatgttttgttctgcaggagtagatagcctcatatactaatcaagggtgaaagttttctttgtctgtcaggtttcctctaacatcttatgaataatcttaaataaaatgtagggaaagctttcagtaacatcaaatagatctcaaaagaaaggcagactgctattcaacattgctagcctctctctgattctagaagcaaagcctctgaataaagggttcaattttacacttttgttctatccccactcaggacttgctaaccacaatcaccccctcaccccataacctgctcccatgcccatttcttagtgtgggtataaagtcaggccagagacagctaacgagcaatgagtcggctgcacttgcgtactgagccaccagaggtgctaatagacaggaaattttcttattagatgctttcaaaaaataaaattctggagcccaagtattgtctttaatgtcctaagggcagatcttgtatagagaactcaagccttgtatttgtttaaatatcaagaacctgtcaatgtattgaataatatacaaatagtagatgtaattcaatttgactagtgtttattaagttcctaatacaagatagcctgatatatacaaaaaagtgaaaagccctgcttctgtggtaaaggggaactaagaaaagctgaatttaaccacacagattaatgaaaatattctgctcttgtcattgctttcagcactttttgaagtagatgtcttctgtttatcatatttcctggcaagatttataagagtcttcaaattataaatctttagcacatcttgagtaaactctcatttcttcaaactcttcatcactcgtataattagaaataaaagactgtagaaaaatatgaaattcctttgaaagaagtcaataaagagattcatatttcaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaagagattcatatttcaaatgcacatgaacatttaactagttattaaaaatttccaataaattgagctattactaaactggaatatacctaattcagattccaaatgtgatgagtaagacacatttttctggtcaaaagtaagttccattcattttattgcctataaattgagtctggtaagtttgagtgagagatatttgagcattatgatttttaaggtaatgctttgtttccatcaagttcttagtaaataataaattctcagttatttggagaaagatggcttttattttccccatattgcctaagcctccaagttataattctaactgttcatccaacttgctctattttttatataaatgatgacaccttctaagtaaagtgatcattaacatccatcatttttaaaagcagtttcactgaaaatgaagaatgataatgagaagagagcctagttttacaaaagggaattttaccttttctgtggagacaatttctacagtcacccacagaaacttgtatgtttaattcagttatgatggaaagaataaaatatctcttaaaagcttcaaactaatttaccattttatccgcaagtttctagtaggctctaacactaagcaaaccagaagccagtggatttctagacagaacctacctaagtgcccatctatctaaaaatgtgctttaagttgggtgcctcagcattacaattcctatcaatgggtccagtactcggtaacactctgttacatgtatctctaaaaatgcaatgtgtgtgtgtgtgtgtgtgtgtgtgtgtgtgtgtgtgtgtgtttagctatcatctcagaaatcaggtaagcaagtcacccaggaaacaaaataggtaactatgttaaaaataaacacctaatgtttatttcatttggtcctctaggtactaacatcatctccattctaaagatgaggaatctgaggctcatagggattgagtaacttgttcaaggctatgctcttaaccacagcgctgcattcttgtattgaaagcagtttgttaacttacaattcagaaacacatttactgcataaatccaatactgttgtgcatagaaccttattatacttttttcctctggctaaaataaaattgaagcattttacatttccttaattgccagcaggtgtctaaaggttctgttttccattttctggtgttaaacctgaatgagctcaaattaatgattcctgataaatatggaataaacagaaatgctttttaaaaattaacaaatattagttctttatttcattgaccagtaaatcagcaaaaaagaaaaaaaaagtcttaaagagctttactcttccccttaagtgaagaggaggctaattaaagactctttaatgccaataggagaaatatatttcccaccctgcttctgttttgttattgctcttgtgtttttggctaacatttatcaagcacatactatgcgccaggcactgtgacaaaaacctgcatctaactattcaatgtttgtcacaaccccatgaggttttcctgaaataagccacattaaaattgtcaaaaagaaaaacctcttgcaaatagctgatcaaaattcatcctctaaaagctatcctgtaacttacacattttgactctgccctaaacatagccagaagtaggttgcctttcaaaattatgtggcctgccatgggaaaaaattctccagcaccaacatgatgtaattggaagaacatagatgcctagtgttttaatatacccttcgcaactttcttgctgtatgatcttggagacaataccaccaaagctctcagaatcagaatatcacatattatcctatctgaaaagggactatgataccaaactcataatcttctgagattacaacttacgactcttctttggcttgtcgtgaggtagaatatagataatatatggataatctggaaaaaagcgtgcccaataaataacagggtattactctcaccatcatcatcatcatcaccattgccatcatcatcatcaccatcaccattatcatcatcatcatcatcatcaccattatcatcatcaccatcgccattatcatcatcctcatcgtcatcatcacctgatacattcttagattctttgggagaaaaatggtaggaaatgagtagaaaataagactcttccatgtggtagttgtgtgtattgtacatatacaacaatatatgaagtcatttcatgtttggtaactagacaattgtatctctactcttttttttaatattattagtcagatgtccagtccataaaggtttaaaaagtcaagtatggactaatttgagtataactgaagagcttcatttgtttcaaatgaaatgaaggggaaaaaagactggaggaaaccaggaaagaaaggagggaaattgagagatggggaaaaaattggaatgtcaaattttttttttccattctctgctcttgtgggttttgtttggtttggtttggtttggtttgatttggtttggtttggtaggactacagtataacatatgcatccttgcgtctttttatttctcatgacgaataatccatccattttttggtaagcatcttagggctcagcagattgctttatcacagaaggttaaatcatagaatcctcaaaagaatgggtagaatccattaaaaactgtgcaaatggaaaataacgtacctatttatttttctgttttcttcttgctacttcagaactttacttttctttggcaaacattgtaaagaaagaaaaatgttcagaggctgggcgcagtagcacgtgcctataatcccagcaatttgagaggccaaggcaggaggatcactttaacccaggagttcaagaccagcctgggaaacatagtgcgaccctcactgtctctacaaaaaaaaaaaaaaaattagctgtgtgtagaggctcgtgcctgtgatcccagccacatgggaggtggctgaggtgggaggattgcttgatcctgggaggtggagactgcactgagctgtgattgcaccactgcaccccagcctgggcaacagaacaagcccctgtcaaaaaaaaaaagaaaaaaagaaaaaaaaagaaaagagctcagagttctcagcatatttacacaaaatttaaaatataaaaactatatttttcctttgactgctctaatatcaatatgcagcttgctaataggcatatcacattcctgaataaataacattcactcttcctggaacaggtagcccccaagtttcttcatgtctttgcacaaaggcctccttatcaaagaagactttcctaacctctgcaggaagtaagttccccggctcatcaatcactactttccttatttgtttttttctttattttcttcagagcacttcttgcaatgtaacatctgtttatttagtgtcgttctcagtccattagaaagtaagctccatgagaccatggattttctttgcttcactactgtatgtcatggcagaaaacttcagcaataattatttcaatggtaatgcagtgattactgaaaagtgaatattaaagacttatcttctggaagagcaaagtcctaattattaggtatcagaaactgataaaaattaatatcagcacatttaaaatacatagctgatatcttgagtatgtaacccatatatatggccattaataaaagtggtttttgttttgttttgttttgttttgtttttgtttttgtttgagacggagtctcgctctgttgccaggctggagtgcagtagcacgatcttggctcactgcaacctctgcctcccgggttcaaacaattctcctgcctcagcctccagagtagctgggattgcaggcatgtgccaccacacctagctaatttttgtatttttagtagagacgggatttcaccatgttggccaggatggtctcgatctcttgacctcatgatccacccacctcagcctcccaaagtgctgagattataggcgtgagccaccatacccggccaaaagtgtttaataatatgctagaattgtcccttaaataactccagtgaaatagcgactttggaggatttatatatgcagtgtcaaataaccccatttaaagtatctatctggacacctcaaaatggtgttagtaagaattattttcagacctacaataagacagtgtcctagatgtcctggattagtaagtgagcaggtttaaggggtactagagagtagggactcccttattatgtcttggactcaagattgaaattagggtagggtttaccagtgacgtgaattctgtgcttatttgtcaaccctatggtgtctatactgaattcagtaaaactctggctttcaacttgagaattaacacatcatgcttgtttccaattttatgtcattgacattggtgagagactcctatgtaggaccatagcccaccaggaagagacacttgggagtctctggcagcatctctcagcatctagtctattgtctcacactgttaaaatgtgtctccaaagtttcatattttattccacaaaatgaaaacccaggaattatctggactgatcttccactgaaagcagacaagtggcatttgttacttaagcataattttagagcttcactctcttcaaccaggttgctcatcagagtgttcctcccagaggcataaacaagctctagtagatgcaattttctccatcttctaacattccaaaaataaattttagtgcccttcacacattggctttctggcaaatgcctgactggcccacacttaatctgactttgacttaacatagcactggttgcaaaagatgtgaaaaacatgggcagttcttacgaaacagattgtggttctagagcttagtcatatttaagagcaagagttttgaagccagtgtaggtggtaacagccatctgaatgtgggaaacttacttaatgtttctaaagctcagattcctcagttgtaagataggaataatgatagtacctagctcagaggagtgatgtgagaatatgagtaagcactgaacaacgttgtcttaaggcctgagcagaatagtgaacatgaaaatgactatcacatagcagttcaacatgtctgttgttttcatgtgctgccaacatcctgcatttgtgtgactgtttctgtttccagctgtctttatccagccacacagaagacgaaaagctcataggagtcctagaaaacaatggttactttgtctttatttcaagcaatagaaggggaccttctttaggaatgcatgttggatcaagttggagaagttgattaatattgtttaatgttgtttaaattcagctgtttaggaaatggaatgcctgtgctgataataaaaaagatcatagatagatagatgggtagataggtaaataaatgcatgatggatgaattaggtagacagaaaaacagaaacagtcataatatagatgagtggataagtaggtgggtggatggacacagagataaaaacatataagggtgcatagatggataattagatagagagattagatagatagaaagatagcctgggcagagtggctcacacctataatcccagaactttgggaggccaagacggggaggatctcttgagcccagtagttcaagaccagcctgggcaacataaggagaccgtgtctctctaaaaatgaaaaaattagtcaggtgtactggctcacatttgtagtcccagctacttaggaggctgaggtgggagcacctgtttgagccaggaggttgtggctgcagtgagccacagcactccagcctgggtgacagaatgagattcagtctcaaacaaacaaacaaaaaaagatacacagatagatagatgatagatagatacatagatagatagacagacacgtagatagaaagaacaaatcttggaactcccttcctcttctgagttacagctgaacacacttatgtttaaagtctatgcttttcaggcatggtgcactcaagttgcaaggaaaacctggcagattttcctagaacttctgattttgttgataccctattaaaatcatcaacatgcccctgcaaaatttgataaaatcccaatttctttatagaacataaaaacccattactgagttgatgggtgcaacaaaccaccatggcacgtgtatacctatgtaataaacctgcacgttctgcacatgtatccctgaacttgaagtataataaaaaataaattaattttaaaaatccattattatcatacttaccttactaacttctcttcctgtcagttcttcctactccttgagccaagctggacttactggtaattccctgaacacttttgatttctacatgatttctatatgctattcttactagaattttgtgtttgtgtttcaaaaagtgtagatataagacaaaacaaaaaatatatatttatattttatagaacaaaaccttaaagaatcagtgtcattttatgttagaggagcatggccttgggttacagtcccctagaccctcctgatggtatcccttccctctcctttagctttatgtgtactttggtgaaaatttttaaaaatgcgtggttaaccaaaggactgcaataattggtgtggcatgactcataaagcctttgcaatttttgttttattatgcttttattttagcaatgtataaattcatttttgctaatactaaatacacatgctattaaggtgatgctcatcagatgatattttcagcagaaaggctatgagatgcaatggaaaacagaacacagtttgctatgagcagaagataaaaggcatagatgcatgctaagccaaagaaagatcaaatgctcaatagacccataaaactttccctcatgggtctatgaaagagcacagtcaagctgataaaagttatactgaaaggaagagtcactgttgaaagaagatcaattgagtagtgtattgaccatggatgcaattttctaaagctttgtagaaatattgatgtaatctaggagggattactttgcaaaatttgctgtctaattcaccatatttgagtattttaaccccactaagtatgagtgtcagcaaagacttagtacttgaaagtgtgctaagagttcaaaatggttaagaatctctgagttaaattttgcattttaaatcaagagacttaccagtaccttttatcatcaaaccagaaccagaaaatcagggttggggaggaggcggtggcttttaatatagtaaatctaagtataaatgtataaaattccatttaagtcatagtgcttccatggaatgtaaagttgtaacaaagatgattcaaatatgggtatattataaacatttacagagatgtattattttgaaaatggtaaagacctctgcaaatggccagatggagagaattacacatatacaaaaaaagtaacatttttagattaaaagtttgcagatctttatcagaaacctttataaaagcaagtaaacttttttcattgtacataaaaacatggaaaatttgctaagtttcagcaggtatttggggtatacagttatagccaccaaagaataatttttatgctcatctggaaagaatattttttcaggaataaagtgttttttcacagtgagctgtaactgagtgattatatatgtattcatatgagacacttttgagagaggaggtgctaaaacaaatttaaaagtattagttgatctatagcaggctttgtccaggcttttctatgagcaaactggaacacacagttaatcgaggaataataactaccttcttaatatcatttgccatcctatgcattatattgtccaccatctctaaactctctgagtctcaccatcgtattgttcataagcagttctccatggatgtctgtttccaaacatcttgagagcacaggaattgtctgccttgattccagataatatattcaagaaattttgtatggcaaagagctttggaagctagaaatttggagcaaagatcaagtttatttgtttgcatcttttgtaagatttggattttctaagactaggatttctcagttctaacttcaacccattatgtgaacatcatctgcttgggccatgccataattacccgcatgggatttgggacttggggtgtcaaggggaacttgcacaaatataaagctcatgctgcttgttatgtcataaataatttggtcctttgtctttgaaccaggagtctcatgtcttctgctagcctccatgaatttatagcaggctaacttgttagcttacaagtaggtcagaacctcagtcccttcatagttcttaacacacatctacagggcaaaagcaaaacaaataaacactataatagtgatattcaatccagttgagcatgagacagggcattgaacagggatttggaagtaaattgtaatcccactgcattacaaccattttttgagttactctgtgcaaattatttcacttctttctgctactcaatttcttttttttaataaaggaacttctgctaacatgcaaatgtgtgcatgtgtgttttctttttttttttttctttgcccattgttttattatactttaagttctgggatacatgtgcagaatgtgcaggtttgttacataggtatacatgtgccatggtggtttgctgcacccaccaaccagtcatctacattaggtatttcccttaatctataaagtttttttagagagggtggtggccctataaggtctaactctaaattcttaaaacttgttaaatttttttcagtgtttttcataactctgtcccttattccttcaacaagggtttttttgtttgtttgtttgtttgttttgtgtgtgtgtgttgtgataacttaaaaatcagaaaatattacatatgggaagctccttagagatgatgtactttagggacttccacaattatgttctgatcaatcctaggtttcttcagagaaaattttgggtctctgaaatgcttgattgaactttaattttcatatacaatttaattaagttttaagctaataagacagcatgtataatcagatgtgttataagccaagtgctaacacatagaagaccatcaatgagtcaacttatatattcactgacattaaaaatgcaaatgccataaaattcaatttctaaaacaaatctatactgataatatatttattttgactgtttttctatggaaagttaagaacaataaatcactttgaacagcccattttacaaatcagaaatatgaaaaactaataggaatatgagtatgatgaaagaatgtggttaattcgagtaaagagaagacagaggaggcaggaagttagctatacatgtatggagctatgataatttagttgaagttttttattccttttgagttaaggatcacgttttgtttcttttgagtttctatagttaaatgctgcaataccatggagtgtggttaaccagagtgagttttcttcctattagaaattgttattaaagactttgttacaactaaacagaaaaaataaaggaataatcccattaaaaagtatgcaaaggactaaataaacatttctcaaaagaagacatacaggccgagagtggtggctcacacctctaatcccagcactttgggaggccaaggtgggtggatcacgaggtcagaaatttgaggcaaacctgaccaacaaggtgaaaccccgtctgtactaaacatacaaaaattagcctggtatggtggcacgtgcctgtcgtcccagctactcaggaggctgaggcaggagaatcgtttgaacctgcgaaatggaggttgcagtgagccaagatcgcaccactgcactccagcctgagcgacagagcaagattccgtctcaaaaaaaaaaaaaatgcaaatggccaagtatatgaaaaaatgctaaccgtcactaatcatcagacaaatgcaagtaaaagccgcaataaaatcatcttaacccggttaggatgtctgttatcaaaaagacaataacaagggctggtgaggatgtggaactctcatacattgtttatgggaatgtaaataagaatagccctcatggtcaacaatatggagttttctcaaaaaaaaaaaaaaaaaaaaaaaaaaaccctgaaaatagagctaccatgagatccagcaatctcaatactgggtagctatcgaaatgaaaggaaatcagtatatcaaagggatacctggattcccatatttattgcagtactattcacaatagccaagatattgaatcaacctaagtgttcatcattgaatgaataaagaatatgtggtatatatacacaatgaaatactatatagccataaaaaataataaaatcctgtcatttgcagcaacatggatggagctgaaggtcattgtcaagtgaaataaaccagaagcagaaagataaatatcacatgttctcactcatatgtggaagctaaaaagtttctctcatggaggaagagaatagaatgatagttactagaggcttggaatgtggtggtcagggtgggatgaagagagggtagttaatgagatagatagatagaaggagtaagttcttgtgtttgatagcacactaaggtaaccatagtcaagaactgtatattgtgtgttgtatatttcaaaattgctagaagagggtcaggtgcagtggctcacacctgtaatccctgcactttgggaggccgaggtgggagaatcacttaagcccaggaggtcaaggctgcagtgagcctagatggtgccactgcactccagcctgggtgtcagagtgagaccctgtctcaaaaaacaaaaaaactacaagagaagatttaaaatgcaaagaaaagataaatgcttaaggtaatggatatcctaaataccctgtttggataattataccttgtatgcatgtatcaaaatatcacctataccctgtagatatttacaaatattatgtatccaaaaaaattaaaaggctttaaaatgtacatttcttccttggcattgctacctctaatgatgagatgacagacctaaacttgggagaaaccaaccagaatgaaaaagagatatgtataaaagacaatatggaagaaaaaccacagaacttaatggcaggtacaagtacaaaaaaaattaaactttgctcttgcatcctggtgactgggaaatgattatattgttgacagaaatatgaaagttgaacagagcaaccggtttgggaaggaaaaaattatcaacacaatttcagaaagttaggagtttgaagagatagcagaactcctgctctaaatctccagtgaacaggtcagaattgaggagaaaggcctagatagaattagagatttggcagtcatctgtgtccatagattgcaggcttcatatatcagattttatctgttattcttgaatcttgaagtgctggtcatgtggcaattttctgccactctttccaataaaaagtccatattctgatttccctgtgactcagtaaattgcctcaaatctcatacactgtttttcttgttactgggtgtcaaaccaaatctgcctttactttaagtgtaaaagttttaaaactatgttgtgtatatgcaaactggataattacatattcatttactgagaatatggaagcatggaaaaaaactaataaatcattttcctcaatcaatgtaaggaatctaggtttacaaaggcatatttgaattactataaaagaaaaggagacctgacaatttctgtttgattgtgagatgtatagcatcatcaaaattacaaggtaaaagctgaggaacatttttctgaatgcttgaagaattgactgggtattcagcagaagctgaatgaaaatgtcaggctaacaatgaagattttgtactttatcacaccctgatgactggtacatagcaagatttgatcagtttcataaaagtaggaaattgaactttcaaagacatcgctagtactagaatatactagaatgctcctttagtatgcattcaagttttttaatagtatgttacttggttaatatttatgtctgtctcatcccttaagtctacctacatttaaattttatttcttggtaagtataaaattattctaagcttacctcagacactaacaaataagtaacaagggctcgatgggtatcaattccatgcctaacacagggctgggcattatgagaagtttaagacattctaatagagtagaatggtggtctccaggggccacctggagatggagaaaataaggagatgttggtctaagggtgcaaactttccattataagatgaataagttctggggatctaatgtatagcatggtaactatagataataatattgtattgtacacttgaaatttgcaaagaaagtagatcttaaatgttctcaccacacacacacacacacacacacaaatggtaacaatgtgttaactaacttgattgtggtaattatttcactatatatgtgtactaaaatatcatgttgtacacattaagtgcatatacttttttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccccatcccacaacagtccccagtgtgtgatgttccccttcctgtgtccatgtgttctcattgttcaattcccacctatgagtgagaacagtgcatacacttttatttgtcaattatatctcaataagggtagggtgggaaagtgagccaggacttctaatatcctgctagtcaatgcatttataaaatgttatttaattaccatgttcctattgtaaagactcagtttcaatagttcataaattatttattcattattggtgtccctgacaagataaataaatatgaaacaggcttgcacttaagaggggaaaagcctatgaaaaaattacaagctacttgggaagccttttggatacttgtaaagtaggttactccagatttattctgtgatgaggaagaatgacagacttggatggtttacaggagcatcttgctttcgatagtaaaaggcactcattggaacatcagcttattcaactccatgcctttacttttagggccacaggaaacaggggtcaatgatggtgaatgcgtgctttttctcttgacagaagtaggaggattgaaagattctggtgcccttaagtgtggttgaatttctgaacaaatatgatccttgcaagagtaattaaaataagctgctaattaaaagcttttgttgtttaaacttggagaagcaaatcaaagtggcaagctttcactccaagtcaactcagtgctctttgactcccagaagggcagcttgagacaacattgcctaaaaatttcttgaatgcctgaaaggagttgggttgagttcagcttagaagtttagattggaaaagatgtctatgttagaataaatcgtggatttttagatttaacatttagatagaaaattacttaattttgattattctaaaaataaatctaccattccagttagtagaatagacatcctttcagctaccatctattgaactcttattaacagtctggcacctggtaactgcataagcttagttaaatctcacagtagtattatgaggttgataatttagttatcccatttttataaagaagggaaaaataatgaagatgttaagtaacattcaagattcattagctcacaagagtgaggctggaattggaacccaatgtactgaccccaaagccatcttctttactaccatattttgccaaccttgaccagctgtaaacttgaggaatcccatacgcatgtgctgggtaaaatagtttccaattacaaaaagacttctaatctccatttttttgtactacatattactattatactattttctgtagcttctaacaatatataatactctaataacgacattgtaattattaataaaaatgactaatgcaactctgtaattttcacttttaacatgttacctaaagcactttttgcttaaatgtttcttcttggtcaataatttattgctcttgctaaactgaaaaacaatatgtttgatgaagttatttcatgtaaatggtaaatcctttacatttagaaaaaaatcatttctcttgtgtttttcattaattataatggcagtgatcaattttaaatatggccttacttgcatattaaaattgatttccttcccagtttagttctgcaagtattacttatttaggaaacaagaaaaattataaaatgtttttactattccatgtttgcaaggtatgggtagttatttctatgggtcagatatttgttccaaaatactattcctttgcttccacaaacacaataataaaaacagttaggtctaacatttattattcaataaattgatatgttccaaatactatacttggaactttttttttttttcctccccaagatggagtttcactcttattgcccagcctggagtgcaatggtgcaatctcggctcactgcaacctccacctccctggttcaggcaattctcctgtctcagccttccgagtagctgggattacaggcgtgcaccaccacgcccagctaatttttgcatttttaatagagacagggtttcaccatgttggtcaagctggtctcgaactcctggcctcaggtgatccatccaccccaacctcccaaagtgctgggattacaggcatgagccaccccacccggccagaacttttttatacttggaactttatatctattatctcattaatactcacaaccatcctataaagcagctgacattatacacaataatacaagagcaatggggcttagataagttaaataactctcccaagtcataaattagaagagacaaatgattttctaaaaccaagactgcctgcttcctagtactaattttttaccctatcaacttgctgcattcaaaatacctttgaaaatattaaaaattaaactataagtataaaataagaccttgagttcatttaatatttggtttattcataaacattttaatgcatatttttaaattttagatgaatagaatttgatttagctgtaattctataatgcatttctttacataattggtatcatgttaactctttgttagccttgttgacctttcctagcactggtattcatgtatatgagcctgcttttgtattgacagtggatatttcttcctttcctctttctctgcacaaatttctttgctgtcatgttgttagcaaatatttattccattcctgcaagcagtcatgcataaaaatatgataatagatattcatgtcctttcttaaaccccagcacatacctacttaaccatcacgtcattcaataatacttatttcaccatgacaagaagggcaacataaataattaatattgatttccctgatcttgcctctaacccatacagctttctcaagtactgattgatagaaaaatactttacctctgaagctgtctgacatttaaatatttaactcccatctcatagttcatgaaatattactaaaatacacagaaaaaactacttaaaaagcagtaattcaaactaaaaacttgagaaagcaactgaaaccaatgaaatcatgtatgatttttaaaagatacctctagaaacttaaattcagggcatcaaatttatatttttaatctccatgaaagaggcaagaacattattgctatttagtaatgcaatattaaatgatattttgctgcatttcccaaaggcagtaataactattactagtagtttattggtttataaaaaagtactatcttaattcataaatagattactttctctcacttctattcacctcctgcctttgacccgtcagctctgcaactttgggtaaattacctctttgagctttcctcactttatctataaaatgtaatgcaattcacaggattaaatacaaatacacatacatattatttgtgtgtgtgtgcatgtgtgtgtgtgcatgcatgcatatgcataaacaaacgatgcctggcatacatgtagtaggttctcaaaaactgtgagtcccatcctttttttccctttttgtatatttacatgacctacctgtgtacacacctagttaaataccttatattttgcaaggctttcacatatggtggggccagggtgaggcaagtgtgccacttgccttatgcacaaaatttaaggtggtaagaaaaaaactcagtaattaaggtgaaataaaaatttaggcagtatttttaaaaatcagaatttatccaaaatttcctgatgaacaaaacctcaaaatattaaataaaggcaaggtccacaggactggcatttccttcgcctcagcctccagtgtggcttagcccagctctgctttcaccagcgttgcctacacatgtcccgtagctctggcccccacacagaaacaacatccaagatgtctgcgtccttagtcgcaggcctcctacataaggcagctcacagcctcattccttattctcggtttgaggttgaaaggtttaaatcttgaatttggagataggaatgaaggcaaaactcaagctgagaatttgagagaaagcaagaatgagagagtatagaacgtcacaaagatctagcaatgagggagcttcattctgaactcaccatgcttgaaaggctatagatgagcactgtctgttccctcagtctgcatcagcttcatccaagaatgatttttgatgatgacattgaataagtatccatgtttctgtaatagttttaggaagcacaaaatgaacttctggttcctcttaggcttataaatataaaggagtattccatagttattttatcttcctattggccttgaaaaaaataccctattagttatctaaatcctcatcatgtgtaggtgtagagtcaatgttaatggtactttttgataaataaaaatgatgacatcctccttctataatacctattcccaaatatttaaatacgcttctactaaaaccaaatcatagactaagttggagtgcttggtgttacttggttttgatttgttctctcctgagacaggacacatttttgtctttgatttaccccaagagaaagaattgtcaccactggataacccagtgagcagaataatcaggccactgagcagaatgagtgagtcatggtgtttctagtcctccattaccaaattgtgcacaaaatatatcgcagctggtgctgccacgtatgcagcattttaggtgggctatggactgctgggaaaagaccatacaaacctatagaaagtccctgatttatttaacaagtatcctgaaattaatggaacaggggctctccacagcaggaaaagataggtagtatatggcctcccctttgcccctgggctcccagaggggcacacagctgccagaaactcgcttcatctgagaagaccatgctaatgttgaaaatatagccaagttcttgctatgccacagtcgcttaaaatatgaggcatataataaccatataatattccagtggcatttaggctaaaaatctgcatgcttccattatagaagcatttacaaacttcagactctacaggttcttctgcacacaagaatcccatatcctcttctggtagataacgcagaatcatgtttccctttactgcgtatctgcctttagaattcttgtgtctataaaaaactcttttctaacagaacactccttgatacagatttagtatgcctttacctaggtgctttccgtatatagtgtgatcttaatagtcacttctctgaaatatattgtctttactgtgtgcaaacttaagtatttgttggggtcttagatcaaatgaatgtgttttaatccaggcctaactgactataaaagaccgtgtgcttcgttaccatgcagggttctacagattgcatacatcagaatcatctggaatgcttatcagcacctcattgcatctggtactgaatctttgtctttgggtatggggcctaggaattgttagttttacaagctcctcatacatgctgaagtttggaaatcattgctttaatattatactgcatcctggttgcactgattccttcacaatttgaagttcttgttgtcttaggaagagaagcctataggctaacagattgccagcacccctgtgaccattactgtttgcttccctcaaaaaaaccacattgttgattggcataagtcctctagtcactacctcaccctgagctcagcttgccgacatctgaatgaactggcagtcaaagccatacagtgccaagagagttagcttcctaagagttcctcatgaaaaatggaagccaggttttgccccttgctttctatcttgaattttgttaaaacaaaaactatttttatctgtggaaacaagcatgtatgccatctgttttctttgagatatcaaagttcagtattgtttttaattcagcaacaaatatttattttgcccttccatatgatgtttattcatactcgtctccttcaccctaccagctttatctgattaaattcagtctatacattggtacattaatattgtctgttaatttttttcctaattaaacctaaggaattgtatattttaatatactgtgacactctatgtattctttatttcttcaaaattatactcctttggaaatgtacaaataatgcgtatttgtatctctgccatttcttaagcttattatttaggcacataatatatataatattagacatgctggtttaactaaaataagctattcattttgttttcttccatttatattattgtggttatataggttaatatatttgaaaaacatgagaaatatattataattaaattattttgaatttcatagtccaaacaagtaaaactaatgttgttctagcactgacaatgagacaaagaggagtcattgaataattaggaaaaagataaaaaatatctagattagcaatgattatttagacatgaaaaacaagatgatatctactaaaatgtatataaactgatattcagacatattccacttgtcataattaatttgagccttgtgtatgatattcattgcttctaatgctcccacaatttttttctgtcttatggagcccatattttctaagaaacgtcatagggccataaggacaccttgccttcagatgcataattcattaggttaaacagtgtatgtcattggcttgggtttctttcttcagggtgctgcccaagtgcatcagaaccctgtttaactggcagcaatttgagatgcagaattagcatattgtttcttggggaatgcccttgaatgtgcttgagtagcttgttgtgtaaggcatgaacagaattgccaagagccagggaagaaatgggttccaagcatcatgcagtaatcctgtgtgcctgtgcatatctcaagaaagctcctcaggaaatgtcagatcattgctgaatgattaacgcacagacattgcagaccagagttatacctggggactcacagctcactcatattacagcacacctgtgcaaaattccaaagcgagggatccctgtggtgccaggtaagcgtctcaccttcactactaatgctctaaagttacagctgagaaattattgagaagttaagctacaactttgctacaacttgaaaacttacatttttcacctttgtggggatggagcttaatatatttgtgtcctgggagagacaaaatgtagaaataaatagagggctggcttggataaagtatactaaaaatgtgaccataaaaagatgtaaagaaaaacaaatcaacttccatgtggaccaatcatgagagcttagaaatacgactttttattaatctcacatgccaagaaaccatcccttactaaaatgatggaatggaatatttccatttggcaaaatgcttgcaggtgaagcaaaatttaatcaatcaaattcaaatattagtaaaatgaggagaaataaactctaggcaattcataatttcataagaactctcatttgtcttttgagcaaagaataaaatagctatcattgcttttaatcactggagaaccagaattctttttagacttccatcacttactgttgaatatgcttgtgtatgagtcctccagtgttctgaaccagagaatagtttctttatgggatttgtgtctgctgcagaatgcttggaggaatatcatttttgcttgcagaaaattgaaataggcatggtctatgtctcaagtgcattttaaagtaggaggtcaagtacaactccttggcaagtgagaagcagacataataacaaaacttcaaaccctagattgtcttcatgtaaccttgtgggtctatgattctaagaaaatcctacatttaaaaaaaagatgggtgattaggtatagagagcaatatacagttttctctgatgatactccaaaaatggattcttaagaacagaccctgttaagatctttccatgttgctaggagcaattgttaccataggaacaatggtactagtaagcatcatttatacacacataacatccaacccagaaagtgatttaattaaattacctttacaattatatactgttgtcttttgcagcgttttcatgtgtatagtacaacttattaggccctcttttaggtaagcttatgtaaatttgctcactggtaactttcactggtttatatcctcaaccattttgttacattgaagtttagtctttctttggcatagaagaaaaaaagattcaatattctgagctcaattgtcatttttgtagggaactttgagtcacagcagtgatgggtgctcagccctgatggggctgctataatcaaataagaaaatcaaagaaaatgttgacactgctgcagatttagattgtgcttcacccacaacccagtcattttatgttgagtattattttgaaaacataaaatcagaacaagtagtcatcctcaaattccttaaaacattctttttttaatttttcattaaaaatcacattctctgatgaaactgaaaagaattcagctcgagcaacgttggaaaatgctcctctacttccccccttaaaagaatagttaattagactatattacagatactgattacaggcctgtggtttgctgttgaaagaatatgctagctcaggttacagatctttctaaagccgaaagaaagaagtatgaattcaggttgtaaattgttaacatattgccagaaaacaaattgggagatgcggtcctctgctgtgatgtggatttgtgccatgattgtggatttcctgaaatactcttaagtagagagtcttaggtactggggaagataaagcacaccacacttgactgcaacaggcttcagctaatggcacatccatcctcacctccttgatctgtcatttcctccaaaattagctcatttagtttacaatgcatcaaattacttttcagtctctatcaataaagtgtgccatctattattacaactgtggaatatactggcaggcaccagacttatttctcctgaatctcaaaagtggacaggaaaagcagagtcaataacacctattagcaaggattatgcattcagcagtgtatataaaatactgggttctttaaaatataatagagaacagagctatcagtcccagggctcaaatcccttccctgacatttttcagtaagacgcttccttttttaccccaccgcccagaagggcatgtctcagcagtttcctcagcccacattgggataagggaaagaggcttctgattttctgtgcaaggaccctttccaagagcatccagatgccaggcatccatggcccaggatgtacaattcccatttacaaacaaactgggctagacagcaccaggaggtagatggctcttgcaacaagacccatcatctgggtcagccagtgcaactattgacccgacactaggaagaccagaatacctctcaaacctcttcacaccctggctcatttcgtttaagagacttatttcccaagaaattggcgtgggataagcttctaataagctttcactttaaattaccaataattctgttttaccttttcaggggagaaatactcttgaatccatctgcactgtcaaaatcaaaacactgtttcatcctatttagctatagcctgaaggcactttctaaattttgtgtcatgttagtgtttaacacattcagagcttggtaccctcagtaacgaagagtttcagagtctgaccttgccctggacaatttgtttttttcctacaaacatcatagaaagagcaagaaccttggtattagcaactttctaagcttcagtttacctgtatagaaaataaagaacatcactttactccataatattggaatattaatgaggatcaagctagataatgcatataaaagtacacaggacagcatccaaattactactcttgttcatttctactcttcccttaaatgctttagatggtaacaaatccacttaatattctggaatgtgtactatacatgcttaataatatattatctaattttataaatctctatagctttgactcatcttgattaaaaacatatttttctaattttatttagaatattaacatttttaaaaaatatgaattaacaacctttgtcattttgttatatgtgaattttaaagatcataatcttcataactcatcagaaatatttaaattaatatttatttttatctgattctttctatgactttaataattttttatctaattctttacatgcaataattagtaatagctaacaagtgtatggtatgtatgcttacaatgtccaaaacaccatgaccatttttaatgattttacatattaaaatttactactcatgacaacaacccaatgagattgacatcattaccaacagcctagttttgcaaatgtgtaaattgtggcacaaatgttttatataacttccccaatataacacagctaatttttcaaacccaaatagttggaccccagaacccaagatttaaacatagtggtttttttttttttttgtttgtttgtttgtttgttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaaacatagtgttttaagtcctgtggaggagagggaaaagcaaaaagctaacagcacaacaacaaaacaaaaaccacttcagacttcaaggagtttttaatcatgagaatgtacagcctgtgtcctaaccatctttcagccctaaacatattcccacagacaggcagcacattcatacaccctcagacaacacactactccgtcctcacactttagagtagaacgcaagttacaagacaatgtcaattaatgttgttgtaggaaacagtccattggaaggactggaactgtcagctgtatgtcaggctctttccctgtactgtctcattcaatcttcgtcactttagagaaaactgaggcctaagaaagttcattacctttctgaagaccacacagataattatgaaagttttagaattcaaccctcattctgacttcaaagcctacaacaccaccacaccacagtacagaggccttaacccaaacttccagtttgagaagacaatgctttgagtagtgtgaaatgctaatcttctccagacattcacctcagaagccaggagacattaataattaaacaaaaaggagtgtctgtacttcaacaattctggaaaataataaactttaaaacatgaccttatgaaatgatatggtagaagaataaacagaggccattgaagttcatcaaaggatgttttctgaacgtttttagatctgacctgggttttaaaaaaattgtgtaaagtgtctacaaagtaaaggagataaaaggctaaacagcatatatctactacttttttttgagatggagtctcactctgtcgcccaggctagagcacaatggcacgatctcagctcactgcaagctctgcttcccgggttcaggccattctcctgcctcagcctcctgattagctgggattacaggcgcccaccaccatgtccggctaatttttgtatttttagtagagaaggggtttcaccatattggccaggctggtctcgaactcctcaccttatgatttgcctgccttggcctcccaaagtgctgggattacaggtgtgagccaccgtgcccggccagcatatatctactttaaaaaataaataaatcttcagaatgtacacattgtttgtaaactgaatctttgtaatcattaccaaaaattaagctgtctactcttcatatttgctctcttcctccacctcttagctaatataatatttattcttagctattatctcctttattttctaagtatatgaaaaggaaagacaggcctttagaaaatatattcttagtgttcccctaatcacaaactttcttgaaaattaaaagacaaagaaaggagctgaagtatgtttaaggtgtacagcctattttttttctagacttacactgatttttaaaatatttttgtgaattttgaaactgggggaaaaagagtgttacaatgttcgttacaataattgtaacttaaatttggacaattttaagtaggctttgtgaggttaaacagtattaacagatcttaaactcaaaagtttgataactataactacatttcttacaatacattcagtaccaaatgcaagtagctaataattaacttgaacagtcccatcacaatgattaaaaatatgtcaactgacacaaaggaactgttatacctaatgagttcataaaagtctgagattacctacaggaagaaatatgaaatatcaatcctgaatattttaatgttttagtatttgtaagtcagggtgagggtcaaacgtaaaatttttcaaggatgtataagggaatttgtatttggtgaaatagtaatgaatttcagcactaacatataattggtttgaaataggaagttttgatgccacatctggagaacagaataatataatccacaacaggtagtaattacttactgaaggtaattgtaatgcagcttgagttgtaaacattaatgaaaaaaaagatttctaagcaaataaaatctcacgcatcaaaaagacaaaaagtttgtgataaatggttcatttaggcatgcagtgctgtgtgggcaaaattggattgcaatcataggcatttcaaaaaatgaaaacattaggagaaaagaaaattggacagaaatggcagggaaattacagcctttgatccattccgaagaacttttttttgaagcatcattatgagtgggcagcaaactccttccaatcttctgttaaaacttttatgaaaccctggagaccacaaggtaaaaataatcaatttaggacagaccatggaaatatttttcagtgataatctttttttcccgtaaaattgtacaaaactaattccaatgttaaattgctatctggtcttgaaattgacacttttaatttcaggagaaggtctttcctgaatcatttttgacctcttcaactaacgatcagttattagacacatgcttcacggtaaattatatggagatggcacaatttcacaaaaataaagagtattgtaatgctcttactgatatatcattgagaatatcatgggtccaagaatcatacctttaataatcacaccttgaaacataaatgggcactatgctatggaaacagatctttggctattgtaaataatgcactatagtttccaaagggctgaggtgctatatctgtatgtgcaaaaacttaaattaatccctacagctttgaaacaatgatgatgatagacttgttcaattgctattaaaatgtctgtaatttgattgtaaaccattaatattcgagattaccgattggctttccttattaaacactggtaattagtcatttcatgaggatttttgacctttattgttaaatctaggtttttaaattagcgtctcaatatcgtttaaattagttcttgtatataagattattttaagttattatctttggaagaatgttacatcctaaagttaaaaaggagaattactggcaaataagtataagaacattactttatatttgagtaaatagtagctttattcttctgagagggctgtttaaatcagatttacaatgcctgaagcaaaatctagatttatttttttactttatttgacttgactacattctgttttcattaacattttctatttgaccttttgaattatagaccccttctaacctaaaaagatgttattatgaaagaagaatgtgtttgttttgtatctttgaaagtgaatactggttttattgctatttgaaaatattacttaaaatatagggaggtgaaatttcaaatgaaatgactgaaatatgttttttctgtcaagatttttaactcaactatgggtaaagtagtttctaggatttattaatctgcaagttctataactaaaatgaatcatttgcatgacacttttaaggttgtaatggtaatttttctaaattatccctaacaatgtttagcatcataaaatagtttcctaaatagcctttttcttaggtcattgtaacatataacatatttttttaatctgaaagagatgaaaatccttgcctttgcccttgaagaatccatactttatggaaaagattgataagtgataaatttaaaaatagggtgatgagtgctgtaagggaggtgcttaaacatcactgcctcagggactgctagactagattatatcccctgtgatagactgccttagcacactgaacttcccctgttaaaatgatccacattctacatggcaattacgtttttcaaatctgtattcataatagaccataaactctacactggccccacaccttctctcttgctcactatagtatcttcaatgccaagcatcatttctgacacatagtagctgacttatacatactcactgaagaaataagtaaatgagggtgaatgaatgaaaggtctgaaacggtgttttgttatgtaacccagattagactagttttgaattttttatttttaatttataaatagtaattgtatatgttgatggggtccagtgagatgttttgatatttgtatacaacatggtataattaaatcaagtaattaacatatccatcagttcatattctagtgtttcatggtgagagcatttaaaatctactcttttaacaattttgaaccgtacattattactaactgtagtctccaacagatgaataaagaaaatgtggtatatacacacaatagaatactattcagccattaaaagggaaattctgtcatttgcaacaacatgaatgaacctagaagactttattctaagtaaaataagcaggcaccaagagataaatattgcatggtctcacttatatatggactcttaaaagtcaaactcacagaagtagagtaaaatggtgtttaccaaaaggtgtattggagaagaggggtagtgggactttggtcaaaggatacaaattacaattagacaggaggaataagtttttgagatgtagtggacagcatggagacagaccatagttaataataatgtatatttcagatcagaccatttttaaatgggcactgaactgtcataaaagaaattccaagtgaacatgatgaggagggcacaaaaacaagatgatagtcatgccaaggtgcagaggtgagaaagagcacagagcaagttaaatcaactgcaaggaatctggaatgattgggcattcatagaatagtattgcagaataattgcttaagatattatattgtattttgttgttgccctcctccatttcgagcaagtaacccattacttgtctaaaggcattttcttttcagagaagaaaggagaaacagccaggagtcattagcagttcttgttttttatgagagtttaaatgtattgaagagatacgttaagtgcctagaaaaaaggaaaataaaggggagcatgattttgaggacaaggagggaataagaagagcgactcctcgagataagaaaggggagctagtttgtcaggaccgtaagacaatggtaatgactgtgccacagacccagaggctgctggcttcacctcagagtcctgtgtcccaatgacagaatgaagaaaagggaagatggggtgataaacctattgaagaaaccacactggctgagaaattgggcatgtcagaggtgtcaagggttggcagaggaattatgaccagaggaacttccattcctgcttggcattcagtaaattcctgggacttcggaacaacctggagattataaagttccatatttactaagattgacattcccacctgccaggaagaatgggaacttggagtcagttttaagatgatttatgaaaataaataaatgcagtagttttgtcatttgaatttgcaacttgaaattcatatgtgctacctaacctagaaagacaggttagaggcacatcactgaagggatcatatatcaagctaatacatttgaaattgattctgaagagagtcggccattaatggtttttaatcaggagaataataaaaaacatcaccctaatgatgacaaaaggttggactggacagcaacaagactagtgggaagttgaccaggtacagccaatattgcagtcgagttgatgagctggaccaaagattatgagtatagaaaggagctgatggtttgagagctatttaggctgtagaatcaccttgattagatgtctgtggtgaagtaaaaacaaacctcagagcactcccaagttcctggttcacagcagggcagtacagaggagatgtaatattatcatttgtcccaaaaagtacgagggatgtgctgacgagagaagggagaaaatgatatggagttcaggagagagaaattgggggcttatcagcaaagttgaatgtcaaaccacataaaagagacatggcccagaaatgtatagatagtaaaagggctgagaaaagaactgtgtgtattcaggaagtttcaaagaagactgaggaagagtgagcacaaagctagaagaacagtagagaatgatgtcacaggagaagtgagaggagaaattttctggaaggagagattagtcaactgtgacagatactactaaagggagagaaattaaaataaacttaggaaatttgaacgataagactttagatgacctgcgagaaaagaatgtgcagatgtagggggataatgtggaaaccagacttcaatgggtcaaaaaggcagttctaagtgatgatgtagatatgttacagaatttgatcaggaggagagagggagatgcaggactctgaatggtttttaggacataggaagttggcagtggaaaggagtgagatacaaacagacatacctcttctattggcatggaagggtggttggaatccttatgaagtgagaatcgttttgcactttgtatagggcagttagaagtggaagaaaagtgccagctatcacggagattgttgtttgtttgcctctattttctgaagggaaatgtatgagagaggaattatctgttatatgaggaatattatgtgaggaattatatattcctcatataatctcatattacctaaatatttatccattatatctattctatgagaaattgtgtggaggtatctctataaaatgagaaaggaattgtatgctgagagtgaggacacagcttggaatattaatggtttagaagtaagcatagtaagtatttgaagaatagaatggaaagggaagcttgactagggacaggtgaaaggggtattatagaaatttttgctaggagcaaagctttcattttgggtccaaactatggaaactaattaactgatgatgcttcataaaaagcaagaaaaatgtaaaaaaaaaaaaaaaagtaagagaaattaagacctaggagaaaccttaggttttacccattattattatccttctcatttatataagaaaattattacccttctcattatatataagaatattcaagaccctttaatttaaggtaagctacattaatcttgacaataagctataagtgcctatttcccaagttgtcatcgatgaccaaaaaacaaccccaaaaaaggcattaaactcaaaaggaaccctcactgggagaggttgagggaaacggggctgagttctagcccaagacataggtatttccaaaattatttaatttcacaggtttctcagcttttgtcatctggaaaataaaaaccttaaatttaatagtacttatgatctctataatcaattggatgccaatcagatcaaattcacctggtttcaaatttaacaataaacctatgcccctagctagctatctggaaaattgtaggtcggaagaagagccattgaacatgttagaaaactctgttctgtttcactacctaaaagaaaaatcgagttacaattttgatggtttattggctaccctaatgcaatctatgttataggatggctgtggttaaaaactcagttgatgaacaatacagacacattaattatgactggaaaaaataaacataagcacagaggatataatgcattttgtatgtaaattatcctgccttatgataatcaaactatgcagcaatggtaacccttcttactataatggttattttcaaatgcttttacttcgttaagtggacttcatagatgataatctctgacataaaaatcattcaattgtcatcactatttcttcagaaaatttgaaagttcataggtctttacttaaaatgagtcattacgatggtgctatttttctttctactgtttgtctgcccatgtattcaattagacatttgaggttcagaaataaaatcaagttgaatgtttatcagttggatataaaacatgtacccacatggaaatcactgttgctaataatgttgtctctattttacagtcagagaaattgacattcagaaagattaaagaactatgaaaaccaagcagattttagttgacaaatctgagaatcaagcccctgactttataaacttaaagtccattgatgtccactctatagcttagacttcagatacattctgccaatcattagtgtgaagttaggctgagacctactagctcatgttactactaacctgattcttggttaaatttctgtggtgtatatcagagttaaatattcacaggtatgttaaagagccactgaagagctcttcagaagctcttcaatttcagaagctctaaaatttcagaaatcacaagaaaactattattttagtttagttaaatgttaccttaaaatattggttaacatgtattgagtacttaccccattgttatgagaacattatgggtaggaatttatttaatcctgaaacaactctatgacataggtacgtttttttctccttttttttttttaataaatgagggatctgagggacagagaagttaaataccttgacaaggtcatacagcttgtaagttttggagctagattaggaagcagtctgaccccagaatctatgctttacaccactgtcaggtagagataatggggggaaaaagagcaaaacattgaattcaatgattacttacattttgatgagaagcaggaaaatccctgtagagtgaagcatttagaaaataatggtgttggggcatgtgataactaaatgaggaccacatagtaacaaacggagagaacttcaaacacttcgtgaaagggtcactgaggacatattgcttcatagtttcacctggaatgtgtgaagataagtttagagggaaaagcatatggacttgaggccttggaatcaacatgacaactaaggttttgggggaaaaaaatgctgtttcactccactgaaggcatattgcaccacttagaggtgcttattactgaatacatctaccaagaaacatatgaaagagccaggaaattatctctactcccacatgaaacagccatatggccatggcaccacaatttcactcttctaagctcttaagctcaggatctgatgagcaagaaaacataaaaataaatatttagctaaatttatgagccaagtgtagaaattaaaagtatatcaacatcaagttaatggaaacaatgaaaatatattataaaaacagaaaaatacatcttgctaaaggacaagctaaagaactatgttcattgccatgaaagaccaaacaaatgtaagagagataaaaataaagcaagagattataaagagatataagaaaaatcattttattgaagagctaatcaaatattagaatgggctgccaagagggattatagaggctctgtctctgaatatcagaagggatgctgttcatcctcattagttaaaaattcagatgttggaaggcagggactccctaggatcccagtgttaatatagaaatccatactcagctgtaatcattgtctctgaggcattaacaatccaaacatgcctgagtttctctgttgacattatattcttttaaaatagggtaaaactttcttctcatctaggcatcaaatcaactgtaaagattttgtttaaaatctgtgagtaatttagtagtgtcctagattcacagtgatgtccctaaataacacaaaatatgttttaatgtactttatatatcagaaaagacagcctattacagttatgtttccatcaatgcattctttatcacaattacaaatatctagtttcacttttaaaatgtgcattaaaatggaacaaacttctctgacagacttttagtgatgactccatttcagaagggaaaaagccaaagggaattcttctgttgccttccggcctctcttgtgtatttcctcttcacagagtagaacttgaatactttcaaccaaccaacgtgagatgggaatttgttaacaattacataacctcagtggataacttgattgcctaatcagccattgttacatgtgtggagcaaattactaaatcatgtactcagtctctaaccaatcttcctagaggaaaaacatattaaaatctacttaggtctaacatctggtcattgtatatctatcaagtaccgtatgccaagtgtgttacatatacgacttcatactaagaacaaccttggacaagatgagtattattattattcattttacaagtgacaaaaccggaactcaatagggtttgacagaatgaactgacagaattgtgaagctaatccagagaggtttatctgacttagaaagcccaccatcagtgagcgaggccgtatgacctcattttaatcagggaagctcactggtgttccttgtatacacagatggcttgtacgggtaaattatctgtgtatgtgtgtaaccctttaaggttgtttgccttcagagactattcttacccccaaactgcctgaaaactgtaggctgttcagttaattgttgtggttgttgctgctgttgttgttgttgttgttgttgttgttcttgttgttgttgttgttatggagtctcgctctgtctcccaggctggagtgcagtggcatgatctcagctcactgcaacctctgcctcccaagttcaagcaattctcctgcctcagcttcccaagtagctgggactacaggcacatgccaccatgcctggctaattttttgtatttttagtagagacagggtttcaccgtgttagccaggatggtcttgatctcctgaccttgtgatctgcccgcctcagcctcccaaagtactgggattacaggcgtgagccaccgcacctggcctgttcagttaatttttaattcaattatttaatcaaaaatcatcaaaatttaacacaacttaaaggttctgattagatgtactcagtgacttcactcagagaagggtcctacttggcgagcatgactgtcacttgtcacaagcaaacacttccaggtcacctttcccctcaccaatacaggcaggaagtgtccagagcttcacctctagaattggcttaggcaagagagagacagactgatggggaggaaaagaggaggagggaaaggcggtgtcagggtgaggtgcagagaagaggaacttgtagagttcaagtagactgcctagactgatcctgggtctgggtcacccatccctgctcctgccacctctgcacctgctgcagttagtaccctctcctttccactgtcaggcaagcttgtcacgcaagacaaagtgaactgcttgccgtttattgcaagggaactttttagcagtgacctttaaaagcaccacatcctataggcatgactatcattcaccctttgcattgatgcaggtggctgaagtatgacaccaggttatgcaccttgggcaattaaaaattgcaaaagacagactgacactaggtgaaaaaaccaaaatagctacttcagaatcaacctccatcccgtcgctatttagagacttcttttttgaaatagaaagtgacaaaaagtcccccactttaaatgaaacctaaacatgtttaactctgtctgtacaaagaacctgacaaaaataatgtactcatttgaccttatatgataaatatgtgcttccattccatgttggtttgatggtactgttcatctaataaatacttatggagtattggacaaatgtcaggaactagattgggtattaagaatataaggaaaaaacaggatattgtcactgccagtgaaagactggctttataattggaaaggcaaacaattataggactttgtactaagagctttaaccttactatgccctggaattcttctaagtgatttaagtatattaacccaataattctcccaacaacttttcacatggttgctattattatcccccattttactaatagagaaaataaagcacagagaggttaagtgacttactaatttatttattaatacctctgaaactaggactcaaactcaggcagctgactccagagtccacatttacatccaccatggtataaaggagcagtccccaattttggcattggggaccagtttcatggaagacgatttttccatggaccagtggggaatgaacggggtggtttcggggtgattcaagcacactacatttatcatgcactttatttctattattattacattgtaacatatatacatatgttacaagtaactacatatgtacaagtaactacataactcactatcatgtagaatcagtgcgatccctgagcttattgtcctacaactagatggtcccatctgggggtgatgggagacaatgacagatcatcaggcattaaattctcatagggagcacacaacccagattcctcacatgcacagttcacaatagggttggccctcctggaagtatctaatgtcactgctgatctgacaagaggtggagctcaggtagtaatgtgagcgatgaagaggggctgtaaatacaaatgaagctttgctgcttacctgccactcacctcctgctgtgtggccttggtcctgagaggccacacaccagtactggtccatggcctgtagtttggggacccctgctataatcacctaaaataagagagtgaccctttcaggggaaccaggaaatatttctgagtaataataatagatgataaaaggccaggcatggtggctcatacctgtaatcccagcactttaggaggctgagtcaggtggatcgcttgagctcaggagttcaagaccagcctgggcaacatggtgaaaacccatctctacaaaaaatacaaaaatatctggctgtagtggagcacacctgtagtcccagctattttggaggctgatgcaggagaatcacttgagcccaggaagtcgaggctgcagtgagctgtgatcacgccactgaactccagcctgggtgacaagtgaaaccttgtctcaaaaaaaaaaaattgataaaagataggttgaatttatagtcaaagaaaagtatttcaaggcaaaacatgtagcatgtcctgaggcaacacagtttgttcaaggaaccttgatgaagtctgtaaaaaatggcatttaaagtatgtcagagaaatgaagaaaggcggggaaattacattaggaccagattggaaaaggcctcttatgctttgctgaagagtttgcactttatcctgcaaacaatagagagacagcaaaggtttccaaagcaaggaaagagaggtgaacagtaaggtggagcataggctggtggattctctccaaattatagaaaacgcaaaatgtagaaattaggtaggtttagagatgatgcatacatatcatattcagcattttgttttctaagacttatcctgaggactgacaaagagagtactggggagtgaagacagaaagaggaaacagaagacagaatggctgggaaggttgagtagtccccccttatctgtggattgctttccaaggtttcagttacctgtggtcaaccacagattgaaaatattacagtattttgagacagagagagacagagagatagaccatgttcatgtaacttttattacagtatattattataattgttctatcttattatggtaattgttgttactctctcactgtgcctaatttatacgttaaactttatcataggtatgtatatgtaggaaaaaaatagtatatctagggttcagtactatctaaggcttcaggcctccactggggaaattggaacgtaacccccatggagaaagggagattactgtacacagaaaaccattagcatgtttcatcaaatctaaggcaccatcgactgtagagcacattaattttaagaaatcctaagaaagaaaaatacttccagttaaacaccgtctgttattagatacattccaatttctcggagttaaaatgtagcagggaatgcatctcagaatctatgaaatattgtataataacttaggcaaaagtagaattgatcactggttccagccactgagtaaatgagaacataaattaattgcaaaaatacttattgagtgttgcaaaaatacttactgagtattacatggaaatataatggagatgttgagaataaatggcggttgtgattgaagggaagaaatgatcatgttttaagatatttagaaaatagaactattaggctttgttgtgctactgaatgcagatggtgagggagagacatttaagtgatgtctaagatggctgatgaggtaatgtctttaagaccaaaagggcaaaaagaagatcatgttgggctatgacatcaagtttggctttggacatgctgaggttgaaatataagtaggacttacatgtgggatccccagcaggcagttggaatattggccctagctcagaaaagaagatagaactagaggtattgattttggatgcatctaagtgatgtggtcaatgaaaccatggaagtggatgaagccacttacaaaataaaaagtctggctaagaagttatgttcacgtgaactaagggaaagcattagaaataaatgaaaggagacagattcaagacatactgtgaagatgtcatttctaggtcttgataactgatgatctttaggtattgagagaaaaatggtcccaataagagatacagagaagttaagaaatatagcagtttagttggagaagagtaaaaatttcagttctagatatgctatgttgaaagtgctgccaagacatcaagtgaaaatgacccaagaatagttgaaaatgtggtctatatttctggagatggggcaaatctagagatgtaaatttgcaaatcatctattcatagtgagaattggtgctgtggcataaaagattgccaagagaaaaaatataaagaaatagtaaaggtttcaagcatagaaccttagagtaagctatacttagcagaagtcatgtggtgcataatgaccttttgatcaatgacagactgcatttatgatagtggtccataaaattataagactgggccaggcgcagtggctcacacctggagtctcaacattttgggagttccaggcaggtggatcgtttgagcccaagagctcgagaccatcctaggcaatatagcaaaaacccatatctattttttaaaaaacacaaaaaatattagccaggtatggtgggtgcacctgtagtcccaggtactcaggatgctaaggcagaaggatcacttgagcccaggaggcaaaggttgtagtgagccaagattgtgccactgcaatccagcctgggcaacagagtgagatcctgtctcaaaaaagtgggggattataagactgtatttttactttaccttttctatgtttaaatacatttaaagtacaaatacttaccattgtgttacagttttgcctagagtattcagtacagtcacatgctaggtttgtagcctaggagaaaaaggctacaccatataacctagcagtgtaaaaggccataccatctagatttgtgtaagtacactctataatgtttgctcagtgacaaaatcacctaacaatgcatttttcagactgtattccatcgttgttaagtgatgcatgccttatgccaaataatactatttaataaaatactaaaactactactatataatggatgctgacatgtgtaagacattttacatctgatttaaaatacttataactgcataacagataatcaactgtctattttacaactgaagaacatctgaggtttagtaacattcccagggtcacagagctagtaagtgactgagtagggatttgagcctgaggctctttcttggaagccctcatgtttcatactgcacccagcctacacaaagcctatcctcctttaatttttatacattgctcttacttctttatagagtataatatcaaacccaaatgcttacagaagacacaagtaagtaacatatgagagaccctagctgggtctttccctaaggatatctggaattgtatgcttctgacactggcatgcttcttttaactatgaagacatattgttcgattccacacacaaagaaaaggttttcttgaaatatgtgatcttcttactctattctcatttttctgtattttgactgaaacatggaaacaagtatttctctaccataagaaagcaacaatgtaagatgatgttaagagcaccagatacttgaattcagttttgtgtacaataaggaatggtgagaactattgcaaaatggagagtaaaactccatctaaaaaggtggcaaacccccaaagctctgtgttgctcaaatttcagattttgtaagggaaggtggaaacttaaaatattaggtgaagcctcccattgataatgtgactcattattttaaatactatgcaagctaaagaaaaaatccctgtgggcaaaatgcacttcaaaagatgacaccacactgccttatattctcgaaatttaatatttccaattccttcaacggtttatgttgcttgatttacaaaactttatactctcctttgaacagagaccattctattcactgttcctcttaaaatatgacatctagagctaaacaaaatcatgcagcttctctctggccttctcagaattcagtgaaactgctactatttttgtgctgagcactatatgctaatgtaacctagtattgcattagctttttctttttttagcatttacaacattttactggtgcctaatgagttttagtccataaaaacccttagttattttttcacattaactgccgaggtaaatcttaactcatccaatacttacaaagaagcagcaattttgttttgaaattaaatgcaagactttacattttctctattaattttttatggtgtagatagagttgaataaactttattttatttatgtgggcccattattctagatttcaggcagagttttcaatcatctgtctctttccacagcttcaagtataaggatctacaattcattatatgtactgtgcacagatacaatgaatgttcctgagaaatctcatccaccaaggtgcacacaattttaaaaggttcaaatcagaattgatccataattagaatattacattagcctttaagaactatccccacagcaccctgcaaataaccacagcattatctgtatttgcctgccttatgtatatgcacccagagacgtcacactgagtgggacacctactgcacacagggtgtcatttcagtaatttcatctatttggctgcttctgctatcatccagaactccagccttaagtcctcttcagtgttcatggtaattaggaaattcctttctggcaactgtaaacatatgtttgatcatagagaacattctcttcctgttcctctgtttaaaagaactaacccataaacatcaatttatctggctcatgggggccttgcactccacatggcttcctttcagggaactgtgtaggctacagtatcaataatgaaagtagctcatgcatcctaaggggtcactatgtgccaagcactatgctgtgcactttatgtaagtcgtctcctatattccttgataacacggtctaaagaaggacttcacagccaaggaactaagatgtaaagaacttgagtagcctcacaaggtcagtaattgtcagggtcaattttccaaaaagcctgtctacactgaaaactctgctctttctattgccgttctcgttcctctgcaggtcagctgacccttcctttggtgtagtcaaataaattaccagttggacagcagcacccgccatcaccaatgaataccctgtgttctgtgttctaaagagctaatttggcaggcatgtatcaaaccctaaagcagagttccctcatagtccactactaagtctatactttttagcctttttaaatcaaggggagtatttttcaaacatttttctcattgtttgttaagtaggtgctttagagctcaacatacaccttcatttcttcaatcaggctgttggtaggatattgaatgagaaagaattctgggctgtgccattgttgtatgactttctatcttttttccaccatgacacagataattgacatacatatctgtatcatgttcacaatacccattgcactcctaattctgaagcttcttttccattaaaaaaataagatcacaagcataaaataaagtaagcatggtattatcgtagggacaacatcaaatcagttttactttttaaaggaagtaattaagaaatgttggtgctttaccatcggggataaattactggtgtcccaagacactactgcggaggaccacttagcttgaagcattcacagagaatttagtgggcatcttttctttaaaacttccattgttccaccaactattaattcatctaaactagattgccctctcattcttcatttttccatttgcttttacaaaaaatgttgcaagaagttgtgcggatgcctcactaaattaaaaagtatgtgagtacgaataaatatttattactttttcatccacatcaggctttgctgtcatgagatgagaataaagagaaagacctatgtccctttacctgccttagagcatgcccagaaaaaaacaatatagagagaaatccttagtaattgcttctctcagtggctgcaatctctgttgagcctcttgttttgtctttggaaatttaatgtttaattatttttaatatgtcaaaatattagtttctcaagagagaggctgtgcagtaacaggcatttggagatcattggttgctttgcaaagtggatagattagatttaaatttattttttaatgaatcaagaaatatccagcttttacatttaataaataagaaatggcaaatgaacaaagggaaatggtgatgtagacagaacccggcggatacctaaatttctgttgagggagatttatccctgtagtttaagactttgatataaagtaaaaggcaaatatctagagaggtaaccttttggctatcattggtcttttgtgaaggagttggacacaaattttgataagaccgtagaaagagaggaatcttatactggaatccctgtggaagtgagaggaaagcaataatagggttgttggttttttttcattatcttcaaaatttttgctgactagtgtcccattattgtttagaaacgtaatttttcttagacaagtatcagctaagctcatttaagagaagcttgctctgggtgacatttttgctgcatttatctttagaaacaatttttaactctgtttttctatgtcatttatggctgaaaattataattgaacagttagaaaaaatctctgttgattaattacatagcttatgtggtatttaaatagccaaatttattacatatttgtagcttgagagtattcttcacaaataaaagcttttttctgggctaggcaccatcccaaatcagatttagaacagtgttgcaaaggttttgttcactaaatgtattccaaaattataatgttctttaaggacggtatggttgctgattttatttgatggtttactgtgaagactcttcgattaaaatgtgtttcactgaaaatttattcttcaagcagacgccttagaaatttatcttgattgcaatggaagatggcaatttagaacaattatttatccttataataactcaagagcttttatcatcaagcacttgctatttgaagacctgactcccattgctaaataagtgaatattaatctgattgtttttagtccttataacataacttaatcttttgctaccctattgcatgaactgagtaaatattaaatgggagctgaattgtccaccttctccactgtttataaagatacatattaggtatgttacaatagaatgagtgctaaagcacattttcttttgaagaataatattctaggaaacttaaatttcattacttgctaaagatcacccatggaattcaattttttcttactttttctcattttgactacctgccttattgcacaaaaacatattactgtttacaagaaatcattatcctttattttcaaatggaaaaggcaaaccaaagacaataatcaaaattggatattatgtcagattcgtcaacttggaattctgagatttgattattcaaaacgtggaacagtacctataaaatttgtttttacctttgtaagccatctggaactcaagagccattagacctgcttttgcaaatcactgttttatacaaataaaacaatttttcagaaggcaatttagaattttgaaacacataccaattgtcagagtcagtctgtcaggttctgctcatcattaattttttaaaacatcaattatggtaaactctatcataattgcaatagaatacaattcaataatgaatataaacatttaatgcaatgcatagaatagaattcataagctgacaataatattggtctcttcatattctattcagggaagcccaagctctaaactgatatatacactgcagagactaggagacaaaggtaatattctgaagaagaatattttagggagaaaaaatgagaaaatgaatagccatctaggtcatttttagaccaaaattttatttaattttatttttatggtgtgatgcccaagtaatggttcaatagcatcacaaatagtcctaaaccctgggggataacatgctctccttctatttttagaaatgcaattgacatcaaaataggtataaaaatacctacctccctgggtcttgtgaggatcaaatgagatgatgtgtatgaaagactccagatgctatacaaatgttggttggattatacgggaagctttagagatgcctttgcacagtggaaggatccttggacttggtagttgaaaaaactcagttttgctagccatgttattttgagtaaatcatttaaatttaattcctctgtgtcatactttttacatgtaaaacgaggatataatttctaccacagtgctgttttgtaaatcacctcaaacaaaatgagatctataatgaaagtgctttataaacaatgaagcataatgctaatagtgtaacagattgttaatagagtacttattaaatatggcataagtaaaggaatgacatttacaacaaaataaatacaattgtttaagtgaaaaatctatgtagaaaggattgagaattgaactgagttcttctgttgaatacttaccatattgcgatctcagattccctatgaaaaggacaaagtcctgcccttgaaaatgttaggatttcaagaagacgtagggcatactttgggtatctacaagatataaaggaaataaacccaaaactaaaatttgcattataagccacttttatggttaaatctcattcctagcctgaataatactttttattgagaatcagttgtatagaaagcattgtcttatgtcctgatttctgggagaatgtgtgtgtttgtgtgtgcttgtgtgtagtggaaatggatttgaaaggtatactacaaaagaatgtaaatgtttacttctattccctcaagcttatatacttgagaaacataaaatttgataatacgaagaatcacagaataaatatcaaatgacttaccctagaatgtattactgaaacttattaagcctactatgtggaaaatggtctttaattatttttaccaaagaaacaagaaggtgaaatgtcagggactgaatatttgtggctatactttcccccaaaatctaataaattgcaattaaaacattaagaattaagaataattatgcttatagtgtaatacagcggtccccaacatttttggcaccaggggcttgtttcatggaagacaatttttccctgggggatgcagcgggctgggaatggggtggtttgggaatgaagctgttgcatgtcaggtcatcaggcattagattctcataaggagcgtaacaacctagatccctcacatgtgcagtctacaatagggttcactcaccacagggttcacaatcctatgagaatctaatgcctctgctgatctgacaagaggcagaactcaggcagtaatgctcattctccatctgccactcacctcctgctgtgcggtccagttcctaacaggccatggactggtacccatccctggcaggagtttggggacctctggtctaatacatatgtatgtacttaacttctttgtcttctagttattcctttagaaatgtaaagagacagggagcttaagagagacaactagatctggttagagccttatttgagtgaaagttgtcagattacctccctaagcctcagtttcctcatctgtgagggaagtcctaactcaatgggttgttgtaaagattcagcattataatcaacacaagtgaaccaaaaccgtgtcaggcaaatgcttgggtctcaaaaaagtgagagtttattaagtgtctcagtaatctttattcttaataaacccaccaagtgatagtttgatctggcaaagatgggacggcacacccagcactaaacttaactattctctttcacacagaatattgctagtttttactggtgacattttaattttaaatttacattttaaatttttctgatatagtcactgggaagacaaaggacagagtttgttacagtgagaaaataacacaattttctgaggtctttttcatgaaatgttttaaactggagctttgtctttggaaattcttgctcttggacatagttatcatgttgtttgaggttagcaaggatgtgattttgaggtcacaaccagacattgtttactgaatgtgtataagataaaatgagatgagagggtaattatctataggtttgccttaattagcagataacattttctaatttaacgaggcctcagtgataataatcaacagtcaagtttctaaatagctttcccatatctttgtggccattaattccctcatctttaagttttcgacattcttttcaaggcatctggaacacttgagcagcaattttccctgtttgcagcaatcaccagttgaatgcttttgtgaatgagaaattaaatgggttttcaacaatgtagatagttttaagtgagagtcccattgaaattatggatgaatcaagggacagcaggaagtctgtgattttctccatttgcaaatgtttttctaaaaaatgccatcctaagaacactttacagatattaacccattaattccagtgcctcatttttttgaagtaattcttattctttctttatggctccaaaaattcacagaagaatagttagcaaagcagcagtcaactatccacaccaaattttataaactgcattaaatgtactactattcactggaaaactcttataaaatatatacatgcatgacttacaaaagtataaattataaatggtatgaaaaatgcttcaaaatctagaaagaatgtaagaacttaggcagggaaaaaagaaatatatacaatcttatttagcgatctgcttattatcacatgaatttgtgagcagaatgatctagagaaggcctatgacatgtagtgaggcaaacaacattttaaaaactcctctggaagaagatggaatcaatgaagtttcaaattcacctgcaaaagttacaagcagatttgaactatgtgaccaaatctagctgcacctagatttgaaaggacaccatttggatttgccatatgcgcttctgagaaggagagaggtatgagtagagctttttttttaacttttaaatttaggggtacaagtgcatgtttgtttcataggtaaacttgtgttatgtgggtttgttgtacagattatttcatcattcaggtattaatcctggtacccattagttatttttcctgatcctctccctccttcacctacctggctccaaaaggccccaggatgtgttgttcccctctatgtgtccatgtgtcctcatcgtttagcccctatttagaagtgagaacatgtggtattcggttttctgttcctgtattagtttgctaaggttaatggccttcagctccatccatgtctctgcaaaggacatgatctcattcttttttatggctacatagtattccgtggtgtatatgtaccacattttctttagccagtctatcattgatgggcatttaggttgattccatatctttgctattgtgaatagggctgcaatgaacatacacatgcatgagtctttataatagaatgatttctattcctttgagtatatacccagtaatgggattgctgggtcaaatggtagttctgtctttaggtctttgaggcattgccacactgtcttctacaatggctgaactaatttacactcccaccaacaatgtaaaatcattcctttttctccacaaccttgccagcatccattattttttgactttttgatactagccattctaactggtgttaggtagtatctcactgtggttttgatttgcatttctctaatgatcagtaatgtcgaactttttttatatgatttttggccacatgtatgtcttcttttgaaaagggtctgttcttgacctttgcccacttttttatgggattgtttgtggggttttttgtacatttgtttaagttccttatggatgctggatattagacctttgttagatgcatagtttgcaaaaacttcctcccattctgtagattgtctgtttactctgttgatagtttcttttgctgtgcagaagctctttagtttaattaggtcctatttgtcaatttttacatttgttgcaattgcttttggtatcttcatcatgaaatctttgcccatacctatgtcctgaatggtattgcctaggttgtcttccagagtttttatagtttgaggttttacacttaagactttaatctattttatgttgattttatatatggcaggggtccagcttcaatctttttcatatgcctagccaattatcccagcaccattgattgaatagggagtcctttccccattgcttgtttttgtcaggtttgttgaagatcagagagttgtaggtgtgcagttttatttccggattctctattctgttccattggtctatgtgtctcttttggtaccaataccatgctgtttggattactgtagccctacaatatagtttgaagttgggtagtgtgacgcctccagctttgttcttttgcttagggttgcattggctatttggggtctttatttggttccacatgaattttaaaatagttttctctagttctgtaaagaatgtcaagagtagtttaataggaatagcattgaatctacgaattactttggatagtatagccattttcatgatattgattcttcctctccatgagcatggaatgtttttccatttgtttgtgtcatctctgatttctttgagcagtggtttgcagttctccttgtagagatctttcacctccctagttagctgtattcctaggtattttattctttatgtggcaagagtagaaatatttttaaggaagatgattcttgctcctactaaataactatagaagaggaagaatcatttggctttcacatgacttgtgtattataaataaaaaagttctttcaaattaattccatttactatgttttatatattccttccataattcacttattctattcagtaaaggcttagtctgccaaaaccactgcatgattttccaaaggaggtacacagtaaaaaaaaaatgattagaaccataagttctggagttggaccacatgggtttagatcttggctatactccttgctagctgtgtaacatggatgaactagttaatctctccaaacctcagtctcctcagctctcctattattaataaaatcggtttaataataatgtattcctccttattttaatgagaggattaaatgatagcatgttgagaaagcacttacacagtatctggcatattataaatgtccaataagtactagttattgttagaatttctggatttaaagagatcacttattttttaaaggtatcttgattgttactactatatcatgcaaatctttatctcttttaattatttatttaatgacagaaaaatactgtaaaaactgaaaaattcaaaattaattttccaagtgcctaagtaatttctaaatagagatataaacacatttaagttcacaataataattgcatttcattggagttttacaactactgcttggttctaaatgctttgaactagacagttaaacttctcatattttaaatttttttccaaacataaaatgcatacattgaataacctaactttaggtatactgagacttcattttataatgaacagttacatgaagagtgcctgctcccaaaaaaaggagttataatgcttcaattttaagtggtaagacatttactgggacacagagtaaaattatagtgaaaaatgtgaagatgctatctgaatagtgataagataattttattgtctatttaaagacaggccttggcaattggaaaatattagttaaatcttttttgagctttttgctgttattgttgtttttattatgttactagttttgctttctttcttctatcttataatattttccctaaagaatggggttagttatgtggggcaatctaatatgatggtatttataatgctctaaattaaatttttgagctaagaaaatcagtcacaacacttgagatttgtcaattttctagtgaattatagttatctgtaaacagttttgattatgaaacttctatgaaatctctcattattttgtaacttctttcccttatttattttacagactaagccattttctcttaagcctatgttagcagcatctccccttggaaatactatgatcatttgataatactgggtttcaaactctagatgcctttctcacattggcttcatagttcaattccataagtttgtgtcaagatactactacatgtaattcaggttactagagttcctgctctcaaaaaaaaaaaaaaaaaaaaaaaaaaaaaaaaaaaaagggagtttggcctgtccagaaataaaataatgtggcagaaaaggtatataaaacctcttgagattttagggaactgattaatagcatctctaccttttcacatcagagtcctgaaccaactaagaggtagaacaaagtatcaagctgctacagatcaggatagtagctttttgcattatgggcttaaatgtgtatccccaatttggttccttgaattgagcttacaattcagatcagcaatgctcccctgcaagttccctgtaagctcactatgcatctgatagagcagcatgcagcctcttaggaggtaggcagatggacagtaagaaccctaaatgtcctggactaagcgtgcttaatttcttcccccaaatttgtcagttaggccaagcatcctccccactgccccacctgggcaagatggatgaaggaaaggatcccaaaagatgtaaatgttgctccttttttcccctttagtgcatgcagtggaaattccccatcactcggttggaatatgaagagtaaaaataagtgttcccatcctaaaagagacaacatgaatttcaattcaaagaagaaagattccagatggttggaatgatcaggaaataattcagagagaagatagtatctgagaaaggcttaaaagaggaatacaaattaaacaggcaagatgaaagaaaagggctaccataaggagccttgtaaaacgtccagaagaaataactagaagaatttccaggcttcaaaaaggacccagttaacattggagtgaatttttaatgaatttagtcagtacgatttgagactttctttattaatatttaggaggcaaggataaggcagacatcataaagtgtttacagttagcaagtgccgtaatgtatatttaacttaatgtggcattctatgaaagtagtgtatcattacaatagatgttgtggagttcaggctctgttgctggacaaatgaaaccagtatctgtgtcagtctaggaggagtaaagaagggaaaataatgaacagatttatggggaaaagcagaagacagacgtctataatgaaagagaagttttggaaaatggattaatgcccagagataaaacccacactataattatgaaaatcattagaattttaacaaaaggaattttgagggccaaatagcagagggtcatcactggatgctgaaatcactaaggatgcttctaaaaatgttggcacaatgtggtgtaagctagtggagaaagatggatacccatcacagaagttgttggtgacattgatgaagaattaaatagcataaatacagaaaaaataagtggcttcagaacatgctgttggttaataatctggaagtggtattggctgataaataatatggtgacgtattctcctgtccttatagaaaaaataggctagaaggcatcagggagaaatcgggtttcaattaataaaaagtgtaacgagccttgaaaaagatttgagaatttattacaatgtgcaataaaatgtagctagtcagtaacatatgatttatgagacactagcaaggaaatgggccagagtatatatgtggcctgggaaacaagagagatctaggtaagaaaagggagttgggaactatcaatagcaaggattaagaaaatgggttgagagagaagctccaggaaactgttgacagtacagaaggtgtcataatttaatcacttcagtcctttggaatggtattgccaagtcactttgggatgttaaaaaattatattccttcaacactttataattaggaacaggaattggcatcatcctattggagcttgctgctaacaacgtgggagtttttagagacagatacaaggtcttgccaacacattctaatgtagtcacaatgccatccagtggttactttggttactttacaggtactttccattgctctttaagaatatattttattttatagttaatattcatcaaagtttcagaaagcttgtatggaaagtgttttattatatcttcaaaaatggcatagcagggatttgatttgctatgtacttctaagctaatggagttatatccagcttgttttctatatgtgttatgctctgggaaacatgatttagcctgtcctctatcaaaattaatgcaataaggaaccatgaaataatgggacttacactgtattcaattttagttctaatagaaacacaatggaaaataacatctgcgacataggcctggttgatcagaggaaagtaatggacatttgttgctgtgattttattggtgctatgggttttttccttcacggtatgctcatcagtatagggataatgtaataaatacttttgacttcactcgtatttagtctcagtttgtctgtaaggtcataatgagcaaacttaaatgggaaacattaatttggcagctgacaacataaaataaatctagctgccattagcaaggacccttcttaaaatttttataaaagcacagctttcaagtttattgcacatctctttaaaaatgtatttcaaagtaacttcagagacatctatttggcacactcaaacttttggtgatgaaattcccttttgccactaaaattcattatttgaatctccatggtaaattagctttatgagttagctattgtaattatttttctgtgaagcaaaggcaggagtagagacaatttcatcatcttatcatcatttgtatgtggaatcactaaagagtttacccatgtggaaccatgaaagtccctgatttacccctctatcagtaggcataaacatatctaaaccacccaagaaactgtacattaatattgcttctaagacctgggggttggggggtagcatccccacagtcaacaatgttaaagtgatgaaacattttaaataattttaatgttaaaataattggagccatttcttgtttgattattttcacactattggtccttaaactgtttaaatttggttcagaaagtacagagcgggccgggtgtggagggtcacacctgtaatcccagcactttggaaggccgaggagggtggatcacctgatgttcagagttcaaaaccagcctggccaacatggtgaaacctcatctctactaaaaatacaaaattagccaggtatggtggtgcatgcctggaatcccagctacttgggaggctgaggcaggagaatcacttgaacctgggaggctgaggtttcagtgagccaagatcactccattcactccagcctgggcaacaagagcgaaattctgtctcaaaaaaaaaaaaaaataccaaagtgatttggaaaagaaagtgatattgatgtaaatgatggcagtgtctgcagattttcaggggtgtaggagcaagagatctaatgttacccagaccgagtggcaaaactgaagataatgaccacaatagaaacacttcacagttcacaagagttatggtgttttatcttcactcatgtagctaaatactccatgttgatattcatttgtcaatactaaattaagctgagtaattcttttaactaaacactgatactctacaacctgcttcgtacagtacatttattgggggctttgttcttgttgttgagttctatatttttttaactttacatttgaaaaagttttagacttacaaaaaaagttgaaatagtacaatgaacacacatatacctttgcttacaccaaatggtaacctctttgccacatttgctttgactatcaatttattttttttggagtaaactagataaaaataagttgaagacacttcaacctataaccctgtaaaccttagggtttacaaccctacgtagtttacaatactactacatacttcagtagtatctcctaagaacaaaaatactttcctgtataaccacaatgtcaatcacacatccaaaaattgaacattcgtccaataatattatccaatataatctctaaatttaaattcccccaattctccaaaatttcactgataactccattgtaaaagcatatttctttttttttttatgtttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattcaccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtatacagtcccaccaacagtgtaaaagtgttcctatttctccacatcctctccagcacctgttgttccctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtagtttgcgaaaattttctcccatgttgtaggttgcctgttcactctgatggtagtttcttttgctgtgcagaagctctttagtttaattagatcccatttgtcaattttggcttttgttgccattgctgtaaaagcatatttctattcttatcattaatattctcttcccaggataccttctacccagtgtttttagcatagttggcccttgcctgaatcacttattatattgactattacaaaaaggtgattttctaattctatcatttcctttacattttgagatttttttattctgtgaagactgttctcttccttttacttaatagtatcactcagccacatagattcctttttatttcaatttttttgtagtccatcaccattatttttctttttcatgctcgtattgtctgaaatttagctgatgagagccaccagaaaccacccctgtgtctttctgacatgtctccaacagatttggggcatgttcttacttacaaaataaggtattctaggcccactttgtaccttgcctgttccagacatttgttttttgttttgttttgttttgttttttgtttttttcctatgggcaatgatatttggaaacctgcatatgctcatttttactgcaatattatttttctaggctcatttggtggacagggctatatttttcttaataatgagtacatagttatacctccaagtcaaatccaataccatagaatgtttcctcacttttctccatttcatatgtttatatcacatctcccactgtcaaaacagtaatttgtttatttatttatatttatttatttatttttgagatggaatttcgctcttatagcccaggctggagtgcgatggcgtgatctcggctcactgcaatctcctcagcctcctgagtagctgggatttcatgcatgcgccaccacacccagatatagatatagatatatctatatagatatagatatagatatagatatagatatagatatatagatatagatatatctatatagatatagatatagatatatagatatagatatagatatatagatatagatatagatatatagatatagatatagatatatagatatagatatagatatatagatatagatatatagatatagatatagatatagatatatagatatagatatagatatatagatatatagatatagatatagatatatagatatagatatagatatatagatatagatatagatatatagatatagatatagatatatagatatagatatagatatagatatatagatatagatatagatatatagatacagatttagatatatctatatagatatagatatagatatagatatatcgatatgtctatatcgatatagatatagatatagatatagatatatcgatatagatatccatatagatatagatatagatatatctatatagatatatccatatagatatagatataatctatatagatatagatatagagatatagatatatctatatagatatagatatagatatatctatatagatatagatatagatatagagatatagatatagatttagatatatagatatggatatagatatagattttttttaatagagacgggatttctccatgtgggtcaggctggtctcaaactcccgacctcaggtgatcagcccacttccgcctcccaaagtattgggattacaggcgggagccaccatgcctggctgaaaacagtagtttctaacgtccttgatctatttgccatttgctctagcctaagtttcagatttttaattattcatttttgtccttggacaatgtaccactaagggtgtctcacttaacaatgtatattgaaactaactttacacttgaaaaagttttagacttacagattatagagatacactttattcttttttatggctccatagttcttcattttatggatctatcagaatttactcaaccaatccctataatttgatatttgggattttccccaatattatgctataatgatgtactttgtgcatgttattttatattcttcaagacgtatcttcagggtgaatttctagaagtgggattgcaaagagaagagttactaaagataaatacttttgtcagatattgccaaatttccctctattagaaattgtaccattttgcatttccaccattgtccttcctaaaataaccaaaccattatttctttgaaaatatgaacaatattaattaactaatattaaaaaataaagagcttttctagaacaagcataagaattccttacacactatcctcacttcctgattccaaactcaaatttagattttataggtagaatatgccactgcagaagcagagaagactataattctagacaagcctcaacatatgtaatcatttaaagctttagtattggtattagtccattctcacattgttataaagaagtatctgagactggtaatttattttcttttttttttttaaaaaaaggagttttaattggctcggggttctgcaggctgtacagatagcataatgctggcatcttcttagcttctgaggaggcctcaggaaacttataatcatggctgaagtggaaggaggagcaggcgtctcacatggcaggagcaggagcaagagagagtgaagggggaggtgccacacacttttaaatgagcagatctcaagaaaatgaactcactatcatgaggacagtatcaagagaatggtgctaaaccattcatgagaaatcacccctatgatccaatcacctcccagcaggccccacctccaacgttgggtgatatggtttggctgtgtcccccagcccaatctcatcttgaactgtagttcccataatccctatatttcatgggagggacccagtgggagataactgaatcatgggggcagttacctccatgctgtcctcatgatagcgagtgagttctctcgagagctgatggttttataaggtgattttcccctcttcactctgcattctccttgctgccgccacatgaagaaggacgtatatgcgtcctctctgccatgattgtaagtttcctgaggcctcccagccctgcagaactgcgagtcaattacacctctttcctttagaaattacccagtcttgggtatgtctttattaacactgtgagaatggactaatccatcgtccattgtaatccattgtaaactaatccacgtttacaattgaacgtgagatttggatgaggacacaggttcaaatgatatcagtatttatgattgcatttttcttgagctaattaaaaatattaaataaaacaaagtcattcataacatagaaatttggagtggaaagaaatcttagggatttacttttatggatcatattagcagaaggtgaagtactgacaatataaaaatgattgaatgcatatcacattgtttcttagagtatggatcaatacatatagcatttttgccactttctactcaaaatacaatcttctctcccttttttttcttccagggcccccactcttctccatatcaaccgtatacctttctagatgtctaatatatttaaatagttcctgagaccctatgatctgatttctcagtttccattcccaagtagctaagtgtggcagaccaggtcatgtgactggaaccactgtggattctcctcatgagacaccaatgggctttcactgctactcagtactcctgctgctccaggcttcaaatgtctgaaattcccacaatgcccctaatcccttctctttcagttgataaccttagtttttagttcacatgaagaccaacaacatcccattgtgttcctatcaattctatcatcccttttccagaacatctttattttcactcttttttctctttctcctagacaaccccacccctacctcatcctccatgctcttcctctggagcactataagtcatctccgttttaatttataatgttttaaatctttctcacttctggtaacttctctttgtctacacacatgtataggtctgtaacattctaaagacagcttttcaccatgttaccctgagttattactttgtctttgtcctttcaactgcaaaattgtgcactgttttaaaatcacagctttttactcacttgtcaagcccttgtaatccagcttccacttcataatgctgttctcttaaaagtttctagtgacctctaaactctaatttcaatagtcttttactggtcttcatcctccttaaactcactttaatgtttggtactactgattggtctttttttaactccctttctgtgattttttgggacactttggtgtcatggttttcttcctaaatgctcttattctctcttgttcattagtttgtcccaactcctaaaattaagcatttcctgaaacatcttcataaagtctacttgagtaattgaccagatgaacaacaagttgaggaccatccatgagaatatacctcctggactgtgaaaatagcataatgcatcctggggactcaatcaacaaagcctgagagtaaaaggagaaaaaactatagatatgggtaggtccagatgatatgcgtatagttcaagaactttattttttagaccaacacatattgcagttaattgcatcaatagtttttaactgactgaaagcagagatctgaactataatttaaaagcataaatgtttacccttcttctagcatctctgctgaaaagattttctttcaatctgataacctaaagcaaattgcataatattagtgtgtctaaactgtgcttagttacttctcattagaaatcagttctgttacttctgttacttctcattagaaatcagttctgtttccccatttttaaaggcctaacaattttaaaaagttaaatattgtgtacagataataatattgttatagcttcatttgatgtaggtcaaattctgatgcaaactggtccttgtaataatcgttcagagtaagaaccaaatgtgttatattctttttaattaagaatttaagaaatatttcatcatacattcattgcctaagtcagcaaatgtttattgtgcactgactatgtggaattcacttttctgagcattagagattcaagctagacaaacttttgtcccctggagcatgcacattccatctgaatgaattaaactggctgagatattatggtatatgtagcttacacatgcagcaccactcacttcgggaagagacaagtcttctgcagtgagtggtgctgcataggatgtaccagcttttagtgaacacagtaagttgcgcagacaggaagatatttgtcttctgtagagaggaactggttcatctttgccagtggttctcaaccagggatgatactgcccccaggggacatgggcaatatctggagatatttttaattgccacaactcagggaaaagggtgctactggcatttagtaatgctgctaaacatcccacaatgcacaggagagctacccccaaccaccaaagaattatgtagtccaaaatgtcaacagtgtcaaggccaagaaacccttctctaggctaaagggtctatgtggcttaattactgggttctttcttagaagaacatacaccatgctgttcccacagcccctctcctccctcttaccgtatagatggtcctttcaagctaatttttctggctgttttttgttccatgggtaaacagagaatgttcaggttagatatgtaccttctatttgtttttcaagctgttctcaagggtcaatcaatgcttactaaagttttcgagcaagcactaaggtagtgagttctgtgcctgctgggcataattacaggaaacaactttgtttttaaaatctcataacaagaagcacaagcacaatccacaaattacaattcctttgcagtgtgtttgtacccttagcagctcacagcagggccacatcatcgtctccgccagccaccatttttctagctaccttcctaaaatatcagaaacaacaaacttcccagggtgaggaaacatcctgtagttttgcccacatggatcagtatttttcccattctgtcattatgttgctatgaagtagacaataaattattatgaaaatatgaatagaaagaggaagtgagtcatgtaaatcattattagtattctatttcacgtgatggaaaactcacagggatcttggtgttagtccagaattcactcatgttttccctttattttaaatgctgaaaaaaacataggttgtaatgttatcattgtacttgtagaactatatgactagatatgaactaagttacttggcaacagttgagctccaaatggaacttatgcctttattagttatgtaacattagatacctcacttaacctttcaagggctcaatttggtaatatgttaaataaataaattgagctagtatctggcatgagaatcctgggtttgaatttggcatcatcagtttctggccatgtgaccatcagcaagccacccactgtgcagagagattataatgagatgagattagcatgggcattacaaagatttttgccattgctgttgtcaccaacagataattatcttgcatgtgtcttctatagcacaactgaaaatcactgtaaactatattaagagataatatccagcattcagaatatctaagatggtcagaattaggtaggttttaaaactcttatgtttcagctctttccaagtcaaatatgaataactataatccacatctaggagtagaagtaaaagaatggaaatctaatttgcaccccagtggtttgtgacatcatctttattaacatgcacgctctgagtattttagattcactgggaaactgttgatatttagaaagggaatatttctctttaaactggtaaagcttaagcatctcctctgaaaattcttctatcccaggatctctttcctgacataaaactgcatgagctgtgttcttaccgcaagagcatcttcattagcaaacagaaatgtcacctagcaaaaggaagtatcaagaagccggctctctccactatgaattgccatcttggtctgtactactgatcctcaggagcactagttatgctcagaaattgacctaagacattatttacagattctgtgaatttctaattacctttgttcacaagaagtcaatcatcagtgcttatgaagagtcacctatttgaatgacaaataactaagtgctggagatttattaaaatgaaattaaatgctacttaaattatctttcacctatccatttgcatttctatttttccgactgtttttctagcagttctattgagcctggtaaggtcttcacctccatcaggcacttttagggttgaatgcacattggagtgatctagtgtgagattttacagaacaactattccacctttccaatatcccttctgtgttagatttctccagagtacacagataataagtggccacattatatcttgttatataagtttgcactgcagaaggaatggtctgagtcttcaaggagctgacatctttattagagacaaaagacaaatatatgttaaaaaaagagtagcccattcaaaaaaagaaatcagtccattacagcaaatcttcattatatcagctaactactagcagtatggactgaaaatatggatcagtagtatgtatatagaagtgacttgaaaatatccataattacataccagttccactgaaccaagtaatgtatcatgtaatgattattttatagcaaagttaactatacaggctttttctataaaatatgtcctatatttccactaatgtccattagaaaatgagagatactctccattttttaaatcttcaacatttttggccaaaaaaatatttaaatgcaatcctgcagcatgttaagaatttaactgttttactttctgacattttaattctcaaaaatagttcatttggtgtcatagcattttttatatctttctttgttcaagaagctgcttctgtcaccttttcccctgacaccaaaggattttctttatattcaaggatcccctcaaatttacatcttctaaaactttcctctcatctttctttgcatgtgattttctggtatcttctggattttacttatttcataagtataaaatttttatgagtaatatgacataaagttcaattactttatcaattctagacattcaaattcctcttatatattctacctcacttgcatgatacctatgttagtttgtattttatttatatttgttgcacaaagccattactttgtaaaaagtattcttatactatactggaaaaagtgtagaaaacctgggttctagtcttacattgcttgacattttctttcatcaatattagaatgggaatattgtacttgattgtgttcctttgcccataactttttaattgtgtgtgttttttatattcatgggcatttcaatttattatcctccccaggtctagaaagcaaattgaacttttgaaactttttctttgagagaaaggaagtaattttattcatgatatccatttcagttagtaaaaatgtctttaagcagctaagtggctccccaaagattaaatgtccaataagtgaaaaaatcggaagtagactcctggccccctggtttcccacatcaaagactagctgccagatacatttcctcctaccagatttctcttgaaattgtaatttgtcatcttctgagtagtagacaatgaaggcctaagatttattttccttgcaagtgaataattagtgaatgtcaatttcatgtttttttcaatctgtgtgaaagtcaaaaatagtcacgttaattatacttagcaggcacttttctgtgataatacaccaattcctggagatgacaaatgtaaataatatttactccttaaaaggtaatctaatctggtattatttataagttcatttaacattgtcttccttatagataacttcaatagtgttttactaattagatataagaaagacagtcccctcatctaaacattattttatttacacttgcttttaggtttttattgtttctttattttcttctacacccccttacagcacaaggtatctcaaacctcaagcagctaccatctggcttgttttatataactctctcagcccattcaagtggcaatacaccagcgaagaataaaaagatatatattggatggagcccaagaactgcacccaaaatagctttttaaaagtcattgagcataacagtgggaataataggaaggtcttaagcggcagctgctcagagagcactggaataattctctcatcatcttgccacaggtatcgtccagaaagcaacgctcctagcacctccactttctttttcactttggtttttatgtctatctttagtttttatgtctatcactcaaattgcaacagctgacaagcacctgggatttaattcctgccggatttcatacattcacattaattttggtaatttcccaattgtaacagtgagaaccttccccaatttgggtgagcagctttaatatttcattgcatattcatgtatcacctcacgttatttttagtttctaaaagagatagcagacgaggcttcataaaagattagtaggagccctagaaatagctttatcactattccagtatatttcttttttcttttcctgagagggcagaaaaggattcccttcaaagaaggcatatttggtagtgaacaaaagggaaccttcccaagaccactagcaatctcgctgatatgttggaatgtctaattttgattctctcaagacagcctaccacaatgcccctgttcagctattgtagggcacaagctaatctttacattctgtttccttcctcccaattcttctcatttgaattatttaaggaatatgtcatgtttcattatttctacatttctttcactgaactatcaagacttgggaaagaaacacgtctttttaaaaaacacacacatgtacagcacaggttattccttttccatttcaaataatttattcgcattatattggtgtcttgtaaatttcatatttattgtgctgctttttaaaataattttttaaagtgaaatttcctattccagttccctttttcatccagagatttttataagatcatatagcatgtaatacagtaaaaaactcaacataccagaatatatttttagaatagagacattctacaaatggcaggagattttttccattttatgccttatgaaaaatggatttggaacttataaaaaatgtatctggaacatctgagtgcaagatttttgattggattttagaattcagatctatgatttaaaagcaatttcttcctttctgaaagtgtccatgtcaaattgatttttaaggagaaagaaatggtgtaatttggattttgaacccttttctcaggacttagattgttttcatttatcttgacttcctttatctttattgcatcctcatggagttggaaaagcatgtgttttcacaacttttttttacaagggttgaccacaggcaaagccataaataaggctttattctttgttccatttcacctttctagcttcacatctattcaatgccaatgtggctttctagctaatactctttttttctatcttgagggaaaagtcttaatattttgtagcatcactccaaaaaataatttgcttttttccccccacaaagagtaaggagagaaaatagttaacacaaatgaattaatcactaatggctgactttcaagtaaaaatccaatgaatgtggagtagttgtctaggagatgtaactggaaatttttcaagtccttgaaaatgcatagaagaatacagagtcccactttattattcttataaaaaccaaagatctgagtatcaaatcactaacctatttttttttatcttgatgctcaagctctgaaagtagctctttctcagtcaggcttctaacttctatgatggttgcatcaactttaatgttctaatttttagcacagctaatggagtaaactgtaactgagtaaaaagatgactagaccactatctagctttctgacttttggaagcaaccatccctttctgaatgttatttgcctcctctaaaattaggaggctcaagctatttcttaaaaaagagttctgcaataagcttcttgggtttgaattcagattctatcactttactagctctgtggtcttgtacaaactatttagtctgtctacactttaatttccttactgtaacatggagatcattgcagtatctactatagaaggaattctatcaaatgatgttggcctagttgactttcaataacttttagctattgtttgattcagaggtatgttcaagtcattatagctatgtaaaacaattaaaataactgaaaaatgtgaacaattcccaaatatttgtataatagctgacattttattaagtgtttattatatgagaaacactaagttcttgatttgtatatttcaattattcctctcagtaacacagtatagaagatataattatccctggtttacccatgaaaaaattaacctaggaaaagcatggtgactcacacctgtaatcccagcactttgggaagccaaggcaggcagatcacctgaggtcaagagtttgagactagcctggctaacatgacaaaacctcgtctctactaaaaatacaaaaattagccagacatggtggttcattcctgtagacccagttactctggaggctgaggaaggagaatcacttgaacccaggaggcggaggttgcagtgagctgagatcgtgccactgcactccagcctgggtgacagaacaagactgtgtctcaaaaaaataaatataaataacttaaataagcacacagtcacacaagtgaaaaagtgctggaagtggcatataaaggggagcgtgttttcccccagagttcactcttttaatcactggactgtattttgccttccactctggtggaagacctctgccttcagtctagatgactaatgcataattaactgcagcactacatcctgaagaaaatcaacctgtccatgtttcttgaatcatttttacaattaatatctgatttatatttcttcttttccgaacttgccagagaattttagaacatgatgcatatatatttttcaagcatgcaaatccataaagtcaaagagagtttttgaaccacagcttgttactcccctaccttctttcctgtcaaaatcacctgtgaagaatcaactttctcagaaagctcagcaacttattgagatttggcctggaattcacataaaactagataaaattagtgctaaaaggcctataagagcaccataaaataattgacatcaaaacacccacacacacacatacattttcatttcaaatgtaagaagccagagctctgaccccattgctttccatagctggcgaaaagtatgacttttgaaatcgatacattgcaatctccatgttaccatcctagtgcagtactccacagcaccggcgccaggaagaaacatcagtgtttcattctccagattaatgatctcctttcagagaaatgactttcagctattttagactatatgcccttcatttgagaagcagtttgtattcattcacttacagtcaatattcactaatatcatggattgatggagttaaaaagcttttcattagttctgttagcaaggctaatttttatagcatttgatcattttacttctagttgcccctctttttttcagaactttgtgtcccccaatcattcttttgatagagtaatatattacatgttttgtatctacaaagatgtgtccatgtccccaataatgagagcagctactcacaaaacaaggttcctgtttcttgaactaattatgcacagaaatttctacctctcacttaccaatgagataattaaaatgtgagtcttggagcagagaggattagaggtttagatgcttgtataatacatatattactggctagtaatttgtactgaaaaaaacataaatataaatatatatatatgtataaactctttgctccatttctcatgtatcttattatttgtttatttttgcagatgttattattcctaaattcaaattggtcacaggttcattcaagaaaaacactataccaacgtaactacataccaattataaaaataaggaatgtcttgatgaaacatagatatggggatagaatagatattcctgatctctaagtgtacatcaacagtagggttctttcctcattaagtttaacttaccaagaacatgtgtaaaaactctattttgctgttcaaagacattcacatgaaatttttttagtgaagtagcagatccaagtacatgaagagccttgggaataaaaataggcaaagccttataataatgattcctgctaatagaaatatttataattacactatgacatcctgtttttagttgctatgcaattaacattttctcttttcttctacttcctcttacacttatacacatgaggatatgtgggtttcattatgccaggatgactaggtagagacatttgttgatattttaagaattttaagacatttctagacttcaaaaatgcatggttagttgtttcttttttattgtcaaaaacttgtagtggacattgctatgcttcagggacttcacacatacataacatctcctttaatcctcatgtaacctctgaggacttgctggtctagtatggaatatgggacatatacctgaataaccacaacttaagacacaaaatggtgacggccatgagcaaggtacagagatcagtagccataaccgtgcagaagaaaaatgttgcttctacctgaaaaaaataaaaaaggttcctttaagtggtgacattaggagctgacctgaggggaaaacaatggtacttttaatatcaatccacccctataacttccccttaactttagatgtgtatcattagcattattcttgtgttaaaacattagggggatgctttggcaagaacctgaaatgaagacaagcgtgcaagtaaaaaggaaagagattgaaggtctaagaatgtcagaaatacctagcaaggactaggagtgagaaggaacaggagtgtgtgttttagtgaaaagagatcacataggatgaaaggaaccaaaatctattcctaaggagttaaaaataaaaggatgcagagtaggaaaatcattgtttgattctcctttgatagaattaccagttgatatcattaagacagtctagtttatttgttgcctgaattgacctatgcagatgccaaaggagaccttttgtcttcaggatgggtagggataaagtgagaagagtttaatttctgaccccatgtacaggacattggaggctcagatgctcattactcggggaatactgatgaggatgaaacaagaagtgcatcatctactgagggtctggaagtttactatcgttaatatctacaatgtggagggtggggaaaggatgcaaaggaggaagagacacttgttttgaaggtgaccaagatgacctttaccctatagctaagctgaatgaccttgctggtaggtgaagtattttgcgaaaccattctggctcacttaggggccagccttgtggattgtcattattcatagaaagacacagtgtctgctcccaacattgacctcacagtatgagagttgagtaatatgaatgaattatttattacttattcaaattttaagactcactggcctctaatagaaccaaaataagaaatttttttcttccttcttttccaataagttgatacctctatctatgcttctcacaaatggattctctacaatcaagtgattcctttcaatactgtggactcacaaactggctaattatacctgaattaagggcagttccattcaggtgattctacatttcattttacacaatgccatagccaggaatgacccaaaacaatttcttaatagcctgaaagagttccttaactttccaacaaacttcaggaaaaacacataggataattaaataaatccaggaaacaattttttaaacattttctttatactagggttgagctagacactacctaactctcaaggagtttacagtatgactttttgaagccttattttttacaaaaatgaaatagatgtataaataataaatataatgctaggcaataagacataagagatgtactagggaaataaataaattttgactgggctggctcagagaagaagaaaacagttgacttagaacttaaaccattacaaggattaggatagtaaataattaagtgggagtggaatttgggtagaaagtttgccaggactgaggaaaattgagctcctatcaatatggtgagttaattaatagagttaaaattcaggtgtgtaacccaataatttactttcatttcctggcttatcattacttatttccatactttcattttttactattattaagattcatcaaagctgggtattgtgcctcaaaccagtaatcccagctattcaagaggctgtggcaaaagaatcgttcatgcccagcagttcaaggctgcagtgagctatgatcatgccactgcactccagcctgggtagtgagaaccccatctctaagatccatcaagtcagcatggccaaaatatcttttgttcaatacatgaaaaatggatgaagctaacattaaatatcattcttatatatttcttcatcaaattccacattttttatttttaaaatgattcactttgtattgttttattttttcttacttcttaggtatttctaaatcccaatatgctctgataaataattatcatagagcatatgattttaagcagagatgctaattggctttaaaaaatacagactcatgattgtaatcatctaactgttgttgaaccccaaatttcaaattcctgctaagcactgcaactcgtataaaattattcagaaaagcagtgttttatgcagagtgagcctctgaggaaaaaattatctatagtctaaataacttttgcaaataggcctactataaaatttggtaggctgatttttcctgtctctcagtaaatctagtataacattgaaaaagatcaccacacttggtttgaagtctaaatgaaataataggcttgatttaagagccatattgtatgaaaaatataattgttttttactatttttttcctgagtgggtatgattggtgtcacctatgtttaataatgtaactactgcagtgggtctcaaagacaagccacatcagattcacctggagggcttgttaaactcagttgcaaaattctacactcagaaagtctgaagtggggcttaataattttgttattattattattattattattgtagagacgggtctcactatgttgcccaggctagtcttgaactcctgtcctcaagcaatccccctgcctcgacctcccaaaattagaattacagacatgaaaggatttttatttttaatgagtaaccagtgatgccaacgctgctggtccaggggacccactttgagaaccactgtgtacacacacacacttgaaacacataaatatatatatcttaaattaatttgtgatcatgaagggtatgtgtgtgtgtgtttaaatgcctgtgtgattgtacatcattcaaccagctacattttttaatcattagtcatttcttattatgtggcagtgaatataaccacttctaacctatagaactgttttgatgttcaaaaccagttctcagctgctgggaatgccttaaacgctaaggtcaaattgtcaatagaatcctgcctgcgtagacttaataccagtaagatagatctaaaattggcatttcaataagctattttgctaaactttaataacacaaattctgttaaccttgaagccctgattaaaacacaaataagcgagaaaatccctattgttaactgagcccattttgcatatttattgctacatcttttaatttgtaaggccatggcagactgtataatgaaatctgctctctagttgctaggtctttctttttgtcttttccacattatattacacgtaggtgctggatgtcagtgtagtagcagcttacctacatttggagaaaatataaaaacctttgaaaaatgtttgctatcattctgtcattcctttcttaactctttttcctatatttgtccatcatctgttttcagagtccaaaaattttaactagttttttcactccaccaaaatgaaaattctaactatatttatttagctatttattttttaaagaaatgctgcattttgttgggttgagtggtatatagagtctaccaggtgctttgattaattcagagttatcctttgcacaatcatatatttgaaaaaagagaggtaaccctgaaaaaaaaaaaaaaaaagagaatacagtatgaatgagctggggttggagagtttgagaataccgaagttcagaaacatggggactatttggcacccaagaaaataaccacatagtcatcatcaggttttgggactgcttatggggaggaaagaggatgcccaaagtagtttaatgaaacactgaaagtaatgatttaggaacagattaaaagatgccagattcatcacttcatcacatgatctgcctttctttgcagtctaacttgggataaactaaggaagaaagtatgacaatcaaattacctgcttttcctgtttttataaaattatgtaaaattatagaagacaaagttaaaactacatgtcgcatttcaactactgtatctatggatttcttactgagaactgtctccagtgacacaaataattttaaattgcatgcattgtttatatttaaagactacaaattctctttatttcttcattcaacaaatatttattatgcagcttctgtgtgccaagtgttagctgaaggaaatatagttgcgaacagacatctcttgcccagccaggtagttaagacatactaagaaacactaatagcaataaaatgtacatggagctatgtacatttctaattctgttgttgttgttgttgttgttgttgttgttgttgttgagatggaacctccctctgtcaccaggctggagtgcagtgtcacgatctcggctcactgcaacctccacctcccgggttcaagtcattctcctgcctcagcctcccaagtagctgggactacaggcacctgccaccatgcccagcaaatttttgtgtttttactagagatggggtttcaccatgttggccaggatggtctcgatttcttgacctcgtgatccgccctcctcagcctcccaaagtactgagattacaggcatgagccatcgcacccggctgtacatttctaattctatatctgggtactcctctcaaactcgaagaaccttaatttggaatttaatttcaattatatggaggaaaaggaattagtccaacctctataccttttcttttagtaacaactacagagcagaaatgtgtccctttaacctttgaaggggctattttccctttcaacacaacggaagaaagcttcagatcagaactaattgttctgtgattgattgatagtttccctcttgttgctacatacagcccaatgacatgcattgtacacacaacaggaggtaagagagtcaatcaattagggaaacaattagttccagtttctacaattcatttgatgttgtagatgaaattgcctgaaaatattaagagcattaaagatcagtggtgaaagctaagtaaatacatttatattcaaattttagaggcagatgcttagttgatgctgctcttctgcagataggcgatgttaatgcaataacaattacagtttggcagcaattaataaatggactgtcaaaatcagtcaagttgtgttcatggttttggaaggctgctgattttagctttgacaagatgtggctgaagtgttgctgaaaaactcaaagtgattaattaatttagaagatataattctgtgactccccttctatgggtagtagttggaaatgggggaacccaaacattcaatgcaacctgatgccttctttggggtccacatttaattagtatttatgtctagtaaatgcaatgtgtaggaatattctaagatttatgagattgatgaagttgtaaccaagaaaatatgacgcaacttggagtaatataattgatgagatcttcaagtcatacggaattctagatttagagcttttgttgcgatattagggtacaaaattcagggtggggaggaaattaggatggactaagagtgatgggctagctctaagtgagctcaaagctatgtctcatgcagagcaatgtgagagacaggtccctctcctcctccgggtaagaaagcaaaaagaaagttaataaaaataatcaagaacatttcatccaaaacagtagaaaagagaaaatgcttaagaattttactatatttcctcaaaagcaaaatataggaacaagtttaaagccataattccatcaaattttgagtttatatgttagcctattcttaataatgatcaaagctgcttaaacccagaaagtaaatcctgatcagtttcacattatcttttagtttgttcagcaaaagaataaagagaatactgatgttaacatgtgtatgtctgtagtatttaaaatccaacacactctggcagaaatgttctagagtgactcaaatttgatccctcagagaaaaagtatattttttaacaaggtaacactgttactttgatgaataaatttttttctaaaaaactctggatacaactaagacagctaagaaacatggaaagcaaataaaacatcactatcacccagaaaaaataagataatactaatagagaaaattaattctaaatattaaatccatttctagaccaaaacagaaaagaattcacattaccttattcaggtttttctaacctttcaataaaaatcttgtagaaatttgttataaaatttcattttgtaatttaatattaggaattaattaggagggaaaacaaattgatattctcagctccttatctttggcgttttagtacttacattgtctttcgtgttctaattaattttactaatccctttagctaatgaataagtaaatgaggaccaggggaaaaattcatcaattgcaagaaaagtgtagaaaattattaattcagaagtaacccataacaaccacagtgaacttgtcagtattgctttgctctcttgctaatattctaatttctgttttattattcttcatagagcaaaatgtttcacagttaatcttaacagtacttttgtttctaagccttctaaaaggcattgatttgggaatagccaaatatttgaatataaattgattttatgcaatacacagaaaacaagtattttattgatataagtggtttctttatttgtagaattacacttaaaattattttgaagcagcatgaactctctctggacggttttggaatttcatgcccaaatcaacttgaacattacttttatatgagctttttgtcttctgcagtagcataaatgcctatggatggaagtgtcaggggagtagagatggagataaaagcttcaggaaacaagatgtaagtgtgaaaatgacagaatgttcatgtgggaagaaattgctataaagcttttctttccttcattcctcttcctaaaagaaatacttaaattttaggacttcagtcattttctttcaatctggttgataatagcaggagactaaggcctactttatatattaagacagaaaatgctcagacattacagagacaggcatgaagaaggggaagcccgcatgaatttttggaatgacaaaccttctgtgctgatattctgatgtcagttgacattctgatattgattttcagacttccttcactgaggaagtagttataatctttaaccagcatggccaagaaagaaatctcaagggcagtagagacttttgctgttgtctaagttctttttatcctctttaatgccataccattcttacctctttggaaggctgtttgtcattcacaaccaattcaattcaattcagtgtctgatgatggacttctacaaagtgcatcttaatcagcagatttccacagagacttttcctctctctaacaccctctgcaaaatgctggctgaaatttttacttgttaccatgaataacagcatgattttgcagctacatgttcccctctttcaaaattgaatgctctatatccgtttttccctaccagctgccttccctctctccactgtcagcattttgtgatgaaaaagattcagttacaatatgtgccccatattgtgtaggctttattttcactcaggctttgagtcaggcctccattctcaccatagaaatgccctatcacctctccaaacaccaattctctctaaaattaaatttattctgctataacatgcaaaacctagaaatgcatccaaagcctgcttctgacaccagagaaaaatgaaaaatcacgagcaaattcacctaagtttactcacatttatgttttactcccttataacagagtaatgcaaaattaggtttatatcaatataaatacgtatcataagcactatcaaattttatactgtggtagggattgagacattgtgctgagtattgcaaatacaaatgttaataaaatcctatcccaaaactcagggagctcagagctgattgatgaaatagatacataagaagataatcatgatataattctagaaatgcattaattcctaaaagtcttgatcctttccctttcccaatataatggtgaggaactttgtttaagaaaatatgtttaagaataggtagcataaatttttttttattagaattataaagagggcttctcttcctggtgacatcttaaccacaagagattatttatgcttcctaccaaaagctactgaaatggtagaatagaagagagatgaaaagggtgaaggacataaaattctgtgcaacaagaaagtaccttaacaaatcagaaattctgaaccgtttccaagacatagaaagcattttataataattgataaagataccagatctgagaaaactgcaacccagaagtgcttggaagaaatgtgctgcagagagaggagccattttccccagctggcccttgatagtctaacaaattgccaaaggatttctgcttggagggtaattacagtggagtaatttattaaaggagaattgcctcctcacagctggacaactggctccagttcacatagaggtacttagagccactatgagggctctctgagtaatgtggacagggtgtaggagcaaacaagaagcaaagcacagtcctctgaaactcaaaagggtatgaaagagtaagaatagcccctctgccagacagaaaatgctgtccgctcccagaaaaattcctcctttaccttgaaaaatgagggaactcctagcttatctactggtacctgcccaggcacttagaaggaaagtctgtgtcaccatgtgtaatactctctcagtcaacactttcattcagagaagaagtaactggggaaagagatttgcccagtttagacaaaatctataccagtcataagattaatcaatattagattccaacatagagtttctagcttcagagtccatgctgttatccagataataactgaaccaatctacataattcagaaacataatctgtccaccctccctgtcatatatatcttgattaaaggggattttttgtaagccagataaatatctaattggtgaatcatcaacctgtacaaatagtgaaatggtaaggaaatgtattttggaatcagagggttatcacatgggtcagcccatcatttcatggagccatcctttgatcatttcccagctgtttccaattcccagagctttttacttccttcattgttgatgccatggagcctctaaaaggcttatagtaacgttcctaggatctgtagtggaacacccatgctaggcaagggtgatttccccatacgtattttttggaagttggggcttgtaaatagttgactaccttgactacctctaagtgtcatgcaaagctgagccagagccaatgagagattctagccagtttcacaaataatcctgaataatttatttggcagcagctatgattttatttaaaagttgataaatctgaaaatatctttagatcctattctataaagaaaggcaaacaggcttcatcaagaaattgacaaaaatactttcagttctgtgtaagtcaaatcgatgttgctataaggccaaaggatagtgaagtagggacgcaaaaagttagccatattccaggatctgaccttcaaaattataggctcaaaaatttgtttaaagtcatctttcggtgtgactgacactacccaattcacaaggggctaatatataagccagaattttaataattgtttagtactgcgtatctaaatacaaacatgttttcttccaacgatgcatcatagtttataactagactgatgaaataaacttggagtcctagtcatcaacaatcttgagctacacaataggaaaaggtgcagatcttccatatatctgttgctttgcagtaaggtagaaatgacttctacttaagaatcttaaaaaattataatagggcttttgataataaaagacatccaacaacttttaaagtggaagtttggcacactcagtataagcactttagatcatgttttagttttcttttaatgtcataatatcaaattattgatcagtaagtatgaaaaaagtctaaagaaatgagccaactgcctgtagaatgacttcatatcagtgaaattatagtatctataattactgaataaaacatgaaaaggcaatttagctccatgtattgctcttgtcagtaagccagcatgcctgtttatcatgtaaataggatagtagttacagatcatgctccaaatcagaaactatattctttctaaactctttatttgaagatctgagatgcaaactgtggtatattcatcagtcttattaagccactcagatggcaatggcattaagtccaggcattggccaaaatgaaaataaaagttaaagagccagagataatgaccttttattacagttacttacttcacaatgttcaatgtcatgttccaatgtgagatggtgactcaatggtattttataggaaatctgttcttaaccccgctttcttaaagtggtgtgttctgggtttgtcaagacgaaggaaagatgtgaaaattcgccatggacatatccctaactttattaaagcgtgacttgttgaagaaacagaaaataaattgtttcttactaagaaacaaaagcaaagaagaaagagaaggagtcagggaagaagcaaaagaaaaggaactcactaagaaacacatggagattatgccatgtaagaatcacaatagggcacctgcctttcaaatattctttccagtcctccaagtcccccggatttatttgtagagtactcctagtagatcaaggtgtacttgtccactgcttcctcacttgcagactttgatcaatgatggacacactaaaaggtagaacattcaattggaatgcaatatataaaactgaacccttacctaaacgtttcaaatcttttaaagcagcttaaaccaatcgcaaaactaattttcttataattcacatcaattcaattcatatttatccagctccacaggatgcagggtgctgaacttcaccataatttacagaatgtagggaagacacaaccctgttttgaataggaaaaaaatgtaatgaaaatctcttagacctattgggaatcaaaagctaggagtcagaggcacatgtaggtaaagagtattagcaacaaggcaagttagcttcgcctagtagataataagcctatggaaaaaaaaatttttttattgtgaaaatgagattgttaagtatttgtgtatgctcgtttttggcagatgtaatacaaactgaatcaaaccgtaagggaaatgtattattttccattacaagaagtcccaaggtatggttgtcgtaggttgattaacacagctgctcaacggcattgtgaggttatggttactttcagtttatagctcgctgtccatagagtatctatctgccttccctttcaccagattctctcatacttacgacatggctgcaagcagttccaggtaccacaggcaaacacatcaccacccagcaaaggagatactgcttcctctgtacgtctttttaaaggttagaaaaacatttccagaaatcacccaacagaattcctcttatattgctacacttccaaattgactcatatgcccttgcctaaaccaaccatcggcaaaaagaataggatttccatgatcaacatatagactaataagattttcttatgaaacagggataaggtaatctccccaaagcagtacttgtcagaaaaaaaaagtggggttttatcttaaattgaaaggaaggaatagctgttaggtaaaaaaccaacacactgttaggtaaacggccaacaatcttgcttgttattttttcgtagattgtagatactgttcattcttgtctcatgtccccaaattaattcattggcacacaacagaaggtagaatttggggagaagtctcctgtaattatttatactagagtatattttggattttaaccatctgcgtacatggctgtatccccagccattcaaatagtgaatgaattacttgagaattattcaaagcacctagtataatgttggacacattgtagacacacagtttattcattcgatcaacatttatctattcatttattagtaaggcagacttccatggactcagagctggcctgtttcaatttaaatcctggctccaccacttactagctgtgcaaactttggcaaattctctcatctataatagagagacactgtaataatattgcctgactcatgaggtttattttgtgagcattatatgagcttagatgtttaaagcacttataataatgtctaggtaatagtatagcttaataaatgttagatatttttatttattgatatattatttctaactggtaggttgcaacattttccatcatcctatttacctcagtctgaactgtgtatagatggattttaaagttttgcttcactgtgtgacaaaacaatgactgtttgaacacagtgtgataaaagagggctgtgagctgcaagctcagattttctgtcaagtgcctgcagctcagaaacagcaagagttcagagttgagtttcagcaaagcaacggagaaaggaaattccaaattatttatctgtaacttctataaaaaacactgagagccgattggcttgcttcaactaagctatatctcttcataactaccaaaagcatctagtaccatcttactatacaaaagttagagatcacttcaattaatattctatacaatgagtacagtcactaaaaaaagctatgtcaaattgatccatggaagatttcagttccatctctaggcctttacatctccctcttctatcaaaaataaattaaaaagaaaaaagagagactttgctcctgttgtaactttttttttttttttttttttttgagacggagtctctctttgtcgcccaggctggagtgcagtggtgcaatctcggctcactgcaagctccgcctcagttccatctctaggcctttacatctccctcttctatcaaaaataaattaaaaagaaaaaagagagactttgctcctgttgtaactttttttttttttttttttttttgagacggagtctctctttgtcgcccaggctggagtgcagtggtgcaatctcggctcactgcaagctccgcctcccgagttcacgccattctcctgcctcagcctcccgagtagctgggactacaggcgcccaccaccacgactggctaattttttgtaattttaagagatggggtttcaccgtgttagccaggatggtctcaatctcctgacctcgtgatctgcccgcctcggcctcccaaagtgctaggattacaggcgtgagccaccgcacccggcctcctgttgcaacattttttaaaacactgtaaaatacacctgaagtttttataatgcatttgaaaaaactcatatcttttcttgattatgaacctgccattcctactaaaatcttgggaggctttttagagccagaaaaattctacattattcagtggcacttttaaaataaatatggtttttgaaactgcaatgatattttatttatagagaaatgaatgcgtaataagtggattatcagcaaaacaatgttaaacttgtgaattcattaatgaatacgtttttagttacaattctgatgtaccatatttttaagattcacatccctattgtaggtggaaaatgttcaggtttgtataaaaccttctgattttctgtatatcactttagtaattcagtacttgaattttctcttggatatgttttgccagtttgtttccattcttttattctcaataatataggtccaaaggggaaaataacatagcaatgaatatagttttcacttggctcatggatttatttttattttggctagttcttctgaaattcatgttgactacaattgctaaatataattgtaattgatcttctgagaacgagaaacacagtttgtttaaattttttttaagttttccctttccaatacattatttataaacaatactcatattttctcctcattctttaggaaatacgtatttcatgtactctaagagaccattaactacaagatgcaccattattttatatagcactaaggaagcatgttgaaaacagtttcaaaaatggtttcatataatttgaattttattttgtattaaaagattatttagacttatttagacagatttcattttgtcactcttgtgcacacaaaaaaaacaaaaataaaagcaaaataaattggttaatgaatttctaaaatttctaaatctgttctcaatactcagatttgataatgctctttttttcagataccatttctgcaaatattgctttactgttgcctccaaaatcttccaaattgcttgactctcattctgctagttttgatggtaaagccaatattaaaaggtttcagacgacaacccagatgcagatcccttctttaagtcacctttgagtgatttgttgactggaacatcagcaggaataataactgtgttgagcgtacgttgagcaaataacaactgggcctggcagacagtgatagtaagataccacagattttaagaaaaatccccatttcaaagatgtaaaaaatgtgaaaaaaaatattgtgaaagaatgtattcagttgagtgtttaatccatcactcaaccatcagtctccatggcattttccttagcttccatgatgggatcccacatcactcaatgctctcagttctaacagtcttccatgtgcagttaggaatgcacagtgaagagttactgacaaaattcattacttctggctataaattcaaatgatccagaaactaacaagactagtgactccacacagtaggttttgtttctcataatactttcttgattacaaggtgcagatacttagatcatcatcaagtgggatactatgtagtgaaactcagatcgaggtgaaaaccaggccaacagaagtggagtaactgcaaggatgacattggacagtgatcacagatgtgagccctgggatcagatagccatactggaatcctggcttcaccacttattaactctgtgacaatgagcatgtttatttttttctctatgccttagtttcttcaaagtttttcatagtttaaattcctagggaatgattcttattgcctaactcaccttttcatgccaaacagtgtcattggcctcagtccaatgagctgccattgaatcaggtacacattcctcctcaaatttgctgtgactatgctgtagggggtggtcacacaatgtgcatgagctctttcccacctttagagccatgagaacaattttactgaaaaggagctatcgatgggcacacactggatttcatactttgagtacatctcccacccaccacctttaggatcaagggttagatccatctctcctcagagaaaacaaagttttttgtttgttttaatttgatttgattttaggttccaggatacatgtacaggacatgcagctttgttacataggtaaacgtgtgccatggtggtttgctgcgtccatcaacccatcacctaggtattaagtccctcatgcattagctgtttgtcctgatgctctccctgccccaccaacaagccccggtgtgttgttcccctccctgtgtccatgtgtactcattgttcagctcccacttatgagtgagaacatgcaatgaaaaacaaagtttaaaaaaagaaaaaagatatagagatgttaaactagttgggccagcttggaaacaaatctagaaaaaaatgacactttttgacacaggatgttattatgatttttaaacaatgaaaattaggattagatgggaaaatagctaaattcttaatataaccagtctccttccatctttaagaacgacggctcctaagcttttgctcaacttcaagagacagggatgggagggaatgaacactggagaatctagcaaactacataagaaaaaacaagaaagaattctcattaacaatatgaaatttgcaagttggtaagtcagttttccaacctctggaagtaggattacctagctacttaaacagtttaacccctggtttttaacacaaacatttgccttttaagctatttgttcattttgagaaacttacagctgcatctctctgcacgtatcctttttgggcccaaatttcctaattcctggtcctatttgctacttcttcttcatgctttcccacctgcttcctggaaatcagagtcatgttcccaattatctaacaatgtcaagaagataactatgagttgtaatttaccactattggtttcaggagatgacattgtgggggcatatttgagtttccataatgggaggaagggtcagcaagcagaaactcgtgggctgctttaatggtgtgaattgatgtcttattctcctattctccaactgcacacaaagcataaagctcactaaattctcattacttacatcaagtctttagtacatggtaagtgagacctaactaaaaatgattcttgttctcccattagggaaaaaaataatcaaagaaagaaaagaaaaagttaagaccaaggaagggttataagaggaaatggagactgaagcatttcgatcagaatgagaagagaggcagacaggagagagggatacgagaaggaaagccaatagggcttaggaagctgcggagaatttctgaagaaggaagagagaagacatatagtagggggaaaagagatatttaaaggggattcttaggaaaggcagctggtgagcatgcaatatttccttctgcttacattcttccaaagacatcttcagcataacacctctacacacctcttcaatgtttgtattgtgggatttgtgacattgcggaagaatgtttgttctcttcttaaagtaaacctaagaaggcccagttatattcaatttgcaaaagcactatgagaaatacttcctggaaggcatactctttaaaaaaaaatctccctacacctctgaggaaatttttgtgacttgttgaatgggtaaaatctggaggtaactagatccattttggaaaaaatggaagaatccaggcacctgggtgttttaggttagccaaactgctgtgcttccagttgttgtaaggtctgaaaaacaacctttcttcagtagctgtttctttggaactactgccataagtcagctctcatccatagtgacagggctgttcaatctcttgcttcccacttacttccctcaagagaaattatgtttgaactagacagaagatacacctcaagcctgacattcaaacatctgcaaacttatggaggattttgatatgctgctaggctttacttaactgcctaaggatctttggatttggaaagaatttaaatgaaagctttgacagtggttcattttttttccaaaaatatttcagagtaggtgttataggtcagattccctgggaacctgctctcaatcagaggtagtttactaggaaatgttctccatgtaagaaactgaaggaagcagatgtgcagaaggggagatgcttgctgaactgatatgccattacaacaggctttagctgatcctgcagtgtccttcagagatgaactaaatcgaggccagcatccaccactcattgtgtgaaggccattcctgggtaagggggtttaaccttcagcaaggcagctgcttttggtcaagggcaatttctctggagtgactccctggctgtgagcaatcagcaggcagcactgcctgaagctgggggaagaggctgaaatccttattcttgaaagccccagggcatgggaagaactgaatagacctggccctcacttacggattctacctatacccacagcagatcaaggaaaacttggatggaataaaatcactacattctgccctccacctcaaaatatactctaacaccttccataatatctcccagcttctttttaataattattccaagagttagtttcaatatgggacttttctgcattagaagactttttttagtaatattttttcgacctcctcctgtatgtgctttaattttgcatgctattgttataaaatacaatacttaaatagagatggaaataatgctttgtctaaaaatcatgatgctattgcagtatagtagactatcttactatgtaatctgagaaatctatattaatttgtagatctagagataggtataattaaagtcctactaagaagaataatttctaagaggacagagggaagttgtcatagcaatcaaaatcctgattttcctcattttataccacaaaactataaactttttttcatatctcatttttttttcatttttcgtaacttattggtgtacaggtggtatttagttacatgagtaagttccttagtggtgatttgtgagattttgatgcacccatagcccaagcagtatacattgcaccatatttgtagtcttttatctctcacccctctcccacttttcccaagtccccaaagtttgttgaatcattcttatgcctttacatcctcatagcttagctcccacatatcagtgagaacatacaatgtttggttttccattcctgagttacttcacttagaataatagtttctaatctcatccaggttgctgcaagtgccgtttattcattccttttcatggctgagtagtattccattgcataaatataccgcagtttctttatccactcattgattgatggacatttgggttggttccatgattttgcaattgcgaattgtgctgctataaacatgcatgtgcaagtatctttttcatataatgacttattttcctctggaaaggtacccagtaatgagattgctggatcaaattctagttctaacaaaagtataaattttaatgataccttcatatcttttctacattgtattttagccagtggccattttacatattggttaaatatgtagctgcatcattcattcttgagatttagcttctgaattacattttaaagttttttttttttttttgaaaatctgacattaggaaattaaacctcttctgcaagatccagttttctccagaataaaagttttaaagattttttttctttttgtaatttaaaataattcaggtttacaatattttgagaatgtagacatataggggaaaagtgggtattcttccacaaggctaacactttgtaatgcatctttccagcctcttctctgcaaaagatttcttaaagaaaaactggacactttatatactgtctcataatttgtgtttttacctaacactcccatgtatttccaggtttatagatggctaccttttagatactttttataacatcattttatagatcattataattaagaggtctctctgttggataatttctggcacttctaatattgtaaataatgttactacaaacatccttatattaaattgcttttatatccatttaagattaattttttattgagaatttctagaagaaaaatgaccctttcttttttttattattattatactttaagttttagggtacatgtgcacattgtgcaggttagttacatatgtatacatgtgccatgctggtgcgctgcacccactaactcatcatctagcattaggtatatctcccaatgctatcccttccccctccccccaccccacaacagtccccagagtgtgatattccccttcctgtgtccatgtgatctcattgttcaattcccacctaggagtgagaatatgcggtgtttggttttttgttcttgtgatagtttactgagaatgatgatttccaatttcatccatgtccctacaaaggacatgaactcatcattttttatggctgcatagtattccatggtgtatatgtgcctttctaaactttttgatgtgttctgttagtttggtatctataaagtatcctcctaatctagtctccttcctaattgcccagtttcttgtaccctcaccttcactatctatatttagccagatttataaatgaatatgttatcccactgttattttaatttgcagttctttatttgtgaagttaaattttttaagattttgcttttagtttttgtcaggaggtagaggagtttgtatttctttctttgaaaattgtttgtgctgctatttacaatagcaaaggcttggaaccaaccaaaatacccatcaatgatagagtggataaagaaaatgtggcacatatacaccatggaatactatgcagctataaaaaagaatgagttcatgtcctttgcagggacatggatgaagctggaagccatcattctcagcaaactaacacaggaacagaaaaccaaacaccgcatgttctcactcataagtgggagttgaacaatgagaacacatggatgcagggaggggaacatcacacacccggacctttcaggggtgggaggcaaggggagggagagcattaggacaaatacctaatgcatgtggtgcttaaaaccaccacagcacatgtatacctatgtaacaaacctgcacattctgcacatatatcccagaacttaaagtaaaatgaaaaaaaaaaaaagaaaattgcctgtgctggactttcttttagaagataatttaattttctattcaataatatttttcttgataatttaattgtctattcaataatatttttcttggtatatttcaggatgctgaattccactttaacaaactaaatgactgtgtctctaaaattaagtactatgtttcctttcagtaagatgacttgtgtcttccatttactggcaaatagattcaaaagaaaatcataaatacttcttcagtactgatttaattgtttaatgatgcttaaatgttattagtagagtagaccagtagaaggaaccttggatcaggctaaatctgtgtaggaccaatcacttaatcctgggaaagccacactccagttacttctgtaaaataagattgagttacttttcagggttgtaataggaattgagaattttctccttaaatatcaacaacagtattttggcacaaagtaggtgcctaataaatggaatcattagtattagccccttttggtgttattttatattaatatgtcctttattttagtggtttttcaaactgcaggtatcaaatcatgagtggattgtgaaactaatgtacacaactttgagatacaactagaattttttagtgataaagaatagagtagaattgaatttatccaagtatttcacagaagtgtttttatgcgaaacttctcttcagtatataatatctaggcagacagagtgtatatactggatgacaatgtaaaataacctcttaactatgggttgtatccaaaaactcctccaaaaaacaggattatattggatacttgtctcatagtttccaagtcttttgatactatagtggctaagacaccttggttcaaatcccaactccattaattactactatatgactttaactgcctggcttttactgtataacctcctatgacttactttcctcacctatgaaatgggtgataattattaacgagaataatatgaaatattatatgctttaatatgtgtaaaccacttagcgggtgctcaataactgttagcttattttttaaagactgagtagaatatctttttttctgaataagcaaactatgtacataaaagaatataaagtcatcaggctgggcgcctgatggctcatgcctgtaatcccagcactttgggaggccgaagcgggcggatcacttgaggtcaggagtttgagaccagcctggccaacatggtgaaactccgtctctactgaaaatacaaaaattagtcaggtgtgttggtgggtgcctgtaatcctgactactcaggaggctgaggcagaattgcttgaagccaagagatggaagttgcagtgagcagaaattgcaccactgcactccagcctgggctacagagcgatactgtgtctcaaaaaaataaaaaacaaaaaatgaagtcatcacattagccaggactgaataatcagctaattttttcatccacaaaatgatgcctcctgataagcattttatttccataaatatgaattttcaagaaccaagtaactattcttaggtttgctatttacaaacaatattatctctcaagatatgaaggaataaaaataaaacactaggcaatcccttagtctttgtcagtatattagatcctcaattacccacaacatttttgtattttatgatttttttaaatttcacagtggtatgcactaagtaaaaagaactttgtctatatttcttacaatctttttttgattaaaaaataagaattaacagggatgatatcattggctggtaagagttaaaagcttatagctcttacttttctgatgaacaccttccaagggtattttatgtctatagaggattggtttggaaattatagaaacattctttgcttcccttaaaaaaaagctgggtaactttaagaacattttctaaatgttgaccctgtttagcaaaagtcttattgttcctatagtcttttatgtctttcaaactatatgtagaaattttttatgtacaattataagctggagtaaaatgaaaactatttagcaactcaagaagtgaaggaggatccagctatcagtacacacaaaggctagaaacaactgtgtaatcacttgaaagtaggagctgaacatcagtctgaatgaccagcaacaatatcccacctctacaactggacaaaaattaagcagaaacatagttgagcaatatacctttaatgtaatgatggagctattgtacttagctattttcatttaactcaatcatttcctttaaattctacagtaagccataagtcctcaaatatcttcaactatcctgtacagagataagtaataatgtgtgtcacatctggtgtttctcacagcaaaggaaaaattaattttttgaatacgtgcctgtaataatgtgtgtatatgtgtgtgtgtgtgtgtgtgtgtgtgtgtgtgtgtgtgtacaattttagtctggctgactcaatgaaatacagaagttaggacatcattaatatcaacagttttacccaagttgtatcaacagagcaaacaaaacttcaaagttttccagggagatgagctcctaaactgaacaaaatcagataatcagaaaaagcttctgggacgtgacttgagttggaaacaaaaaatttccacattctggacaattctgggaggccaagtgctattagagatgtgtggataaatcaattgatcaatcaattgattgatccactggtagtctgttccattgatccactgatctctggaacaaactaatatgccagtggatcaattgaacaatggagcaatggaacaaattaatatgccagacactatgctaatttttttgcataaattatttcatactcataaaaaccttacagatttggtctgattatcctcattttacaaaagaagaaactgaaaaacgaagaagatctgagccgatatctgtccaattctaccctttaggattatattggtagctagtaatggaaaattaaaaacttaaaaaagagaacaaggccaggtgcggtggctcacacctgtaatccaaatacttgagaaggctgaaaccagtaggatcatgcgagcccaggagctcaaggctgcaatgagctatgatctcgccactgctctccagcctaacaacagagcaagaccctatctcataaaagagagagagagaaatagtcaattataaaataaaaattcgtatctatgtatatgtgttagcctcagccatgatctcctggaagtagatccaaaatctctggattttgattaagattttaataagaatcttatgcatctgagattattctattttcaattgtactttcactaaatatgtaactatgcatgaccaactcacaaatcgtttgcatttctttcttttttttttttttttttttttttttttttgagacagagtttcgctcttgtagcccaggctggagtgcagtagcacaatcttggctcactgcaacctctgcctcccgggttcaagctattctcctgcctcagcctcccgactatctgggattacaggtgcctgccaccacacctgactaatttttatattttagtagagatgaggtttcttcatgttggccaggctggtctcgaactcctgacctcaagtgatccgcctgcctcggcctcccaaagtgctgggattacaggagtgggccaccacgcccagactaaatttcatttttaaaaaaatcttgtttgctggttatctccacgtctttgcaaattaaaaggtttttataagttcgtctactttcctgttaagaacgtgaagtgaatcctgtccaggcctctttacttatctatttctgccccaaatcatgcccattctttcctcagaaagcctgaaatcttaagttctgcaggaaaattacaaagtctggaatatttttagaatggagaatattcgttcatttctactcccttagaataccttccttacatttgtaccttcacgtgttctaagaaaaatccaggaagggcaggttttagttcttcatatttcagaaggtggataaattaggatgtcaaatgccctgttaaagtttatttaactagtgaagaggatgagaactgatgtcttctgaattcacagctgtttgtattgattactttattaattattttggcatattttggaggtaaacaaatacttaaaataattgaatacattaataaaataaaatattctaattaaataagctaaataaagtaaaatatctaaacttataagttatgtttcattagcagcaccttgatatatatagtcaaccatgccacatttatagtgacttaaataattacccagcaagacaagtaaattattgatcagagtattgtttacaataaatgtgaaaaaagtgactggggtgaaaacttaccatcaataaataagattcaagaaccaattactgtaatatattcataacatcttagagtatcaatattatgaataatattacttataaccatttttaaagtcactagcattttgagtacatgttatcatttatcaacatttccaatacaaatattttatctctttcttccttttagaaaatacaaaatatttaaagtataaagcatgtatttcatcaagaattgtttcatacacgttttggtaagatatgggttaaaagttaaatctacacagcaaataattggctgtataaataactaatagatttgacagtatacatagtattgctggaatagaatgctattcagtaactatgtctggtcttaccttctggggaagaactcttcactcgctgtggttccataaatatttcatttaccaacacaaagcaatatgctaatgatggactatttacccagtgagcaggtgccacctctgatgttgtttcatctctgggatacctttgatgtgggagcagttaagccattttgaattgttctgtctttgcttccctcccctcacagcttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccatgtgagtattctatattagtacttgagtaaaaataagtggttgaaaaataccccatccattggaaagaaagtagaactccgtttgatatactataaatttacatttaatttattactatgggaatgatagtatcccaatataaaatgaaatattcttggaaatggaatattcttcttgtctttaaatatacttcataaatgaaaatccagtttacaaaaaaaaaaaagtctgcagcttgtatttaatacaggtaggttgttttctttggtgtctgtttctctcaagaatattaatgtttatgggttctgttatatttattttggatttgcatttatgaaattatttcattgcaaagattgtttctgaacaatagctaaggtttgctttcccaatatcgcaggtttgattttctgtcattcatttgtcatcatttaaaaatcttattgttattttttaaagtttccttattgtcattaaaaaaaactgcacctaagtttatttggataagtatagcactaagtctaatcagtgacatttaattttttaattttatttttacactgacagataaaatcatactattgtacaacatgttggctatcattaataatatatctatggtgtattccagaaaaatgttgagagtgaatataaagtgttctcaccacaaaaataactatgtgagattatgcatatgtcagttagcaggattcagttattccacaatgtatcaaaatatcatgttgtagacataaacatcatgttgtgcaaaagatctctcgaacttatttctcctctgtaactgaaatgtattcttagaccaacatctccccaattgccacctccccacaatcaccacagccactggtaaccaccattctactctctacttctatgaaatcaacttttttagatttcacatatgagtgagatcatgtattatttatgtcctgtgcctggattatttcacttaacaatgttcaccaggttcattcatgttgtcacgaataccacgatttcatttttttatagctgaatggtatctctcaagtggatgtaccacagtccattcatccactgataagacacttgggttgattccatgtcttggctattgtgaaaatttctgcaacaaacatgggagtgcagatatctgtttgtcatattgatttcatttctttggatacataccgggtagtaggattgctggatcatatggtagttctagttttaatttttaaagaaatctccatactgttttccatagtggttgtagtaatttacattcccaccaacagtgtgcaagggttcccttttctccacatcctcgccaacacttatatttgattttttgataatagccattctaacaggtttgaggtggtatttcattgtggctttaatttgcattgccttgataattagtggtattaagcattttttcatatttctgttgaccatttaaatgtcttcttttgagaaatgtctagtcaggtcgtttgcccttcttttgattggtttatttgttttcttgctgtttgaggtccttatatattttggacattaaccccttatcagatgtatagtttgcaaatattttctccccttctgtagattgcccctttattttgttgattgtttcctctcctgtgcagaagctatttagtttgatataatcccattcgtctatttgcttttattacctgtgctttttgggtcatatccaaaaagttattgtcaagaccatgtcataaaatttttatcctgcattttattctagattcataattttgaatcttatatttaaatctttaattcattttagttgatttttgtacatgttgtgagatagagtatagtttcattcttatgcatgtggatatccagttttcccaacaccatttactaaagaggctgttctttctccattgtgggttcttggctcttttgttgaaagtgagttggcagtaaatgtatggatttctttctgggttctctttctgtttcatcgtctatgtgtctgtttttatgcttgtaccatgctgttttgattactatagctctatagtataaaactataactctgtactatatttcgaagtcaggtagtgtgttacctccagcaatgttctttttgctcaagattactttggctatttagggatttgtgtggttccatacaaatttttattttgtgaagaatgtaattggtattttgtagtgtctttgtctggcatttctatcagggcttttctggctttgtaaaatgagtttggaagtattccttcttccatttttggaagagtttgagaagaaacggtattagttcttcaaatgtttcatagagattagcaatgaagatataaggtcttcacttatgggagattttttattactgattcaatcttttgttcattactgatctattaagatactctatttcttcataattcaaccttggtaggttgtatgtatcaaggaacgtatccatgttttcttggttatccaatttgttggtatataattgttcataagagtcccatgagcctttgcatttctattgtatcagttgcaatatctccttttttgtttcttattttatttatttgagtcttctctcttttttctcttagctaggcttgctaaaggtttgtcaattttgtttaactttcaaaaatgcagttttgttgatcttttctgttgtttctgtagtctctatttcatttctttctgctctgatttttgttgtttccttcctttactaaatttgagcttagtttgtctttgtttttctaatttcttgaggttcaacattaggctatttatttaagatttttcttcctttgatggaatagacatttatttctataaaattccctcttagaactgcttttgctgtattgcataggttttgctatattgtgttttctttttcatttgtcttaagaaattttttgtcttcaagaaatgtttgtttcctttttcatttcttcagtgacccattatttattcaagagtatgttgtttaatttccatgtatttgtgcattttttctaaagtcccttctgtttttgatttctagttttatatcatggtcagaaaaaaataacttgatatagttttaatcttcttaagtttattaagacttattttgtggcctcacatacgatctattctgaggaatgtttcatgtgcagttgagaagaatgtgtattctgtagctgttggacagaataatctgtatgtctgttgggctgattagatgcagattgtagtttaggtgatgtttccctactgatttcctgtctggatgatctgtccattactgaaaatggggtgttaagtcattattattgtattacagttgatctctcccttcaggtctattaatatttgctttacatatttaggtgctccaatgttaggtgcatatatgtttgcaattattatattctcttgctgaattttgaccatttttatcattatataatgacctttttatttctttttgcaacttttgcttttattttatttgatctgatacacatatatagttattcctgctctcttttggtttccatttgcattatatatcttttttcattcctttattctgtatgtccttacagatgaactgtagacagcatgtagctggatctttttaaaatccattcagtcattctatgccttttgattggagaatttaacctatttacatttaaagtaattatcaatacttactactgccatattattaattgttttgtagttattctgtacattgtttatttctctcttttctcccatgctgtcttcccttgtggctaaatgatttttctctagtggtatgtctgattccttgcttttcattttttgtatatcagctagaggtttcttctatgtggttaccatgaggttttcaaaaaacatctatagttataacaggttattttaagctgaaaacaaattaactttgatcatgaaaaaacctctacaattttactcctctactgtccacattttgaattttttatgtcaaaatttacatattttatattgcatattcctttaaaaaattattgtggctattattatttttaattgttttgccttttagccttcatactgaatttataagtaaatgacacaccaggattacagtgttatagtattctgcatttgactgtgtacttacttttaccagcaaattttatacttttaaatgtttttgtgttaatcattagcaactttttttttaacttgaagaactccccttagtatttttataagacaggcctggtggtaatgaactcccacaacttttgtttgtctaggaaagcctttatctctcctttatttctgaaagatagctttgctgggtacactattctctgttggcagtttttttcttcagcatgttttataatattccactctctcctggcctataaaatttctgttgagaagttggctgctggatgtattggaacttccttatatattatttgcttcttttctcttgctgctctcaggatcctcttttttgtctttgatccttgacaacttgagtatatgtcttggggtagtcttatttggaatgaatttaattggagacctttgatttttctgtatctggatacttacatctttctccaggtttaagaaattttctgctactatttatttatttactttttttttcttttttcttttttttgatggagttttgcttgttacctagactgaggtgcagtggcacgatcttgcctcactgcaacctccacctcccaggttcaagcaattctcctgcctcagcctcccaagtagctaggattacaggtgtccaccaccatgcccagctaattttttgtatttttagtagagacagggtttcaccatgttggcccagctggtctcgaactcctgacctcgggtgatccacccaccttggcatcctaaagtgctgggattccaggcgtgagccactgcacctggcctactttaaataagctccccactctttgtctctgtcttcttttttatctcctatggcttgattgtttgctctgttgatgctgtcccataaatcccatgagctttcttcatttcctctcattcttttttcttctctgactatttttaaataggctgtcttcaaaatcaaagattctttcttctgtttgaccagttctgctgttaataccctctactgcattttttttctttcattatatttttcttgactccacttttcatttcattcattgtatttcttagctccaagaatacttttttattatttaaacctctattaaatgtcttattctggtctcatattattttctcattttgttttcttgaagttcactgagcttccttagttatttggaattatttgtcaggcattttatacctctccatttatttacagtcagtcacttgcaccttagttttttcctttggtgatttgtttccctgattcttcttgatctttatgatcatgtatcaatgtctgtgcatttgaagaaataggcacttacttcagtcttcacagtcttcatagacaggctttgtctgtgaaagccctgcagtagggtgtggtgctagagtgcatcagaagcccaggacagttgcagccagcatggcatcgccagagcctggggcccactgtggcaggtgaagcactggagtgggcaagaagcctgaggcagatgcaaatggaaagacactaaggtgctctaacagctggatgcagctgaagccagtgcagtgctgccagaagcctagggcccactacagcaggtatggcactggggcagaccaaagcctgggacagctgtggccagcatggcacttccagaatctcagggcaactgtggccataagagtggtgccagaagcctgaggtccacaacagcaagcacagtactgggacagctgaagccaagggccactaatgctgcctgctgctgagggtgacctgaagcccaagacaactgataccaacccagtggcgatacataccagagatcgagtttgccatacgagcctgaagcctggggctttatggtccctcctggcaccagggcaagtttagaggctcagtcaccagtataggtcttgaatataaggccgtggtagtctgcctggtactgagttttactgtgcagttgcaatgctaggctccaaagcaaagtcctgtgctcgcttccctctctttcccccaagttgacagtatctctttctgcacctgtgctgcctggggctagggaaagagtgatgcaggtgttgtagaactgtccttcctatctcttcaatgcattttttcttagtattatgctactaccagttactgtgagctttcatgtggtttccttagctcttgtgaagttattttcatgcatggatagctgttcaaacttatgattttgtgggagatggtatctggagagtcctactcctccatcttactctgcctcagtccagttgcatataatttgaatcttaaactacaacttagtcttttttcttcaagtatgaatacttactatgtactaggcactttcccaaatgctgagaacaaatatttagcactcacagagcttatattctagtgaagaaaagaagttagaaattaataaagaggaaaatatatattaataaatgatgtaaggaaaaatataatagtgtaaatgtaatagggaaggggaaaagcataaaaggttgttattttggggatgaccagggctggtttccttcataaggagatctgaaggaagtggaggagaagctatcacaaaacctggcaaatagaaccaaggcccttaggtaagaatctacctggaagagcaagaagcccagtgtgccttaagtagattgaacgaggtggagactggcagaagataaatttgaatgtagcagaagccatgtcatgtggggccttgtcaattgttctaaagaacttagattttacactgagtgaaataaaatgcctttttgagcagaggtgtcccatgatctgacgggtggtttttttgttttgtttcattttttatttatttattttttattattattattattattattattattattattattattattagagacagagtttcactcttgttacccaggctggaatgcaatggcgtgatctcagctcactgcaacctccatctcctgggttcaagcgattcttctgcctcagcctcccaagtagctgggattacaggcatacaccaccacgcctggctaattttttgtatttttagtagagacgggatttctccatgttggtcaggctggtctcgaactcccgacctcaggtgatctgcctgccttggcctcccaaagtgctggaattacaggcatgaaccactgcgcccagccctgacttgagttttttaaaagattattcttgctacagtggaaaaaaaaaaaaaagcaggggtagcaggctatagagaggcaagggtagaagagaaagcaggttgttgcaataatccggatgagagatttataagagaattattctataaggacactgaaaaactaaatgaagcatacaaggaatcagcttcttattcctcattaattagcaacttgttaatttgtctgtccacttttaagaagttcaagttgatctaagacacacacttagcacagttgtcagtaattaccattcttagcaggaagacttgtaagccagtagagatgaagatggtccaatacatcgaacactagaatgggaaacacaaaatctcagttcttgtccttgctctgctgctgagttaatggactgatacacaaactccgggtacttttgatataactttgaggtcataactaccaggcataaaccaaatacatatattatgggtgcaaactttcacttaaggaatattttatcaaaatgtttacataggagaaatgtgttctagagaagcagagaaagcaatgaacaacataaatcaaattcatatcttggcttttaacaccatcttcctctctggaagaataaacaacatgagacacatggcaaggctgataagtataggattgaaatgctccccatatacgagcctaactcatttacccatttccttttggtctttgcccaatgttagcacctccccaaccacactatttaaaattgcaatccattcatctcaccccatctttgccagtatttcctgtcccccatccttgctttatttcccaccatattacttagcaatatctgaaatatcatgtattttattattttgttttaaattgctctagcttcttccaaaataatgtaagctctctgaaggcaatatgttgggtctgtttatgctcatgcctagcacatatgaggcactaaatacatatttgatgaatgagtggattaatgacaaccaatttaacttgtatcctgagccattcctcttagactttgaggccttaatatgctgacaaatttaagcatcttactaaatcatacattttaaatttccaacacttatgaaagcatcattttaatgcttgactgtgtcataaacgttgaaaatgtaattgtttctttggtcacaactcctccatcttttagcctttctcactcagagccagctattactttattttttcctccctattcattagtaggaaagcaatcagctggaaaaaaattatctatgaaactctcctttcttttgcttctcttgggtaatctcatctttttccttcccaaaccattgtcttagtcctgtgtccctctattgggcactggaaatcagaccagataaacaatctgcttgtccatggagatttgcctttgaccagcaacctgaaataacagaatgtcaaagaatctgagtaccacccctaaaaaatattatgttgctagcactctccttgatttaacaggaagaaaaaagtaaggtaactaaaaccttaaagtggtatggtaaatcaatgttagaaaacactgcatcataaataaaagccatgccatttatttaaagtggtatgttaaatcaatgttagaaaacacagcatcataaataaaagccatgccatttattaaaagtgtgtaatagtatgtattttacactttcattttaatccgtcataatttttcctgcctatataattgacatttctaataggatttatatgcaggaggcaatactaaacaaaaataaaacacatccttaaaatcaaattcctttaggactataagatatataaaggttatcacttttgacttggcataacatactgtgatgctaatgacgggtaacaaattagaatattaattgatttcagtctctgaactaaatcttggctatctggcagatgtgttttttgcaaaattgatagcaaacagctttactctgtcacttgaaattcccacttgtaagaagaggggtgtcacaatggcaaggagtgtgcatgtcattagttgggtaatctgcacagtccagcatgaaacatattcaaaccaaattgcctgatgatatcatccaggccttaatttttttaaattaaggcttaaattttttttaaaaaaaggagaaggaaatggtaaacgcttagcatttttatctttcaattcattcttcacactgttatctaaatgaagcagacaaggttttttagaattttttttattttgcaactttgattttaatatgactagggccatggttggtctgtaaagcatgaactcatgtcatctgaatagctgtgattaaggctttgatattcatgagcttcttgaagtagagtgcacctttctttaagcacagtagaaagtcaaatagccagaacttgactcttagtccagaataagagcaagtggattaggaatagttgtataatttatgcagaaatgttattggatagacagtttaattcagaaattaaaaatacaagctctagccatagactacaagagttcaaaccctagctccactgcatactggctttgtgaccttgggcatcttaattaatttttctgactatcagtttcctcctatataaaatggggatgaaaataatactcccatcatagggttgtttggtaaaggtgtcaatgcatgtgaagtcgttagcagagtgtctggcactgaataagcgctctataaatggtagctattattaaactcaagctgtcactttaacaagtctatttctattttagaaaaaccctctattcaggtcagtcacccaaattgagaaaattccggaaactttgcagccaaatacaagtgcattgcattctttaatcccattccaatgatctctgtgttagagaaggtaaattctctcttggtgtttcttatttcatcctctcctccattttttttttttttggtcctataattttactttctctctccttcattccctttagcctacacacatgctcaagattcacatatctgataatgcctagcaaaattccatacatcgtaggttcttaaggataccagttttctacctttatgctctaaaaatttcttcccctactttacctctcccatcaagctatcattctgtctcctcccttcacatctctaccatacttatttaaaaacgtaatctggaccctgacatctgttttatcaactcccattaccaactcaattcctttcactctaatttccatcctttgcatactattaaaattgtttttactaaagtccccagatacttcccgatgtacaattacgagggttattacaaatattcagttgctcagatatttctgcattattatcactattggccttcatctactgaaaactcttgacttccaggaccactctcctttcttcctcttctttcctccccttctccttcactgactggtccttcttttgttatgatcttttctcccattaggtgttagaggtccttgttttctggggtttctcttttaatcctattccatgtttattctacatgctctttttgggcagtttcattcacctagccattcaaataaaaaaatctcactattattcttgactccttgagcgatttcaccacatattctgtacctgcattcaagttatgtgaactaccttgaacgtctctcaaaaccagccagcacttcactacaccactgtctcccctcatgattttctctcttcctggattccccttccccagtaccctaatacattgttggggttttttttgccattcaagagccagttcaagtgtcaccacttggatgagaggttccctcatttcccaaggcagaaatatatgagtcttctccaacctttcagagttcttcattcaaatctctcactgttttggttacctggggttttctgcctttctcactgaaatgtaaattagccaaaggcaggaccattttcttacacatcttcgtatcccccacatcttgaaagtgtctgacaccaaaggcattaatcaaatccagatctcttctcggcactgtgttgggatgaggaacaacagcaaagctgtccttccaatacatggggcagcctaaacggggaggaggagctgtttcctttgagactaggttaattactgctacaaacaactatttagatatcaaattacaaaaattaacattaaagcaaacagtgcggttcttgtgccatgctcggagaaactgtgatctagaaagcagtagttttcaaacctttttagccaaggattgctttgttcaaatgcagtattacatagatacttaaatgtataaggtcttattttatttcatcatcttctttagtttataattttagtttaattttgactcaaaatatagaaagtgtgtctgtgtgtgtactaccgtgtacgtgtgttttaagagttaccattaaaaacaatcctatggcagaaagttcacctaaagcagtagggttttttttattttttatttttttattttttttagacagagttttgctttgtcgcccaggctggagtgcagtggcacaatcccggctcactacaacttccgcttcccgggttcaagcgattctcctgccttagtctcccaagtagctgggatttcaggcgctcaccaccatgcctggctaattttttgtatttttagtagagacggggtttcatcatattggccaggctggtctcaaactcctgacctcgggtgatccacccgcctcagcctcccaaaatgctagaattacaggcgtgagccaccacgcccagccaagcagtagttcttaatagagatggcactgctcctacaacacagtgtaaatattttgggggtcattttcagtatattaaaaactgcaggaaactcctggcatttagagggcatggtcacaggaccctacacatcctgtaaagtgtgggacagtttcacagaatgaagaattgttctgaatcccacacaaatttcaaaagccccataggacatacatgtagatggaaaccctttctataattatctgaacctaaaactattttctgtataaacacaaagtgtttttgcatggctctcatatatgaatacatggaatagtctagtttgtattctaatgtccacctagcctttaatctccaattttcttgtgatttttaaaaaatcttctgattgtcttctctaaatctaaacatgctttttagtattacatagtttcaagcatttgattatttcattgtgtcttattgtatagttgcatctgaagatttttgtactgaaatagaattttttaaataaattactgtcatttctccattatattatagttgacaaattttattaattttaaaattatgtaggtaggtatgttatattcttatttacactttgagacagaaaaaaaggaatattataaaatatttgttatgaactggggtaatactgattttaaaaaacaaatgtgcagtaggactctatcaacattctctattcaaggtggaatgctaacaaaagtacattctactgatgctacatttcaggaaggctgtttatatgtctccttggattttgttttataaactagtgttgagggatttttataaacttccaaagcacaggtaatacagagtaacagtaagcacaaaaagccaccaagtaaattaaaatcgcaactaagtttctaaactttattcagctacattccattagcatttcaaagatattaagaaaacacacctgaggaaaatgaggggcttgaacaagattttggacctatatccaaaataattcaggaattactttgctgaaacaccatacgaatatactttaaaatagctttaacatctattttgtttttaccacgtagcaaaccacagactacattttcactaagcaaagcctgactacaaaaacaaatctacaaagatgacagaataagagaagctgggagactgctgtttctcctcactcatgactatgtagatctcttattgcattgctgatctgtcaggtttgtgctagtttctattaaattgagtaaagaatttagaagcagaaaccagagggaatgtatgagatataccattatatttttagtgcttggctttatttttgtttgttttgattttcctttataagaatactgtaataaagggatttgtacttgatatcttctgagtccacgtgtctccccagcctgtcttttgagtgaacctaggtaactttgaaataaagattaagaaaatattggcccattgaaagatttcctcactaagcaacactttcattgacactgctaccctggagaaatttcaaaaccacttgaaccctctccttttttctcttctctttcaagctgttttcacacatacaagtttttcttaaaaaaaaaagataatagtagacaacgaataatagaaatatatttgaactgataaatatgccattttctgaaagtagtttatatctgtccataaaaactcagaaaagagccaggatcttgggacaataaactataattgatttagtcatattgttcaatgccttgaaggtaaaatgttattttaatgtaaaaatataaaaaattaattatttaatgtaaaatgtaaaaaatttatttttgtaaggatttggatcagattattttaaatcagttaactattgcagtggatttaaaacactgctgttataatcacgcaaatattactacctaaattatttgttatacttcagtagcccaaaagtggtagcaatttatccataatgctgtcttaatcactcacagattcttagccaatattagcaactaaccgaggttcaggagaacattgtttgctatggtgagcatctatgaaatgaggtcatttgtagtatgagctgcaaagttggtcttcccaagttcaaaattctgactctaccattactagtgtgtgaccttgggcaaatgatataatttctctgtaaaataaagacaataatagtactttacctctgggaaggtgtgagcagtaaagtattcgtgtatataaagtgcttaaaacaatgtctggaatataatggtcacattcaaattccataagcttccactgcatatgtatagagcacctactatgtgcaagactgtatatgccataggaaggagttaaatcaaagcacataatttttctggacctcaacagcattacaactcagaacttttctgcgagaaggacttctaaattaaaatgtcttagcaggacagcgatggctctttatgatatggctcttgcatatgctctagcctcctcttcaactgttcgccctcacacagtttgctccagcacgacagttactaaatgtattatccatagtttttctttcttccaggtctttatacaaattgtctcctctgcctgaaattccttacttgccatagcttgtctacctagactccttctagttagccttcagaactctatttttctttaaagcttttccttttttctggtaccaacttcctaacccactattcctcagcaattctccctccataacaagtttatactttgcatatgtttataaattttacttttattattttgtatttacttgaggccaaggacacactgtcttttcatctttgtgtctccagttccagcacaaaatctggctcataggtaggcagaattattattctcctttagctcaaaggccctcatatcaagttatcaagaaagacttccaaagagctcttacgggaaaagggtgagaggacataataatcaaaggcgacattcactgtgaagctgaaccgaaggtaggcgaccttccagaaccattctgccatgccctctaccccactctactttacaatacatctttgctttttctctctccttttatttcttttctccctttcctcgacctttctttaacattatcatcttctgttccctttctttcctccttgcccctgctgatttaaaatgttcattgtttatttttttctctacctgtctcgtggcagccccatctaattcagagtcaagatgcaagcagccaccaaattggtcctccagctaaacagtgtcctcacccccaagcatgtttattccaagtggagatcagggactcggtgatagcttcatctttttgttttaaaaataacgaattgtattgaaatgtccagaaaataagattagttcattttacatgatgattgttatctaacatagcccagtttcctgtgttttcactgagacagttcaaaagaaacctggatacactgttacagtggcttttcctccagtgggtacttgtgtgaggtttgctttgctgagtagctgtttatacgaaacttgtgtaggtttctgtgtttcaccctatcaggcacacaaagcacagcagttcctcttttcagctacattgtcgatatcaccacaaccgtggatatcatttgaagtggtgcttccacgtggcctggacagccatcttctgcccacagtgattggaactgttctgtcatctcacctttctacagctgctgtcattcatccacctttcttttccggatctgctaatgtggctctaatgcgatttacctggctgctttccaggccctcatcagtagtgaatctgttttgctattttgcattaagtagtcttaagcaccagtgctactgacgtgaaaggcaaggtacttccataaaagcttgaatgtaataatctaacagttgagccctgcataattttaccagtgctgcaattacaggaaaacatataggcagtttcccaaagtcagttgtgctgctgttatcttccattggagattgatgccgccttgcctctactctggattacttgatttggccattcccttaggcagggatagttggatccgtatgtacaaggcaccccacacaatgtatcttactgtttattgaaaatctcgtctcccttggcttctgatactcaattctctaattctctttctttccttctaacattctttctctctctctgtctcctccaattgcctacaggtgggtactctccaagcctctgcctctggcatttttctacctctatgatttatttataatttcaggatttccaatactatatgtaaatcacactcaaaactcagtcctcaaacttgatatctctgttgaactctcctcttttgttaaattaactttattgaagaatggtttacatacaataagatgcacccattgaaaatgtatagttctatgcttttagtcatatacaagcaatgtaatcaccacccccaaaaattgcttctagttcctttctagcaatcgctgccctgctacctctagttatgggcagttattaatctgcttttctgttattacaaattagttataactgttccagcatttcactaaaatggaaccatgcacgtattctgtgtctgatttctttcacttagcacaatgtttttgcaattcatcttgcatgtttcagtagtccatttctttttattgctgagtagcatttcattgaatggatatccatgagttgcttatccatgtatttcttgatagacatttaggttatttctagtttggggctttttctttctttctttctttctttctttttttttttttttttgagatgaagtcttgctgtgtcaccaggctggagtgcagtggcgcaatcttggctcactgcaacctccgccttctgggttcaagcaattctcctgtctcagcctcctgagtagctgggactacaggcacatgccaccatgcccagctaatttttgtatttttagtagagatggggtttcaccatgttggctaggatggtctctttctcttggcttcgtgatccacccaccttggcctcccaaaatgctgggattacaggcgtgagccactgcgcccagcctagtttggggctcttaagaataaagttgcagtaaatatttttgggcaactctttaagaggacatatatttattatgttttcgtttctcttaggaagtgcctaagtatagaattactatgtctggtagtacagaagtatatttgtcttactttataaaaaagaactgccaatctgttttctaaagtggttttattatttatatctccacaggtgatatatgagagttctagttgctctacatccttgctaacacttggaattgtctagtctttttcattttagttactctagtatgtgtatagaatatatcattgtggttttaatgtgcaattccctggtaactcacaatggattgtagacctaaatgtaaaagttaaaactgtaaaacttctagaagaaaatatagacaataatttcatgaccttgatatagacaaagattttcttaacaggtcaccagaatcattaagtataaaagaaaaacttgataagttaggatttttcaaggagtcaagccttctgctttgtaaatataccattaagaaaataccaaaaacggctagtcacagaatgggagagaatattcatttcatatatagatataaatatatatgtaattaatatataaatatatataatgattatatataatgacatagaagtcatttccataatatatatattttaaaacttcttacaattcaatacaaatatgagcaaaatatttttaatagacactaaatcaaagaagatatgaatggctaagttcatgtaaacatgttcagcattcttagtaagaaaatataaaataacaatgaaatggatttttaaagctctcttctagatttgttcaactatatacccattagcaactgaaattcaccatatccaaaactaaattcactttcttttctttttcccccaacaaaacaaacacatgcatgtttcttgactctgaagctcaataccagagcttatatttaattctacccacttttggacccccattgtccaactagttagcaagtcatatttcctaattttctgtcctctctctactctcaacttccactgtcattattctggtttgagccctcatctatattgtaagagtctcttaggaggtgttcccacaacgattttccatttatggccagcccattgtacataaatctttcagatgatttttcttagatctgagctctgaacatgcaagtcccttgttcagaaacctttagtacttcccccttagctggcttttcaagttctttatttggcattcaaacctctctatagtttaaccccaacctacctttccagcctctttccagcctctcttttaagtactcagtactttgtgaactgaactaattactgttctacagatacgtgcttccatttcctgttgttttaccttagtctgtggtgttctcccatctgaaatgacattacccccatctctgtatagtcaaacctccctatcctaaaagactaagactcaattcaaatgctagctcttctataaagctcctgctgaataccagtattactcatttaatatacttttcatcttccaccaagtggtattactataagctcatatcttccttactagatttttaagaaaactgtagaggttgacccattcctacatagtgccaactacatgttatatgccctacaaggagaaaacagtcaacaaatgtttgtgtcatggataaacagcttgatgatgggatataaaatagaataagccatcattcttacaatctgataagagaaatagaatatgcatggaaacaataacaacgtagcatgtgatgcataataaaacttgtgagagacgtgtagaggagtcatcatagggtaatttggaattaggttagagaggtccatcaatatcaggctgaggttagactttatttaatagttaaagatgagccaggaaccattcaagatattcaaacacagaagtaacataattacagttttgtatcaatctggcagcagtgtgtgggtagaatggattgtgacgggggaacctggaaggagagaaaggcaggacagagagaactgaaggaacactagcgtgagataatgaaagactaaattgctagcaaaagcgcagatgtgacagactctgtgaacatgctgttgacaggtgctgtgtctgggtctgaaggtgtgtagaaaagagaaaatgaaatataatttcagagaagctgggtaaccattccagggttatgccctgtagggattggacaatacgagaaagagttgggcattagaaattgagatttctttgaccacatacaagtttaggttgcattaaataaagtggatatatgttattagtaagactacacagagggggaaaaaagacagaaatccagtgataaattcctaaaatacaaaactcatggaagagtaaagaagttgatgaagagataaatgagctgtcaaagactattgggtaaagtagaacagcagtgtgtcatggaagctaaattaagagagagtttcagagaaacaatagtcatttccatgtgaaagaatgttttttaaagtactgcttaaagtttggaagaaacaaacaatagggaggctctgagcctactccagctccagaagctgcccgttgaaaattttaagttaaaaaaaagaaataaaaatgattaaagcaggcaatctacccttatagtgttttcagtctaatggggcagaagtagcagacttcatcctcatcatcaccattcccatcattttccgagtgcttagtacaggccatcatctgtatattgaattataattttgctaaccctatacacttatgatcccaattttatagaggagtagaaagtctcaaagatgttatgcagaatacattttagtacagggtttaataaagtacatattaaagtgagatacaagtgagctaagatcaaaggaaatacaacttgtatgggaatgacagaaaaggagttaagaaagagataacctctagactgtgccttgaaccaaagaaggatttgcataaccagagagttggtaaaaagtcattccacactgaatgaggtatcatcagagttttgtggttaacagtgaggttggtgtgattgcttggtgtacaatatattgtatatactacaacttactgtaggatacatttagtggtatggctggaagagaaagcatgtgaccccgttttctaagaacttttaatgccatcctaagcaggttttatgctgcaaactctaatcctttgtgggctttaaggaacaaagtatgacccaacttttttttctttttggaccattaaagaaatagctagacatataagcatccaggcatggcaaatgcttcagatatatcacagaagattatgcctgaaaagagggccagtggatttagagctctttgttgaccttggaaagccttgtttcattagagagctggaatcagaagccaagttgcagggtgcaggatgagaagttaagaagtgaggaaacagagtgagaatgtgaaagcggtgagcgtgaactgttctcttccataagaggacaagtagaattacagctcatgcacttaacaagatgcagggcaattgggtatgtgctgcggtagtgaaaagaaggagatgaaaataaataggttttcattaccaaaggcagagctaactctcctgcctacttccaaatgctaccacatatccacacccttgatgtcattactaatccctcatatatttgcagcagaagttgcttgtgaacctgggacagaaatgttgatggcaatccaactgataatcttgaatgtgagaaatccttttggatatattcatatggctaatttgctttgactataaagtgttgctgagacctcattaacaaatttgcgatatttcccctgcttctttgatcagagtctccctgtccttggaattctccataagcctcatgcatatagcacttgccaattttatttgtatgttctagttatttgccttattcttccaaattatcctatattctgtggtggcagaaattgatattttgtatgtactgctcctatacagcaggcactaaataattacttttggtttgaaataattttagatactatgtttccctattataaatatgtgtaaaaaattgacttgtagagatatcttagttttctattgctgcataaaagtttaccacaagctattcctctgcagaactaatagccctagtataaccatgagaaaaatatcagacaaatcccaatttagagacattttgaaaatacttgaccagtacttctcaaaactgtcaaggtcatcaagaataaagaaagtctgagaaactgtcacaaccaagagaagccaacggacacatgacaactaaatgtaatgtggtgtcctggaacagaaaaactcagaaaatctgaataaagtatggactttagttaacaataatgcatttacattggtccattcattctaataaatgtgccatattaatgtagaggttaataataggggaaactaggtatgaggtatatgagaaatctctgtacagtcttaacgtttctgtaaatctaaacctattctaaaaaaagtttgttaaaaacatttgctacaatattagtggcttaaaacaacacaacgtttattatctcacagtttacatgaattagaaatccaagcccagcctaacagggtcctctgctcggtgtctcgcaaggctgccatcaaaatgtcaactagaccacagaagagggagtccaggcttttttccaagctctttcagactttttggcagaaattctgttccttgaaattacaggactgagaccctcagttcctaaagatgactctgccatatgcagtttacaacatgactgcttcttcaaggccagtggaacatctctctcacctcaggaagggcctagtcatgctttaagggcttgcaactgggctcacccaggacagtctcccttttgatgaattgaaatacaacctatttgggaatttaattacatctgcaaaatcctttcacctttgccacatagcacaatccattacagtcacggatctttcccatactcaaagagaaggcttacatagggcatgtatgcaggagagggtagagtcttgaaaaccatcttattaatagaattctgcttaccaaagatttggaaagagaatgaatgtatgacagagaacaaaagaattgttactttatgaaaaggcaatagattaccttttatctaaatagtgtcaattggcactactctattttttacaaaatttaaaggatttgaactgaaaagcatccttcttattctcattttcttctctccttctttttggtgtcattccattatagccactaaaatagtgtatttttgcagggttagcagcagcatggttattatagtggtgatatcttccagtgcagattctttagagtctgagcattgtttaaaaagaaaatgaaagctatatcagttcactattaattattctcagtctagtgaatccttcaaaggttatattttggtgatggtgatcagttcatatcaacaggttcaggaatgtctatttccaatctatgaaaacaacatagattccaggttggagacacggttccaattctaaacttttgcttaaaataaaaaaatgattaggaagaagtagagtttctgtgcttaatttgatctcagttgtacaacttgaaattatgagctagtatacatgggattggttattagaaattgctagcttgacacattcattttttaaaaagtaattatatattgcaaggtgttgatattgtcttttataagaaatatgcatctaaaaaatgtagaggagaatattttatttaaaaaagaaagggctgggcacaatggctcacacgtgtaatcccaacactttaggaggccacagcaggaggatagcttgagcccaagagttggagaccagtctgggcaacatagcaagatcccatctctataaaaaattttaaaaccagcctgtcatggtggcacatgcctttagtcccagctacttaggagactgaggtaggaggattgcttgagcccagaaagtcaaggctacaagtgaactgtgatagtgccactgcacttcagcctgaacaacagagtgaaaccctgtctcaaaacaaaaacaaaaacaaatggtaagtaaaattctgagattctagaaaaaagcgattcgtttactgaggaatgatttgcactggcaactttttttttttttaattttatttttggagatgaagtctcactctgtcacccaggctggagtgcagtggcacgatctcggctcactgcaacctccaccttccggattcacgtgattctcctgcctcagcctcctgagtaattgggactacaggtgggcgccaccatgcccggctaattttttgtatttttagtacagatggggtttcgccatgttggccaggctggtctcgaactcctggcctcaggtgatcctcccaaagtgctgggattacaggcatgagccaccatgtccagcctacactgactttgaatgtgtttcccaaaacataaaaattcatgtttttataaagcataggaaaatgactaagtacaaaataattggtgttggtgaaaacagaaaaaaaatgtatctgcattaagaaattagaaatgtattttttaaactcaaaagtagataatgtgtgctgtgggtcgaatcatgtgccccatactgtatgttcaagtcctaacccttggtacctatctgcaaatgtgacttctttagaaatagatcactttttttttgaagatcgaatcaagttaaggtgaggtcataccgaagtaatgccttagaagagaagagaccagcgtccttagaagagaagagagatacacagggagaacgccatgtggcaatggaggcagagattagagtgatacatctataagcctaggaacaccaaggattactggcaacaccagaaactgagagaaaggcatggaacagagtctctctcagagcattcagaaacagtatggccttccaatactttgatttcagacttgaagcccctaaaactgtgagagaataaatttctgttgttttcagtcacccagtttgtggtcatttgttacagcagtcataggaaacaaatataatggacgagctgcatgtggatcacctgggtccttgtgaacgaatgctgcaatgactttaccatctctgcccaggatcattgtcacccaccgctcctgaaggagagaatgtcccttaacaagaagagggttatagagcggcttgggaagctagacttcatctacttatcatcttctcttgggctagttatgtctactttggattgtgtgaggacaaggaaaactctggcctgaggaccttttgcagtgagaggcccctcccctgtgggcttgaaatgctgatttatgcactggggcttgattgtcctaatagccaccattggctgagtatgcacctagtaatatacagaaagaaattaagttttcaagcaacaagcaaagtgatatttttttaaatcatggcttctacacagaggtaaaacaatttcagaaattgaagatcagaaattgaagatagagagatttattaaccaagattattcaactgccaagtagcagggcaggattcaaaacttagccaaaactaagttcttgaaccaaccaggttgtctgctactacatactgcctcctcctcccaaaatgccagtggaagactgtgtgttatatttaatatgtaacttgtattgcacgtgtatataacttctatgtaactttacattgaaaattgtaccttgctgcttttttcctaaaatggtgtattagtcatttttatactgctatgaagaaatacccaagactgggtaatttataaagaaaaggagatttaatggactcacagtaccatatggctggagaagcctcacaatcatggcagaagatgaaggaggagaagaggcacatcttacatggcagcaggcaagagagcatgtgcaggggaactgccctttataaaaccatcagatcttgtgagacttatacactatcatgagaacagcaggggaaaaaccagcccccatgattcaattacctcccatcgggtccctcccacaacatgtggggattatgggagctacaattcaagatgagatttgagtggggacacagtcgaaccatatcaaatagtctccaaaatgttcccattttatcgttttttcatgtttgttttctttatgacttgttaaatagaatttcttaaattgccctagcacagccacatgctttctcacatttcagtgtcaagcaaaacatcaagtacagggcatatttttcacactgatgcaactttgctggtaaattaagataagaatatttattaggtctcttttgtgtttatgtattaaaataaattctaaaataaactcagcacagtgagaataaatttgaggaccttccctgggagcaagaattgctaaagcaatcgaaatcgaatcccttttccctgcttcgaaattcaagcatcgtaaagcattcttaccggcaagcaggaggtctctaaaactaaagtcactccagagtggcagagttgtcactttaaagataggccttaatgtaatgttaatttcaaacctctactccttaaatgtactaagtatctttatctcagaaatggaaaacaaagttcacagggccttccaagcaggaaaaaaaggtaacattacaaatttacttagcataaaaagtaaggaaggaggaaaggagggaaggaaaaaagagaggaagaaaaaaggaagaaaggaaggtgagatggaaggaaggagggaaggaaggaaggcaggaaggaaggaaggaaggaaggaaatacaggatgggggtggctaaattatacctaataaagcttagaatgtgatataaattttatgacatgaaaagcataatcctgtatactctatcataaagtaaaagaaagttgttatatattttacccagtttcataatgaactcttacaccacattttcaattgtgttaaaacaattgatcaattcaccttgattccattctgggcactttaacgtactgcatcgaaagacttcatactgataattattagtgttctcttttcctggccaaaaattaagatgctttaattaataccttcatcactatcattggctttgcacatgccatactctcatttactttacaatttgctaaacctttttctctctctttggaaatcttgatcctcaagaactttccacatgatttctttcatagttcttttgcattctttttctccttagaaactttcattttttctacattggcacaggaaacatcaatatttgatcataaagctaaagtgatagcctggcacagtggctcacgcctgtaatcccagcactttgggaggccaaggtgggaggatcacttgaggtcaggagttcgagaccagcctggccaacatggtaaaatctgtctctactaaaaatacaaaaattagccagtcatggtggtggcgcctgtagtcccagctactcaggaggctgaggcagaagaattgcttgaacccaggaggcagaggttgcagtgagccaggatcacgccactgcactccagcctggacgacagagagagaccctgtctcaaaaaaagaagaaaaaaaaaaaaaaagctaaagtgctccatggttatattaaccttccccgctaagtttccacacatctcagtttagtacatgttgagctagtgaagctgggattctagtttgacttttgaacggcttttttttaactgagatttctatctttagtttctttttctatgtggcaataatggaatgagaactttaaaagttactcaaaaacttcatctgatgaagtaggtagctgtcttggcaagtaaatgcaattcctgaaaattttttccactggaatgatagctattatggctacaagataaggtatgagcaatgagttttctggccgaaggaatgactctgaaattgccatacctctgtgtagaagcaagccatgctttaaaaaatgacactttggtctttgcttgaaaactcaaacataaataaataacttctaacctggctttgacttcataagaacttcattattgccgggcgcggtggctcacgcctgtaatcccagcactttggaaggccgaggcgggcggatcacgaggtgaggagatcctgaccatcctggctaacacacggtgaaaccccgtctctacaaaaaaaaaaaaaaaaaaaaaaattagccaggcatgttagcgggcgcctgtagtcccagctactcgggagtttgaggcaggagaatggcgagaacccgggaagcggagctgcaatgagcccagatggcgccactgcactccagcctgggcacagagcgagactccgtcaacaaaaaaaaaaaaaaaagaaaagaaaaaagaaaaaaaaaacttcattatgtatgtattcgtgcagaactttgagaagaatgtttataacaagaaaaatataatggcaaagcatcgtggcaaaaagaaaaaaaagaaaaagaacacagaaaataattatgcaattttgttaattctgagaccaaagcaagctgttctggggagcaactcaggggaaatcccttaaactagcttctatcactgtctaattaaattcaacatgatttcttatagatcatgtagtaggataaatataggtgagataccaaatgaacataatacatgattccttcagttctagaaatgtttaacagagtagtttaagaggatttcatgaaaagtaaaaagaatatataacagtagactaacactttttttttttcaggaaagggaaccacatgagcaaatagatgtggcctgagcagggcataattgagatacgtggaaagatcagtttggttgcagaaaatcagcccctgcaccatagtatgagataaatgtttagcatccaaatataaagtacttttaatatcaatttaaagcagagcatttcttttattttaaaaaatagggagttattaaagatttttactagtattttaatcataagattaaaatattttatggaaattatgcaaaagtcttaatgaagaacagaatctgaagaccagtagacatgttagtggtcaattccaaaagacgaggcaatgtgcataaaagatattgttctctttttcaatgtagtacttattttcgcctctactcttttattcacgttgcctctctttcacccatcagcttcgcatgtgtgaattttacacatttttcatgatacccctttcataagtccattccagttcttctcttctttctctggatttccacttttttttaacttttgcctctgtcttagtccattcctgccgctataacaaaatatgtgcgactggataatttttaaagaacatgcatttattgctcacagttttggaggctggaaagtccaagatcaaggtaccaacaggttcagtgtctggataggggcctggtccttgcttctaagatggtgccttgaacactgtctcctcacacggtggcaggtggaagagcaaaggggcaaatactgtgtgaagcctcttttataaggcattaatcccattcacaagggaggagccctcatgacttaatcacttcttaaataccttgacttttaaaattaccacactggtgatgaagtttcaacatatgaattttgggggacacattcagacaataatggcctctgaggcaattatcgttaattctatctggaatcatagtcatttatctcttatctcaattattatgattttctggaaaattaaggggatgccttgatttctttttatcacccttgtccagcccagtggctggaacataagggttcagtataaggttgacagagcattcagttattgggggtgttagatggatagagtgatagaagtaaagatgtacagttgctgagaagtcaaagaataaaagcaacagattcaaaggataaaggtttttttaatctagaaattttaaatttgtttccaattccaagtgtcatagaggttgggaaaaataaagataattacatttagtgatgagtttatcacctgtgactttacagtgtatggtttttatagagcagatattaaaattttagggagggtattcaaaagtcaagtatgatgaggcatcttttctcacctgtatagaaaatgcattctcatttctcccatttaccggtactttcggttcactgcttttaaaaagatatctgaagttaaaaaccatctaatatgtataactcatgaggcagggaaggcttttcttataattggactttacaatattgtttttaaacattcttggcctagaattaacataccactgctgggatatatagagtataatgcaaagtaacacaagcaaagtcagtgatacacaattcttcctcatgagagaaacaatttatgggaaattattaagaactccaggattattagcatcccacctgcaattgagaaaggtaaaaacatatattcccttaatacatggtagattgtttagcaaccacctacacattggccgtggatctctaaacatttaatgagtgcctgctgtgtactaaacaaccttctagagtacacaacaatggcagtggaagacatttacaatacaatagatgctttcagcacacaaacatagatactcaaaaggctcacagttataaaagaaaacaaaaaaaaaataagagttgaaaaacagcttccagagcagtatttcaaaaaccgcaggaagctatagtgaaaatctaggaagatgcacagtgaaggaacacaaagtatgaaagtaataagagccatcttggctgctgaaaatatttctcttaagaaagaacatcttgaattacgtgttcagaaaatgaaggtcaataaagatcttattggttagaaaaaatagcgaagaatagtccgaataattaagtcaaattttaaagttaacttacacagaactaagcccatttgacccagttggcacagtccatttaaatcttccttaggatgccccacattaaagtaggtgaactaatcacataacattggtgcaaaccaatgagatttctgaaaaaaatattttaagtgaatcctccattaatggagagttgagaagattatttttagatccaaaagacaggatttaatagtaagtgagatgaatgagatggataaagggtacagtaagattagattgattaaaataaaaatatattagaaaaaaactaggactcaacagacggagagattgggttgtgcaggtgatggagaacctctattgtacctgacattctttaaaggaggaaaattagcatattcaaaaaagaaaaaatattttgacaatagcatgaaagccagagacctttcttgcctccttgtttagaaatcattatagcaatttacgcatggaaatatcaaaaggaaggagaagtatggtgtttgtgaaaatgaaaaagtcttaagtttcaaaaatgccatggggaggaatttggcagtggataggatgtaaatgagtaccaaagaagatggagaaggctaactttactgaagactaaaatgagagtcaagaggaaatggtatgttcaacaaaatgcaaataggcaagaaaggcttgcttctggaatatatcagatttcagatcttgctgacacaaacacctctgggccaaaagtttaagtcagctggagacccttgacattctaattgagagttagccctgcaaaggaggtgattgattaaattgattctaacacataactgattgtatagaaaatctgagaatattgaccctttaaaaatctgtgaaattaattatctgtttttagaggtaggatatccttggcagaataaactgattttatttctctgcatgtgttttagctatttttgactccggagcatgtttcatctcccaggcatatggctattccggcttagagttgttgaagggcaaccactatgcaaattattccctcttctctttacctctttctttttttttttttttttttttttttttgagacggagtctcgctctgtcgcccaggccggactgcggactgcagtggcgcaatctcggctcactgcaagctccgcttcccgggttcacgccattctcctgcctcagcttcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcttgagccaccgcgcccggccctctttacctctttctatatcttccatctgaagagttggaagtgtgagtggtgagaaatcacatgcatccagaggagacagactctaaaggacatacacaactctatggaaggactagactagcagcccaatcaggtagttaaagaaagaccaaaagttattggtttttctttagggagatggcatcaaagcattttgagccagaagttagtgctaagtacctgcaggaaggatgtagaaacaagggtcttgtcatttgcagataaccaagcaggtaatgtggcagccaatagcagcagcccagccttggtgatgactttactcctatcaatgaaccaacaagagaaggttaggtcaccattcctggagaaatggaatttaaaatttttcatgttaacagcagtttaggagaatgaagcctgttttagaaattagagtagaatgtaaagtatcaaagttttgaaccccaacatcagaagtgaatctccaaatcagaataaggcaaattaagaaagctagaactccttaaagtccccagaccaaataaaaaaaaaatagggttgggtctggaacctgtaatatgatcattatcattaatatagtgattattaagcactttacttgaatcatcttaattaatcttcatgcaattctataagatgaatattatcattatttccattttagagaaattaacttacccaaagttttaccaataatatgtatctaggaagatacaaaatctatctaaaagtggttgacaaaaaataccactgcataggtgaaaggaggattcaggacaagagttgaacatcccttttatagaagtccttccaggaaaaaaaggaacatggcttggtgtgtctgacttccagaatatgatacctcccagtaagaaaaagctcttatttcttgttcttactcactctttattaataaatacaattccggtatgtaaacatattcctccgtattcctaataagggctttcctggaacactcacgttgaatcaccctcagatatgtcaatttccttgagtccagcaagaacagaccacttaaaatatttcaaatttgagggtaattaccgtgcacaactttggtatatctctgcagtgtttttatatctgtggaaatgtatttataatttatactgcagcaacaataaaaatctgtgaacaaaatggtgaagtcagtgattttaggatgatccaattctggtcattttgttataataacccagaactagaagaatcttcatatgataaaatggatgatctatgaattgtattttaggtggggggaactcaacttcaacttgtgtgttaaggggaattttttgtttgttggtttgtttaagaattaagaagtagccacctaccctggcttccacaaagctggacaccaaagggcaaattatgttatcagcatttcgttttttctttttccatctttggcttggctttcttcaggttttaacatctctcttaggcaggtgtcctctacatgttggttatctggcagctcaaggtttccattcaactagtggagcagctcagcataaagtgacttttcactttatgctgagtgcctaccatgtgacagcattgtactcaatgtggaaatacatcagtaaagaagactgcaaaatttctacccttctgttgccttttctagttctagcatttgtcacaatagtctcaagtctgagtactactaatactgacttgggtcatgtactcagctatagactaatcattttgccctggaggaatgaaatctcctgactcaccagacctgagacttatatccacccttaaagaagggaagaatcactaatactctaattaccctgattaacaatgaggaagcattatttttccagagaggaatttgagtgcttttaccaaacaatggatatgaacctggagggaaaaaaaaaatcaattaaaactccaaaatccaaattcaggaaaattaaatgaggaaatctccccagaaaataaatagaacttgctcagataagagaaaatggaaatttgagtcaaaataagcctccttagtcatcaaatctagatactccctcacccagtcaacaagcgcaggtagcaaaatagtcttcccataaagagtaagttggtggatgaagttgcacttctatggataaccacactctgtagtcatcgcctgaatgcattgtctgaggtttataacttctatttatagaagttcagcactcaccaagtgaagagctctgggctatagatacttgcttccttccatggacagtaaaaagtgtgttcaatcttgacttaaccccaagtgagtagaactcaggctgttagtgattgaggcctcaggcttggtaatttataaaatatactttgcttttctgttttatggaggaaaacctgcttacttccatgctttggaaaaactgattcaaaacgtgtctaatatgctgacttcaactaagtgtatagtaactgataaatatctcctaatggagttttatttttttttccaataacagtgttatggtagttgaatatatgtttttcttaacaagatagatgattgatagatagatagatagatagatagataatatatagacagatgtgtatctatatatctatggatatttgaagagcaaaaatttacagatttatgacatggtagagcatgttagttaccagcatagatttcacagctacacggcctaagtttagtaaaaaatcatgactctatcattaagcttctaaatgtgagcaagaacctactctgagattttcatcagagaaatgagaataaaaatggtactcacattataagattattgtacatattaaatgcattaatattaaaaatttagaacaatggctaatttattgttgacattcaataattttaaggattattatcatcatcatcatcatcatcaccatatttagtatacattcactgcaagtaacaggattcttaagcagaggtagtggtcattagtactgttcaaaaagtatttctgactgcgcctgcttaggggcacttggcagaattgcactttttttactctcttgtgggtagaattgtgtgattcattctgacagggaagttgtgaatggaagtgatatgcttcacttctgggataagcatttgattgttgatatgagatcatccagacctcattcttctttcaggaacagaaaccagcaattttgcaggtgctcctgctccatcaacccaggtctctaagtgactgcaataaacagaagttctactgatccaccgtagacctgtagcatgagtgagaaataagcttttgtggtgttatacccctgagacttcggattgtttgtgacattactggtgcataatctaacttatcctgactaatacagccaccttacacaataacgcatttaactttctcagataaagtcaagtaatggagaaggaagttccagagctagttgacaggttgagccagtaattctgagccttctctgaatcattaaagaacagctgtggcagctccaaacatcatattcccacatagcaatacaatcaggaagtggaatggtggggagcaaaggcaaaaaggatcttttcccctagtgctctctcttttatcagggaggaaaatattttctgaaagtctcctccaggtttccattatatcttactgttagtgctaaatcttatatccaaccctagaccaatcaatgacaaaaagaaaaaaactataagcttgccacattttatcatgtttcactgtattgcactttaaagataccgcagatttttttacaaattgaagatttttagtaaatctgtgtcaagcaaatcaatgccattttccccaaagctacgctcactctgtctctctcatgtcacattttggtaattcttgaaatttttaaatctttttcattattattgtatctgttatggtgatcggtgatctttgatgttactattgtaattgggggcaccaagaactatgcccatatgagacagtaaacgtaatccataaatgtggtgtatgttctaactgttccaccaaaagccattgcccagtctctctctctctctctctctctctctctctctctctctctcacctcagaaagcttcccaattctctgagacacaacaatattgaaattaggccaattaataatcctgcaatgacctctaagtgttcaagtgaaaggaagagtcttgtgtctttcactttaaatctaaagccaggaatgattaggcttagtgaggaaggcatgttgaaacccaagacaggctgaaagctagtcatctcgcacaacttagcaaagttgtgaacgtaaaggaaaagttcttgaaggaaaagtgctactccactgaacacacaaatcacaagaaagtgaaacagccttattgctgatgtggagaaagtttcagatagaaggtcaaactagctacaactacctaatttgatgcctaatccagagcaagatcctaactctcttcacaactctatgaaagctgagagaggtaagggagctgcagaaaaacagtttgaagttggttcatgaagtttaaggaaagaagttgcctccagaccatcaaagtgcaaggtgaagcaggaagtgctgatggagaagctgccacaagttttccagaagactgatgaaggtggccacactaaacaacatgtcttccacgtaaataaagcagccttgcattggaagaagactttcataggactttcatagctagagagaagtcaatgcctggtttcaaagtttcaaaggacaggctgactcttagtagggatgaatgcagctggttgaagccagtgctcatttaccattccaaaaattttacagcccttaagaatgatgacacagctactcttcctatgttctataaatggaacaacaaagctggatggcagcatatctgtttacagcatggtttattgaatattttaagcccattgttgagacctgctgctcagccaaaaaaaagattattttcaaaatattactgcccattgacaatacacacagtcacccaagagctctgatgaagacgcaggaggagattgatgttgttttcatgcttgttaacacaacatcctttctgaagcccatggattaagaagtaattttaactttcaagccttattatttgagaaatacattttgtaagactgtaactgctgtatatagttattcttctaatgcagctgaggaaagtaaactgaaaatcttctagaaagtattcatcattctagatgccattaagaacattcatgattcataggaggtcaaaatatcaacattaacaggagtttggaagaagttgattccaatccttatggatgactttgagaggttcagaacttcagtggagaagttaaatgcagatgtgataatggcaagagaactagaattagaagtggagcctgaagatgtaactgaattgctgcaatctcatgataaaacattaacagataaagaattgcttcttatggatgagcaaagaaagtggttccttgagatggcatttactcctggtgaagatactatgaacattattgaaatgacaacaaaggatttggattactacataaacttatttgataaagcagtggcagggtttgagcagattaactctgccttcaaaagaagtttggctgtgggtaaaatgttatcaaacagtatcacaggctgcagagaaagctttcatgaaaggaagagttggttgatgcagcaaacttcatagttatcttattttaagaaattgccacagccaccccaaactttagcaaccaccaccctaattagtcagcatccatcagccttcaacacagaagcaagaccctgcacctgcaaaagattatgacttgctgaaggctcagatgatcgtcagcatttttttagctataaagtgtttttaagttaatatatgtacattgatttttagacctaatgctattatatacttaacaggctacagtatagtgtaaacagaacttttatatgcactgtgaaaccaaaaattcatgtgactcactttattgcaatattcattttattgtggtggtttggaaccaagcctgcaatatctgtaagttatgcctgtacaaaactgacttaatttggtcataatccatctcacacatctgggaaaggaacctactattcttgagtaaattaatccctgcataataccagaacaattcagcactctcttagcaaaaagtaaggaagaagaatgtctatgtaaccaggaacgtttttcataagagtaatggccttctacaagactctgtggaattgaaagatttcttaaaatgaggtgcccttgtgtttgcagtatatgcagttttgtctcaggagagagttttgggtctactgagaagaaactgaggtatactgataagtttcactgcttgtgtattgtagtggataatgtggatttctaaatagatttgctctgccacattattagacagatgcctaataatttaatgtacattaaagtatgttaatagggagaatgtgtaatcataaattaattaccaagattatgattatcccaattttaaacagtgcttgaattaaaatatatccctagaatacaaaatgaatagtggcttacgtgttctaaggtgagagataagggctctgcaaccacttgtggctttggaaaatgacatattttgcagtttgaaagcatggatttcagttaaacattaaaagcagatgactgccatgactatctgtaacatgatcatgcaggacaatgagagaaacggcaaaagaaattctgcctttcggcacatattttctctactaatatttgcaatgccaattttcaacagcacaggtgtatttaattgcctctgaatattgcaatgcaaacccattcaatgttgaaaacaggagcccaaaaaggaatctcaggctttgttggcctgcagaatcttgtagctccagattgattttaatatatccagggaattttttttctttgtcattgcgctttctttagaagggcatttaaattatcaaaccattaccttatcaagcacaaatgtgatgccaattcttgtgatttctgagttatatgtgctaaaaattacatgagttctattgaatatttttatcaagtccagtgatagaaacatgtattttctcatgctgtagttccaagatctttaaaaggggttggtcaataactcaaaaccattttttgatgaagggagatacactactaatagcagatatgcttccaaaagtttacaagcaataggaatgcttctaaaatttttaatgccagttactctgcctgatacagaagaaaaatgccatctactcaagttaattaatccatgtttctcatttgtttgccttacacttgagttttatctgagtaacaatattacaaaatgtacttacacaatatgagaatattatattttacgcagggtatacccatgattcatctttaaattaacttcaggaaatctcaaatcaaagcttcctaatgttaacttcagctccatttccagaggagaccatgttactaataaaaatagcttctagcaacttgataagagagtctctgtgtgtttatggccaagataaatgatcttaaagatgtagggcacaaaagagaattttgttgaatttagccttaacagatatttagtagcatgtatcaaaattcaattttatctgaaactgaagaaaacccatcagatattataataagacaataactcaatttcagacttgtaaacaaaggtgacattaatctattgaaatgtgggaaaatagtcaacctgtatccttctcataccataaatcagcatgtttgatcactggaagcttcattttgatgattagcagtcatgtattgaggctaaatgatatgtttgtcgcacagctaatattaactaaatctatttatcatcttgccagtggtactacagtgaggtcacacttttggtgcagaacaaaaagaagccaggaatctgttaacagcatcccattgtaacattgctgttttttgttttgttttgttttgttttgtttttgtttttgagacggagtctcgctctgtcgcccaggccggactgcggactgcagtggcgcaatctctgctcactgcaagctccgcctcccgggttcacgccattctcctgcctcagcctcccgagtagctgggactacaggcacccgccacaacccccggctgattttttgtatttttagtagagacagggtttcaccatgttagccaggatgatctcgatctcttgacctggtgatccgctcgcctcggcctcccaaagtgctgggattacaggcgtgagccaccgcgcgaataaaccgagaaagaaaagcatctgactattaacctcatatacttttggaaatggatgtttgtgtccacatcccctttgatatactgggttatggccttggcggtgaaaattccttactgtatatagtgggttaaaaaagtaggatgaatgctaacaaatgttttaggatgtatcacaacatctgaattctcccttctgatgcttagcattttatttcacaaaaggcaaggttactaaaagaagaaaaaaaatcaactgtttagatgaagaagcaaaattaattagtaaatataaaaagtgattatttgagttttgctatgacaataaacaagaatatctcattctcagaagaaagtcagctaaagtacacctttattttacatattcctatggattacacatttaagaatactaaggaataatcattctgatttattttatttcagaatgactgcgatggtgttggaaaacagggttttatgcttcttttcttatgtttttctgacttaacatcttgtctgactttcaaacagttcaaaggaaagagagtaccaattagacaagggaagaagatgagagactgcctgaacagcatcacttttgtaaactgagagttcttccaaggatagagtgtgtaaatgctgacctacattaaatacaagtgacatggatttctgggcatgtgggacgccttggtaatttgagtgacaaatcacgtatggtgcgtttactactcttttgtggctttaaagttaggtgattttgactctaaagcatgaaagttcaaagagctgttaagatttctctgtgatgtatgcaagggttttcttaggaataaaaagtctaaaaaattcccaagaagacacttatgtgtaataaaagcataaagaaatgtacaggaataaaagcactagattttgtgtagaggttaccccttaggaagagagaaaaggatgcaatcaaaggtagtcatatgtggccttagtagtacccatacttttttatttcttcactgagtgtgggtaaataaataattttttacttgacttaattttaataatatttgaaagaattaaagaagtccatgaggtaatgtgaaaacttgtaatgaaaaaggctgaatacaaaattgtatatgctgggatgacaactctaaatgtttgtgtggagatggggacaagaagaaatagaaagagttaacttgctaagatggcagaattatgagaaatttggacagaaattgatgagaaaagtgatttgaggttttggtgatgaagaaagggagaatataacctaaggaagattaaagatttcacataaaactaggaaatgtttagcataaatcagtttcaccaatttgaacctggtcttcctctctgtcctctcccttgtactcaccaaatcattttacaatcttccaataaggaaaaatacttcctttggtatgaatgtctagaattaatatttatagttctacaaaaaaattcagagctcttaacctaaaacaagtgaaagtacaatcattgtttttaaatgttacaaatacaatacctgacattaaattgtatttcctctatattgcatattctgaatttaaaactgtctaacacctttaagcttaaagcttaaattaggcatgtaaaacaagataatgacaaaagaaaagaaggccggatgtggtggctcatgcctataatcccagcactttaggaagcaaagactggagaatgcttgagcccaggagttcaagatcagcctgggcaacatatggagaccccatctctataaaaaaataaaaatattagccaggcattgtgtcatgcacctgtggtcccagctactcaggaggctgaggcaggaggatctcttgagcctggaaggtaggggctagagtgagctatgattgtgtcactgacctccagcctggatggaagagtgagtccctgtcacaaacagaaacaaaaaaactcatatttattttcagaagggacttgattatgtggagccatatggggcaaagtgcaaatataccttagaactactttaaaatacctattattttttctataagtatccacagccagaaagagcaaaacttgctgagtatgattggcaaaaagattttcttttgttttgattccaccgttccttatttttcaggccttgaataaagtcaaatacagaactcttatgaaaaaattcagtgtagaacctataatttagctgcgattgttctcttggttttattttattttgatcaatttcagtcaggttcccttgatttctctgaaactggagagtattgtattctaaacgaatgacttgtctttgctagttgaagtaaataagcaattagagcaaaaggctgtttcattgaacttcaaagaaaattgtttttaagattctgttgttgttctgtggcccctaataatgcagacggtctttatacaacagaaatctgtcagagaagaaatttttattggtagctaactttacacacacacaaacacatgcacacacaacttcagaagcagaagcacaaggtacttcctcagagaaccacaaatatcatcaaagtcttattttgacataatgctactttaacaagaaattcagatttatggaatgaaaattgctgtagtaacaagtattttgaaatccaccctaatacccagaaagtgacagcaaatcccagtgcttcagtaactctgagccagttaaactgtaggacaaaattctgttgtgttctagtatcactgtctttctgaactaagactgtcttgtgctttggttgataggaagcagtgagggtcctgcctttcccaggtttgaactttctcaggtggttgagatcttccttgcagctcctaaatttcattatatttttctctactccacaatccccatccagtaataaaaatctattcaaaagttgaaattaggaattcttccatttacatctaagcgttagattatttttctaaggaaaaaattaagattctgtttttacagaaatctcatatttttttttttagtagacttgggtctcaagccattctgttaaaaggggaaaggagtaatatcattatattaaaatatccaaccatatcatgagatcaaaggataaaaacatcttgaggatcatttggtgagtccgtctacctgcagaaatcctgcatgtctgcatcactgtgaacagctcagtatggctcaggggtcacctcgctgttggaacttcagtggtctcacatagtccctaaatccaagccactgtcattgttcttgggggttgtaaaggccattaagtgctcagtagtcttataaaaacatgcagattcttcaaacagaaataatagctttagttagtgtactttagagccataagtttaaaacccagcaggagaatataaatgatggccaggcaagaaaaacaaaactccctgccaaccttcactgcctacaaaacttaatgatctatgccacatctactatttgtaaaattctttcagaaagtatccattcttaacattaagaaatgtctaccttccttcctccaatattttcaatctctctgccacactatgtttatattctctcagaattctagtggatcccattgtctaagacttaaaagctgttattttatactggattaactttaatcatctgtatttcttccaaattgtagagattgcattggtccaattttcttttccttcaatttttaagagaagcaaatcaaaccaagtctttaaaggaagcacagcaagtctcagataattttattgtttgggcctaattattttaaatgttaccaaggaatatctttaggttaaaaaaattaaattttagaacagaatttgatatatatttcttattatttaaaatgggaaagggcattagcatttattaaatctcatctgtgtgccaagtattcataggtatcacctcatgtaattctcacagttattattgcggtattattatttcaattttcatgtaaagaaataaaagctcaaagaagaaaatgactcactgagttctgaacacacaattctctgagtccaaacctctagcactttctagaataccatgaagagtggaagtaatatgtaacattataattaatgttttattattttactctcttattgttaaatttcacacagtaaaatctacacataaacattcattttaatttaaaatcaaattatactgacatagtgccaaaataactgctctatgagatcaataaatccaatctattctgatatagaaaggcaaaacccgtgtgcattgctttgtaatagtaaccaaacagtcattatgtttcagccatttcaggaacttatttgtgattgttgtatattgattataattctggtcagttgtagttaacaagccttttttttccttatactttcttttttccaaagaacctattttgttttatagcatggttggacttttctctagaaaattacaaatgtattcaatataaccagtatttatcccaactttctgaagaagaaacttctcctacttaactccaaccttatgactcttctctgatatttttccagccataggtgttagcatctgctgttgtaaaatctttggtgttgattggtgtggactgagatgaggaccagagccaagatcactttttacaagaaatatacaattctgccccttgtccaactctataaattactagaagtttctggaagtgtgtacatcttcaagctcatcttaatcatttccacatttgtattcttgagattatacctgagattctcatccacacaatccttaattaaagcagctgactcgcttctcacaatataggaaaatgggggtgccaactgctttctctgccaacttctgagtactgttgaagctgaactagctcctcaacgcttcttctccaggaaatgtactgcaactctcatgctatttagcaccttccctcctcatttcaaaaattgtgctgatcagagacattcagaaaaagtgcaaaagaacaaaacagctccaaatagctttccacagttctgcactgtattcttccctctgttgatttccctacaaaacaaataggcaaaaaagcagctcacaaaaaagatagagtacatagaaaagagaaaaccgaggcataagacagcactgtgtgcttcaagaaagtcctggagcaaagcttggagcacagggttcaggtgagaactgaagttatattagcataaacatatggtcgcttactgccccctctgcaatgtccagaatgcattcctaattttcattccatttgtctccaatgcgtgataggacttcaaagagtcatgattaaagaaattgttcagtgcaattagtcaccacttacaagtcagtgagctcgcattctggggtgagtgctaagctttttcaataggagatagcacactccattcacttctttgttgttctttcttaagatccttcttctggtgattttttttttttttttatgtccagagttctactattttctttctttctgcctaataatacttaatttaaaataaatacatcttttcagaaataataatttcatccttagtgaaaacatttacccatatctgcccactatattttgtgttttatattctttcatttaaaagtattaagatgaacttcaattataaaatcttacattgcttgaaagacatttgcctaaatatgttatgtgtctactgtagtttttcaaaaaattttgatttaagaagccacaagtatattaaaataattctatttcttccaggaaatggctggatttagtgatcctgtaaggttaaaaacattataatatttgtatagtgaccaggctcttgatttagatggttacatataagcaaaatactgaatgaagacaaaaaacacagctatcccttttattaagtttcatagcttttaatcccctaaggaaatcctttagctatttcactattttactaaatcatattaaaatgcaaatttccactaatattacaattctagtcaaaaccaccaaaagaaaacatgggctcttaagcttttttttttttaagtatgagcacagacagcagaaaataaagctttcctgtaagtgaatatggcatctacatttgaattatgtacacagtaaaggactaaaaattgtgtggtcctaagtaagtttaaattctattgtctttgattgatttgaaatagaattatcagagattggattaataaaaagagcttgacagttcaaagaagtaagcttgtgattgggctatgattttttccaaggattttttgggcagtcatattattttctgtaccttaaatttaccatctatgaataaagataatattgactgcatgaaataataagcccagcaactttttttttttttttgagatggagtctcctgtgtcacccaagctggagtgcagtggtgtgctctctgctcactgcaagctccacctctcaggttcatgccattctcctgcctcagcctctcgagtagctgggactactggcgcccaccaccacacctggctaattttttgtatttttagcagagacggtaaactattcagtggaaacgtgataaagttgtttctcaatgaaaaatgatcattataatgtaaatgtgcatgtaactagttattgaataataaaagttgaactcaaggtagctttttcagtcacttcaaatacttggccaattttgaaggaaaaaagaaagcagcacccaaaagtctattgttgttgatgcactatagaattgagagtgtgttcaagcaaaatctagcatgttgccaatggaaagatagtaaaaatcttgctactaatacctgcactgctctgctgaaacatttacctcaggtagtgttagctggaatggctaattattgaaaatacaaagtactgcatattgtttatttccattagtacaaatttagtattattctaatgctgcttgcattatttgaataagataaacaattctcagtcactgtgacttcaaagaactattctttattctccccaaagtttgatttactcattctattgtttattcatgaatagctgtgtactaccaaatgtcttgcctttcagtttttcaacagcaatctttactttagaaccttactctcaccttctgatatatcattaagtttgaacatgttgaatgctttgacggttgtattatacatgtaaaattgcttgtatttcatcttttatctagacagcttttatagtttgggtttttttcaaccaagttttcaacatttttaagttatgaagtttaacaggaattgctgacaaatgataataactggcatttttaaactcttcttagtatccactacactaagtactttacatattataaatctatatattatcacaaatcatttacagggtttttatgcttatctcttctctccacctggctctcattttatacagaggaaaactgaagttcagaaagtttaactaacttgatcaaatttatttggcaatttaagtggcaaagctaggagtccaaatccatgaaacttcttatacttgatactgccctgttgttgttatgattaatagcaattatgttttttgacaaatgattttcactgatttggagtaaataatttaaaattatttcatttaaattaagcctgatagtactatactaactgatacgtttacaaaactaaactcttcttagctgtaatatcattagcatttgctcaattttcagcagagacacaaaagaatgccagaatatatggaaagagtatgaaagctgaaccccaaggacctaaatctgatcccaactctaataggaatcactttacagaagctacattttagatccccaatgttatcatctttaaaatgaagataatgttagctactttagctattctacaatatggtgtttaggatcaaaccagttgaggtcatgtgaaagggtctcagaaagtgaaaaaaactataaatgaaagaattagacaatactgcaagtgctgcatgcaagaagagtaaaactattagcattactaatacaatgttaagagaatcttttcaagaggatctgctatgcaaaaattatttagaaaaactaattgacagaaaacaattgagtctttctgtcatttccatagtctatccagaataaagagtaatgaacacgtgcatacgttttctaaataatctggaaaagttgatattttttaagtgtaccacttagatttaataaggagtccagtggagccatgcttacactataggtaaacaatatttgaagaaagctttctctgcctctgattatatttttatttattcaataaacattttctaaagacttagcatgtacttaactgacatttcatggaaggcaaaggaaaggaagaaagcagtatccctcttcaggtagcctcccccatgttagaaagacaagtcacaaagctactagaaaacaaagattgatatatgataatacaaaacaaaaggagtgaatacatgcagatgtgaaacaaaataaagggcttatatatggtattactcaggtagacatttggaagaaatcttttgggagcaatgtcttattttggcaaagaaaaaaaaataaaggggattctacatccttaagggagatctgtgaaaacctacaatagcaagagtcatgcagggccttgtggtcatgtgcttacagttgcagtgcttagaatacaaactctaaacagaagaggcatatgatggtaaaagaaaaaaatcatgaagaaaaagtaactgtgtaaaagactgacaggtatagggaagtcccttcagacgcaagaacagacaataaatcaaggatcatgggagttgtagaataaagttgacagtttaaaagccaggaaacaaaaagaaaaactgctgctacactttgaaaattggacagataaaattgccatggagagaaactgattgacaaaaacagagcaaactacagattgggaggaaaattaataagcttggtctgtagcagcacaaatccattggataatcaaagaaaaatgtcccgtggatacttaggcaagtgaggggctttgttttcactgttgcctacctgtcactttgtatagtaatgaaattaatgagcctgaatcttccctttcatgactgtaaagactcaaacgccctgttcttctccacccaagcatagcagccatgcaattctgctgtcaatgcaatcaaatctttccaagttacagagaattctaaaaacgtcctcacttgtttctagaatcttaaaagaaaggtagtggaggaaaaaaaatccttccaaaaaacaagtaataaggcatttttgtttacttattgcttatagctgttggccttaaattataaaatatcagggaatatatctgcccctttagctgataatcttttatcataattgaatttaatctcaataacattaaattgcttagaaaagaaacaaagtagatattaagatattgaattattcagaagctatcaacaggggccatgttcaattcttggaatgaatttctttttctcaggcatctttgccaaagttggaaaacaggttaacaaaattgttaaccaaattgaaagtgtcaaaataaagccaaatacaaattgggtcagaatccaagagctgcctattgtgaagtcttctaacgtaaaagttgaaaagaaagttagcttccttgacaaaagaaaaaaaagactaagaggttatgtgtttttagttttgaacttagaaatcagaactcaagaaagacatactgaaaatttcataggatgaatggatttccctttaaccacaatattgtgttgtccacagcatgaatgaaaactgttacaaacttccaaaggcttcagatgattagcctgtgaattgccttcacctctgccaacttacctggcatcctttacgtttaccagcgcacttctccctggagcctgcagacagcaagctcctgggctgactgtggaggcttatctaaatcctctgaaagttgtgctggggtttatctctgcctgaagacccatcattttgcatgtcaaatgtcagacattccaatactgtgaagatatagatggctttgccttatcatttaaagcagactaatattattataggcattttataaaattaattatttgaccaatacatgtgcagataaaacgtccttcattcaactaacttccatcatcaagactaatcattgcctgcagtgagaaacatcagtaaccttaataagttattcagtagggactgtgaatttgttcaacagcacaggaagtacagaaatcagatcaaagggtagaggatctggtaaaaatttatcgaagcatagattgtgactttgtgtatatcaaaacaatatgatatactttactaaagttttgatgtattgacagttgagtttatgggcaaagagaggcagatttacgattctattaaatgttaaggatttttaaaaaatcatcgaaaaaattgtattcatttgacatgtaaaataagtttgccgtgactatatagcagaatcaaaatccattaaccatggattaatcattaaccctttaatttggaattaagatgatatgtggtatttttcacagtatttcatatatgttagtcaaatctgcccaagcagactgtaaactaataaattatttcaaacttgttcaaatggatgagtgaatgaatgagtgaatgaatgaatgaatgagtctctcttctagattactgttaaccacaatttatctgccctaaaaagtcacaggtaactgacccaagtcaatggcttggagcatttttacagtatttttgcacagacatatattccagtttcctctttgtcaggaacacaaattgaaaagagaaatagagctatgtgggaggagaatgtgacatgtattcttaaggagacaattctgaaggctatttggagaaggctacatgaatttactacaaggaaacatcttttcatctactatgatagaaaaatctaatgcagattttgataagtctgtatcatattgaaagctctgtttaacagagtaatcactggctgacaaattagattaaaaggagtctgaaaaccaaaggaaagaaaggaaggaaagagaaaggatgaaagagaggcaggtaggaaaagaaacggtgtcttccaaatactattttcaccgtggagcaagaagggctttggagcatacctcagaacgtagctcctccatgaagtcgtttttgaattccaggccccttttatcttgcccttctcttttttttttttttattgaatatcaataaatttattgaatgccagattctgggctcaatgttttcatacatttgttcgcttaatccttacagcaatcctgtgaggcaggtagtgttctcttaatttacaggtagaaaactgtgaaacagagaatttttttattgtaaataaagtccctctccatgagctttatatatatatcttgcccttctctaaccagctacctataaatcctttctgctccactgaattttgtgcttaactgtattgcctcctatctctagttttattttctgggagttagtctttctaagctcctagggaaagggaaccatcctttctgtgttctctgttctctcactccacctctgcataagttctctcactccacccctgtatagtttaaacacacagcagattgtcagtaggaaagaaatgaacggttaaatgatctgatgcaggaatacgtttttcctttggccttggtgtgtcttgccttgatgctctgagaaacaggtttttaatttggagtccagttgtcttccagacctggagaacaataatctgcactcgggtaccacatattaccaactgtatgaaaaagtacacacacacacacacacaatgcacacacggatatatgcagtttcccatgaagagtccacaacttttatcatattttaaactggacatatgattcaaaaaaggtttagaactatcattctaaaggaaaaaagatacttcagtaccctggggccaagaattggtagtctttgaagccattttaggctataatgagaaattcttcatttggacctctgattgatttaatcttaaattatgttctatgagactttacatactttttcaaatatgcatttaatgttctgtctccagaggtggctaatgagtgtattaatgcacatatttccagaacttttttccatttgtattgtataatttagaaaaagcttgtttttatttttgctgatttttgaaaaatgattatccttgtgtgtttttgaaaattattcataaacagccccaaaagcaagactttgaaaaagattttttgtgctagttaacagcagaataattatttccatattatattctgcaccttgcatctacttataatgatctagaaagatgatggattattttgagtaaaactagaaattggcaaaaagcatcagtaaatataagaatgaagaaacatgtagattattcataaaatgaataatgcacacattagtgcagtggtgaagcattcataagacaaaatagagatatgttgaaggtagaaaatgcttgaagttactgctgaatttttgtggtgaccatagcaatggtattacctgtattgtcttgaggctcttggctgaaatatctgggactgttacaaatgtacaagcttatatttttccagggatgaaaatatagctcatcctgtgaaaaagatatggatttaaggttgtttcttaatatgataaatgccaatggaactaataatacaaatctgcccttaaaagtgaaaccaaggcagaaatacaaaagacaatgaattatgccgtagattaaaccaagatcccagtgagtaaatctaccaaagttttccagcctaggggacagaaatagctgactatgaatgggaatgaggatgaagagaatcagtgctaaggaaaagccccttgagatagtggcgtacttcaaagactgtccgctctacttctacttgagcttaagaacatggctatgtgggtttccttcaagtcatctaatatttattgagcactgactcaggcattttagggactgcaaaaaagatccattgggaaataaatgcgtagaaccgcatagagcctgcctccccttagccatagggcacattgtataaattagaaaaggggctcctccccaattgttcattcagtaggtgtgagattcaatgaatgtctgatgaacaggcctcagatttggaagcatgaacttgacatgcacagctgctagtctataataccaaagattttcctttttaaaatgtatactctgcaacacccttgctcttggtgaagatttcatctttgttttcacaatgctcaattaaagagaaagatatttggagcatttacttttaaaatatatatatgtcaggactccttaagtaaataattttttaaaaaatttatttagtgccaaaactccctggaagaagaaataatgacgtttttccatccgagagttatatttttattgtagaaagaatatttgttagttggcttcacaatagttgtatccctgaagcactaaatttgtatacaggagcctattaggccatgtagatttcatttgaaaaatgtaccgtattatgttctaagagctgagtttagcaaatatgagaaattgagttcttttagtaaaataaataagactgagattttaacacctgggaaataaataataagcttcatgattgcacaaaccatccttagcactgtatcccaatcctgagaaaaatgccttgcacatagtagatgctcaataaatatttttctttgcacaatttttaactgctcaatttatgcctacttgtcatgaaaaaacaggctttcttgataaaggaagatctttttttcaacaaaagacttgctaatactaatttatttctaaatgattccaagtatttctattgtgtttgtattaatatcagtgctttgtgtcatgaataatctacagagagccaagatttaagtcggtgagaaaaacatttcttgtatgggaagagagtttattaagatacattttatacatttgcacacatttatctctttttttcttaatgcatctttttatacccatctaacataaaccactcaatgtattgtatcacatagtcaatatttctaccaatggggagcagattttaacagatgtatccgatatttttattgaaaaatccatcaatgctaagtgaggcatatggtaagccttgaaaaggaagtattatttaaatgactggagaggaagaagaatagcatttgaaaaaagaaagaatgcactttagaaaacacaggagtagaattgagcagggaacaacttacccagtctgatgagaatagaggtgagtgtgggggaacagtgagaaataaacacaaataagtaggatgggctaaatgacagaggactttgaacactgtgcacaaaataattgataattatatattggaaagttttatctgattacaatgaacgggtaaaatggacagaggagataattgatgggaaaagagatcagatgggagataatatcaggtctacaccttataaatagacataaaagaagagtaaaacacattgaaggagaaatggcaaagcttaccaaccagttggatttgggagtatgtatttccccatttttccaatggggtaggaaacgacagaagcaccgacagagccatggagctgttttggagaactggtttgggaaggagataaaggatgcacaaagcattctatagactttgggaatacactcctggagtatagaatagggagtagaatagagtaactgaacgagtagtgaggcatgggaaagcatgtgctcaacaatgagtgaatgggaagataaccaaggggctgagaaccaccttaagtagcaaccacattcaagccttgagaatagaaagggaaggagaggggaaaaatgtagagatgtagcagaacatgctggtagggaacagtaacatgaaaataaaagcagaagaaaattttaagaaggattatgtgatcaagattttctaataccacagacagtgttgtttgggtttgaccaaaaaaagctattcattatcttttggagaatcctgagtacaatgttagagtcttgagactggttgcagaatgaatagatagaaagggtagataagaagaaaagacagttttttacccccaagatagcggattggagcctttgttagtgtgcctcagccacttggagagagcaaaatagtgtgtgttaccttttttctttctttttttttttttttgacaatatctcgctctgttactcaggctgcagtgcagtggcacaatcatagctcatggcaggctcaaactcctgggcttaagtgatcctatcacctcagctcctacatagctgggaccacaggtatgcacaacatccagctatttttttttattattttttgtagagctaaggtctcatgttgcctagatcttgaactcctggactcaggtgatcctcctgcctcagcctcccaaagtactggcattatagttatgagccaccatgcctggccacacattgtgaacttttatccaagaaggaaaagagaaacttaacagaaaaagtgaaagaaacttcactttcaaaggagcagtaggcagtgaggcagaaaactgtgagtctccaaagggcaaaagagggagagaccatcaccatgattctcatttccactgcagagcctggcaattcaggccacaggggagcgccttaaccctacccagcactgaagctgattttgtgagcagcgaggaggatatgaggagcggcatcaggacacactttgcaggcactcctagaccccagtgaaacagaaggaagacattcctgatcctaactcgtaaaatcctccaaaagttggcaagttaaactcagccagcgcttagaggttgccagaaactcccaactgtggtggggcgtgatggctcacgcctgtaatcccagcactttggaaggccgatgctggcagatcacgaggtcaagagatggagaccatcctggccaacatggtgaaaccccgtctctactaaaaatacagaaattagctggccgtggtggcacgcactggtagtcccagctactcgggaggctgaggcaggaggatcgcttgaacccaggaggcagaggttgcagtgagccgagatggtgccactgcactccagcctggcgacaaagcaagactccgtctgaaaaaataaataaataagaaagaaagaaactcccaaatgagattcgtgatctaatctcaagtggggatgaaccccgaaggccagagctaagcacaagtgggaagtgtgctcttgccacaggtgcgggagctggacacctctgctttgcgggtcaatccaggaagggtgtggcctgagagccattgtttgtgtcttgagtgggaagtcttgcatcctgggtcagttttgtattctgagcatgaactgcctgagattccgctggcagttacagctttcttctgctgaagtctgcaggtgtgagacacaccatgtcaggggcatgagagctgagtgggtctcactgtggtctgctgcccctctcttcctgtgcagactgttttgtgcagcagaaatggttccactcctctctggaacattaccccagtggccaggaaacttcctttcaacctccgctgctttgcatctgcacttgggcagccgcagcgcaaacttggctcacccaacccccacacagcttcacctcctttatatgccttggtagcagacaatggatagggacttttgagagttcgatggccccacccatctcctgggatatctgagtactcttcctgggtaacctaggccatgcataaatcccacagccacagctggctccctcctgaaagtgtcacctcctggcaggaggtcaactggcacagccaattacaacatctgctgacacaacatagtactcatagtgaacatgctcactgtagctggcaattgagaaagccaccacactaaggctatttataaccaaggaaatcttagagagatacatcacttccctgtcacccccatcagagctggtgcttgcacctgccactgggagaccagaggacagatcagccttgtccagctccacccaccaccagcatgggttgtggcagccccaccaggtggctagatccagaggagcaggagaattcacagtcttctgaccctaagggactgccactcctaggggaaaagggagtgcaccacaccaagggagcaccccacaggacaaaagaaaccagagagtttttctctattccagaactttctgcttgtgggcaaagaacagctgcatctctttaagcagaggcacaggcagagtgctgggctcagtggaggaagactatggctctgcacagcagtcaagcagcccctgtgctcatgaagagatttggagaagggtacttcttgtctcccttggccattgctgcaggcacacccaggaattctcctgtgaaaactcagtgagagtgcacctgtacacagcctttctggaacatttgggggtgactgcgtccccaagggaggtgtgccctccaggttcaggcttgcaagaggggtggagttccactccccctctacatgaatatcagtattcctgcagatggaccgaggtgcctatctgatctgaatataaaaaatcctgggatgggggcatgataggaaggtaggtcacttttgtgctggcctcatagtggagctgaggtgactccctccctcccctgtaaagatttcaatgtatttcgctgggagctcctccagccgcctctatcagagctgggacttttgcccactattgggttttgcatttacccagctgcttcagccacaggcagttcttacccttaggtggcttctactggcctgaaggctgaactgttcaacccagtgaaaaaatactgagggtgtggggagggaagtacacatgactggggaatgaggtaagcttcatgagacctctgccaccctagccccacaggagacagtaaacctgcttacacatccagtacatagctactacaagcagcatgtgagaaagtcattgcacaaagattctctatatctaaggaactcatacagagtctttgacatggaaagcacccagagccaaagctagtcaatcataaactatacacattatagtcacaacctcaaagctccatcaaaataaatttttaaataataagaagaaatatccccagatgagaaagaaccagaaaaatgattctggcaatataaaacaaacaaacaaacaaacagttttataacacccccaaaagatcaccctaactctccagcaaaggatccaaatcaaatgaaatctttggaataccagataaagaattcaaaaaattgattgcaaagtttctcagtgcaatccaagagaaagttggaaaccaacataaaaaatcaaaaaatacaattcaggatataaatgaaaaattatctaaaaacaaatatttctttaaaaaacaaaacaaaaaaaacagaattagtggggcgcaatgactcatgcctgtaattccagcactttgagaggccaaggcaggcagatcatgaggtcaagagatcgagaccatcctggccaacatggtgaaaccccatctctactaaaaatacaaaaattagctgggcatggtggcacacacctctagtcccagctactagggtggctgaggcaggagaatcacttgaacccgggaggcagaggttgcagtgagctaagatcgcgccactgcactctagcctggtgacagagcaagactccatcaaaaaaaaaaaaacaaaaaaaccagaacttctagaaataaaagacttgcttagggaattacacaacgcagttgaaaattttaacagtaaactagaccaagcagatgaaagaaattaagagcttgaagatgaggcttttaagttaacccaatcagacaaaaataacaaaaacaaaaagaaataaagtctccaagaaatgtggcattacataaaatgtcaaaacctaacaatccagaagaagaaggaaaaatgatgaaggaaggagaagaagaagaaggaagaaggaggaggaggaggaggaagaggaggaggaggagggagaaggaggagaaaaggaagaggaagaggaagaagaaggagaaggggacaacaataaaatgtttagaaacctatttgagaggacaattgaggaaatattccctggtcttgctggaatattagacatctagacacaaaaagctcaaagaactcctgggagatacattacaaaaaggatatcaccacagtatataattatcaggttatataaaatcaatgtgaaggaaagaattctaagagtagtgagacaaaataacttataaaagaaataacatataaaggaaatcaaataacttataaaggaaaacctattagactaacagcagacttctcagcagaaaccttctaaaccagaaggccttggggtcttgtctttagtcttctaaacagaagaactatcagccaagaattttgtatcctgcaaaactaaatttcataaataaaggtgaagtaaagtcattcccagacaaacaaatgctgacagaatttgtcacaattagactacctctacaagaaatgctcaaaggaatggtaaacatcaaagcaaaaggttgatattcaccagtataaaaacactcaaaattataaattcatagagcttatgaaataataacacagtggagaatacaaagcaattaatgatccacatgatgaatggaacagttacccacatatcaatattgactttgaatgtaaatgttctaaattctccacttaaaagatataggttggcagaattgataaaatacataatccaaatatctacctccttcaagagaccaacttaacacataaagattcttacagagtcaagataaaagagtgggaaaatatatatcatgcaaatggaagccaaaagcaagcagtagtacctattcttacatcacagaaaacagactttaaatcaacagcagtaataaagacaaagaaggtcattatataatgataaagaatcaattcaagcagaagatataacaatcataaatatatacacatctaacatcagagctctcagattcatgaaacaaatactaccagacctaagaaaagagatagacagcaatacagtaataagggagaattcaacaatccactgacagaagtagacagattgtcaaggcagaaagtcaacaagggagcactagacttaaactggtctctggaacaaatggacctaacaaatatttacaaaacattctgccccaaaagtgcagcatatacatacttctcatcagcacatagaacattttccaagatagaccatatgacaggccacaaaacaagtctcaataaatttttagagatttaaatcctaccaagtatcttctcagaccacagcagaataaaactaaaaatcaattttaggaggagctctcaaaactataaaaaacacatggaaatttaaaacctgcttctgaatgatctttgggtcaatgatgaaattaagacagaaatttttaaaaatttttgaaaggaattataacagtaacacaatgtatcaaaatctctgggatacagcaagagcagagctaagagggaagtttacaatgcttaatgcctacacaaaaaagacagaaacatcacaattgacaagctaatgtcatgcctcaaggaactagaaaaacaagaacaaaccaaacccaaacctagcagaagaaaagaaataataaagagcagaactaaatgaaattgaaaccaacaaatacaaggatcaatgaaacaaaaagttggttatttgaaaagataaataaaatcgatagaccaatagctagattaaccaaaaaaagaagaaagagaatttaaataagctcaatcagaaatgaaaatgaagacattacaacagatactacagaaatgtaaagtattattcaagattactctgaacacctctaagcaaacaaactagaaaatctagaggaaatagataaattcctaaaaacatatagcccccccaagcctgaatcaggaagaaatagaactcttgaacagaccaataacaagtcttgaaattgaattaatactaaaaaaaaaaaaaaaacctcacaacaaagaaaagcccagaactagatgaattcatagccaaattctaccagtcataaaactgacatcaatcctaccgaaactactccagtggatcaagaaggagagaatcctccctaactcattctacaaagccagtatcaccctaataaccaagccagaaaaggacacagccgaataggaaatgtccctgatgaacatagatgcaaaaattctcaacaaaatactagaaaaccaaatccaacagcacatgaaaaaattaattcaccgcaatcaagtgggtttcattccagggatgctaggagggataaatatatgcaagtcaataaacatgattcaccacataagcagaattaaaaataaaaaccatatgatcgtatcaatagatgtagaaaaatcattcaataaaatctagcatctcttcctggtaaaaattctccacaaactaggaatagaaggaaaaggaacataactcaaaataataaaagccagatacatcaaacccatagccaacatcatactgaatgagggcaaagtagaatgtgttccccctaagaaccagaacaagacaagggctcccagttttaccacttccattcaacatagtactggaggtcttagccagaacaatcaggcaaaataaagaaataaagagcatccacattggaaaagaggatgtcaaactgtctctgttggctgttgatataaatgtatacatagaaaaccccaaagactcctagatttgataaatgaatttaatgaagtctcagggtacaaaatcaaggtacgtaaatcagtaccactgctatatgccaataatgatcaagctgagaatcaaatcgagaactcaatcccatttataatagctgcaaaaaacataaaatacctaaaaatatgcttaactaaggagatgaaagatctctacaaggagaactacaaaacactgataaaagaaatcatagatgacacaaacaaatggaaaagcatcccatgttcatggattaaaagaatcaatattgtgaaaatgaccatactatccaaagcaatcttcggactcaatataattactgtcaaagtatcaacatcatttttcacagaattagaaaaaaaaacactaaaattcatatggaaccaaaaaagagcctgaatagcctaagcaatcctaaacaaaaataacaaatctggcaatatcacattacctgacttaaaattatactacaaggctctagcaaccaaaacagcatggttgtaaaataaaagtaatataaaagtagacatatagaccaatgaaacagaatatacccagaaataaagccacgtctctacagccaactgatcttcaacaaagccgatgagaacatacactggggaatcgatatcctattcaacaaatggtgctgggaaaattggatagccaaatacagaagaatgaaactggatccctatctctgaccatatacaaaaaaaattaacacaacttggattaaagacttaaatgtaagacccaaaaccataaagattctaaaagaaaacctagggaaaaaaactcttctcaacattggtgtaggtaaaagatttatgaccaagaccccaaaagcaaatgtaataaaaacaaaaataaataaataggacttaaattaaaaaacttctgtacagctaaataaataatcaacagagtaaatagacaacctatagaatgggagaaaatattcacaaactatacatccaacaaacggctaatatccaagatccacagggacctcaaatcagcaagaaaaaaagataataatcccataaaaagtgggaatatgtgaagagagatttttcaaaagaagccatacaagtggccaacaaacatatgaaaaaaatgctccacatcactaatcatcagagaaataaaaattaaaaccaaaatgagataccaccttacagtcagaatggccattaataaaaagtaaaaaaaaaaaaaatagatactggcatggatgctgtgaaaatggaactcttactcactgttgatgtattaggtaaattagtacaacttctatgcagaacagtatggagagttctcaaagaactaaaaacagttctaccatttgatccagcaatcccactaatggatatctacccaaagaaaaagaagccattatatcaaaaagacacctgcacttatatgtttattgcagcacaattcacaaacgcagaggtatggaatcaacctaagtgctcatcaatggatgagtggataaagaaaatgtcagatacggatatagagatatagatagatatagatagatagatcatggaatactactcagttataataaaagaacaaaataatgtctttttgcagcaacttggttagaattggaggctattatcctaagtgaagtaactcagaaacagaaaaccaaaaactgcatattctcacttataagtgaaagctaagctatgggtatgcatgggcatatagaatggtataatgaacactggagactcaaaagtgggaaggggatgagagattaaatattacctattggatacaatgtacaccattcaggtgatgggtacactaaaagcccagacgttactactatacaattcatccatttaaccaaacccctagagctactaaaataaataaataaatgaaaagacagcagaaaatacatgactagcccacatgaatattactaatgtatagttacctatatacagcatatattacaaatctcttgaggtcttctttgtatcacttgagttcctattgttgctataatgaattattccaagtttactgtcataaaagccacacacatttattattttcccattctggaggtcagaaatctgaaattggtttcactgagctgaaatcaaggcgtcagcagggccaattctctcttgaaggtgtaggggagaatccatttccctgccttttccagcttcaagaggcacctgcattccttggctcatggtccctttctttatctacaaaaccagcaacagagactcttcaaatctccctctctctcttggactctgacatttctgcctgcctctttcacttataaaaactctggtaattgcattgagtctacactcagataattcaggataatttccccatctcaagatccttaatctaatcacacttgcaaagtccctcttaccaggcagggtaaggtattcacagcttccagaaaataggatgtggtcatcttggaggggccattatcatgtctaccacaaggtattaattaaaacatcagaagcagttttaaattaatttgccttgtacttaattattatgtatcaatttacctttgggtcagataatatatgtgagattgattcattaactagaaaatgaaaataaaatttttaatagagtttttatactagtcaattattttctgctgaaaggcctttaagttgaatgttaaaattgttattataaacttccatgtaatggtagttgggtagcaataacaataaactgatagttttctgcctgtagcagtattttgatgagactatttttgactgaaactcttattttgtatttaaaaaatcactgcattttatgctgttatttgcttcactgaattatttaatttaatatgttctattaaagagactttaaagctagatacaaattttttctccgtatacatttttaatattcacatttttaacctaacgacctaaagataaatttgaatttctcaaactattcaacctatagtttttcctctgtaaaactgcagtgatactgaacaaaactgctgcaaagaataaataagataatgtatctataactgtagccaaattgctgggccataacaggtaggtaggtcttcaataaacttttagcctgatccaaaatatattccacaagatttgctgaccaatattgaaacatgtttctacaaatactgcagatgaataatactgtgggtgttgtttcttagtaaacttgccaaattttaaatatttggttactctacacaattaaataaaattttaacatgagcatccaagtaactctatttactaaaaatggctgtttctttacatgatatatgactaatgagtgaagctatcctatagctatacaaaatgataacgttaagcattttttattttgtctatctaaaggtgccaatacattgtgaagaaaattctgttaatttcattatatttaatacagcatattccaacttaaagttattcagaagatcaactgaaggcaaatctaaaagacagcagtgctttaagaaataaaagtcataaaacaaaagtttttcagtggttataaattactttcaagttgcattatttcaaatttcttcctgtaatctcatgttcctagctctttaactccctttgattaaatgatgttcctttgctttcactattttctttttgtgaacttgtcaaatcatctttgtcttgtcttgtacaatttaagagacttttatgtagctctctgagcgactatcaccacacaagtccaactgggagaataatttatgaggttcaaaatgaagggtcattatgaatgctgtctttcccgcaatgaatacatacactctcttgttcatgcatgacaggattttaactaaatcaatggagatagatgcttttaaatgaagtattatgaatgatatcattggttacataaaataatttactttttatgtaatctttaccttgtttaataaatttagagaactggaagaaaacttctttaggtgtgggtttatctgtaactgtcacataagtatttctttggtagaaaacacaatttcaaaagttgtagttttatgtccttaggttaacatctagtatccagtcataagccagaatattatgcatagtaagtattctgcacaatgatactaaatgcagaggaaaagcaaagagagtagattttctcaattttgaagagaggttaatttttaagtgtttttactttatcaaagtattcctgactggtgttcagcaatcattggttctagtaatgtttatttggctttttcttatcatttcagtgcccagtatcttttttttttattacaacagacaaatctaattacttctgattaatctcaatagctgtgatttggattatgaatacttcccttccaatctaactgaaatcataaatgtttccatgtcaccttattttttataagcacatggtgtaaggcataccaaataagaaaatatattaacttttatcagagagacaactgtaatagaaaactcaatgtttattttagtatatttatgtatatatgttctattattttaaacagcctgtaaacctaagcctctcctcttatctaaaaatcatccgtcctcctctcattgcctttgcattttcactaaactcccctctgtgtatttatcttgctttttaggtatttacttgtgtgagtagtttatgttttttcatatgtcctgagctctctgccttacccaccatgccttgactataaagaaatgatagctaactttggccaggtgtggtggttcacgcctgtaatcccagcactttgcaaggccgaggcaggtggatcataaggtcaggagatcgagaccatcctggccaacatggtgaaaccccgtatctactaaaaaaaatataaaaattagctgggcatggtggcgtgtgcctgaagtcccagctactcgggacgctgaggcaggggaattgcttgaacccaggaggcagagtttgcagtgagccgagatcgtgccactacactccagcctggcaagagagcgagactccatctcaaaaaaaaaaaaaaaagaattgatagctaacattaattgagctcttgctatgttccagatgcattaaaagctttttaacatattaatccctttcatctttaagccagatgaaatgggtaccactgtaatcttcactgtatagaggaggaaacagaaactcagaacagtgaagcaatctgagtagagtcacacagcctctaagtggccgaagccaaaatctaaacctgggttaagagccaccgaacacatgagcatcacccacatctggagaacttcagtgcatacattttccccatgcttgattttcaaatcaccaagtacttttaattaaccttcactattgttatgatttgacatttgttgttctatatatacaactaatatctgccccataccatgccagaacataagaatacaacacctagtattttatagatgagtaatagcagctgccatttattaagcttttgccatgtgccaggcactgcatcttattatttaatactcagaaagatctatggggtacctaccaatttatttccactttagagatgaggaaagtgaggcagagagaggttagatgacttgcccaagatcacacagctagtaaatggtgaagccaggatttaaactcaatggctgaactccaaagcttggctctgaatgagtgaagagatgtgttcctagaaatctagcttggagagtcaagaaaagtaatagggaggagatgacatttgacatatctggaagggcaaagtgggaaagaaaggaaacaatacactcaagggagacaacaacatggataaagtactgaggaatggtgtacctgcagcataacaggtgctcaaaaatgcaaatgaaaaaaatgaatatctttatagcccatgagttaaaaggttttccacatctaagtgttgtatgactagtgctctctgtgtgtttctttcagtgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggtaatgtattctttctacatttcttcttattttgtttaaaaaagataaacaaatgtattattttatgccatataattacagaaataaacaacttctggacccatatcgtttttgagatgctttgcaaacctttcagtcattgttcaagatcccaaagcataatggaagcatttggcagggttttccaatctcctgagcatatagaacagaaaagggcatccatgatcatcaggcccatcttgatgggtttggcatatgagaatgatgcctgaatattttgattacatctgtttaaccagtcttcattgcgtttagagttagaaaaatcagataaaaagtgcctgagtgttttgcatttgggcaggggatctttctaatttctactgttcatagtcactgttaaataactgagttttacggctgttcatcaaactggatgaaagctgcttttcctacatgtccatccagctgaaaaattaattctcaagaataatgagttacatgggagaagggagagaaatatgagccagttctaaagaacacgacaggatagaatttttgccttatgaaaaagttttctttcttatttcttataagacaaaattctcatttcaatttaataaggacaattacaaccataacactggttataaaatccatctggctgggttatctttccaagcccaaaaaagctatttggatgttctttatgttgctatctgtttttggctaaattaattggacaacttggttcaagataatgtttactattattaatgataattattaaatgcctcttcatttttgaaataatatccatgttgaatatctctaaagaatatttaattcatattttaaaattaaaatgtaaatgtacagattttttatagaattaacattttcaattatcaatgttttcatcaaatacaaaagttttatttattcccaaatagcaaaatatataagcagttttataaattcctcttatactattaattactattaatcaaactcttaaacctgaatctccttaagaacaatttaatcaggtgttacaacaggcattttaagtacatttgcgttgtttcctagttcattacacattcagggacattaactccccttcccagcttcagttttaaactctttttcctcaaagacactatagtatctattgataataatttcacaaaggctcatgttttactccctgcatttttgttctgttttggagctatggaatggatgaaatgcctgtactcatactcagagagttttggcctgagctcggagtagcaagggtttgatttttctggcaatttctaatcacagtcacaaaagccaatgcataaacgttcaactacaggtgtctaataaagatttttctcttcagttaatttaagtagaaactaaaatttccaggcatgtcttactttatttccacacttttcatagcaagcaggacttgataaagatttctttaaacaacttattgggagattaagtgtggaaataacctcctagatggacatggactgaataatatgtatgttaattttatcaatattgtgaaaacaataatttgacaatagatcactatctttttcataattatcataaaatttgaatgtggtttccctgtgttctagaactaattaaaattactgaataatgttaagtgataacgatagcatttcttcctaggacaataaatctataatatttgtgggatttgttctgtatgatgtaaaattataatttacagcatagtggtggtgtttattacccctgttatgacctggataaatgaccaagatctcaaatatagagaattaatgggggttaatttttcattgatgatctattttttggatggggagagacagagaaaatgattcaaacaaagaaatattaagaagtcagtgatagtttatactaatctgttattgcaaattatttagaatttcaaccactcaaaaagatgttttcagttattttaggtagagcactttgtctacataggacattagctaggtctcaatttttgtaagttatgaacaattaaattcacagaataaggtacaatttggacagatgaatatacactccagggataaacgtttatataaccatagcttatgctactttttgaagcagacaaaagtagctaatcatgggttccatcattttatgaagaggaaggctaaaaaagcaaaatagaatgtgcagattttaagaggatgtttcatcacatgatgatcgccagatcacccaaaattcaaaacagcatgaatacaaattaaaattattattaaataattatattttcaaaatatcttcagcagaatgttgaagtgaacatggggaagaaaataaagatggcttatgcccttctcgtttaaaaacaagacagatgtgagaggcattttagatataatttcttaatcttaagaaatatctatatataggctctatatacaagatataaaggctctaggacaatcaatacatttttaccattttaattcatatcaaattcacagaaattccaatttcaatattcatggctacatgtctctatagtaaggttttgcaaccaaggaagatttttttaaatattctgcaatgactacaaaaagtatagacatttatgttgcataagatatatatttatgtgttcttttgtatgtgttaaaattggagaacactaaccagacagagggaaaatattcacatgtaaagtcataggtctggaaaggtcatttctccacggttttcactaatgtgtgtggatattttaatttttatttcttccttctatgtccttatctgtgttgtgtctcatgactgttctggactgtcccttgcggtaggtttcctctgctacttagacatccctagtcaacgctcagatacatttagtggcctggcacctggggctccacagctgagggtatatcattctgacacacatcaagaggctgaactaaattgatttttttaaagataaggtgttctcattttaaacacgctaacagattaaatataacagtattagaaagctcaagttttaagttgatggacacaaaaagaaattcagtcccttgtgctacttttctagtgcgccttattaaatccaaatctgaacaatgtaactgagaatgaacaaatgctccttttgatggttgcaaacaaagcacctgttgaatgtcaaagcaaaccatatgcatgcgcacttaatctttgaaatttaagataaggtctgatgttcccaacccagctttttctactgcaatttatcaaacctcagtactgctaggtttacaagctttttcttccgaattttgttctatgaagaggaaaatagtgctcttgagatattataatagctactgatttaataggtctgaatttaatatgatggtacagaaaatgtcttgcttaagctcagcctttgggacaggaatagacttaatcacttcagtgatgaacagtagcactgagaaattatcaaaaatttagccctatttcatgcagaataattgcagagatggtcctgccttctattcaggtaaaaaccacttagggagaaggagatttaatatatcagctatttcaaattgcattgggctgaaacatgatacataaattcagttctgaaagagacttttgaaaaaggtattttaatcaatgaatttttcattataataatagagcaacatgcagatttatcaaacagaagtagatgttaaatagcttgttattattttttaaaaaccaaaatcttatagggaggcaaattaccgaagctgcaatttcctgagcacacctaagacagtgttaaagacttatacacagctagggttttgaaagggcaaagggattccactgcctgaagttctctaattaaactcagtagtttttttttttttttttgtcactttactatcacgttacctttagtgaccaagccccttgttcacaaattaaacaattaaaataaattttaaaatattttcatgttgtttcctgcctttagctattagtaagtcaacattttaacattcaaagaaacaatgaagcatagattaaactttccaaattaagtggtttgtagctaaccaaatttgataatgtttctacaccgatgtatatcatgatggcaattttcaattttcaaaactcactgaaggctcctaagaaatttccagcaaacaaaggggaggcatcactgacaacagctcaattctgtttatatgaccttcccacctgaatgagttctattaaactgtgatacagctgagtctcagttttttagaatcaaattggagttaaccgggtgaagccaaattagaaaatcttgtaatttcaaggactgagggtgccattttgaagcaccactgaagatccctgagtaagtgggtggattgaacagagaatctccttcctgagaatgctgaacacagcaaagaaaaaagaccatgtagtcttggatgtgggggtagcagagtggaggaactgcggtctgatgactgatgcctatctacagcctggttatacttcttgcatttgagttctatgagaattcttagattcaatttgagagctaagaagagttaagattcctttactttatcagagatataaaacagtctaccactggcttatccattttgatttctgtgagattctacagtaatacatgcatgcatacacatatacaaaaatagcaatgaaaatgctataacctaaaaccaggagacaataattgtgatatataacacaacaatgaagttgaaatcatcaaaatacaaagagcctttgcaaatcaataagaaaaaggcaaacaacacatagacaaattagcaaaggatatgtacaggcagtccccagaagaaaaaatacaaatggttaatgtaaaagtttgtaatcttttcaacctcaggaaaatgtaattttgtatttttttaattttgaataatgactgtgtatagatttctaattaattattctaattacttaaagcagtaagaattacacatccctagaaacaaaacttcatgtacttataacctttgatatttttagcaaaatgtttgcatattagaaaaacacattatatattttgattttttaaaaagaagagcatttgaatgaaacttatgagttagtgagctttctaatatttccatttatagtacacttaagttttaggttataaagagtattcaattggtcagactgagttttgagagttcaatacaattgattttgttcttaaatacaaaacgaattcttatgccaatttgtttttgacagaactgcaaacttaactctttttatcttttgatatcaaacagactcttaatcaatttaattcagcctagcttttggtggagctgttatgaaaataaagtggtaaactgaaattggaagtggggtgaacttttctctaaacacggatttgctggtggtatgtttttttcctctttttcataccatgataaatgtatatgtgaaacacagggaatttaaattttctgaggatcattactgaactatctttttcataggaaataaggcaacaaaaggccatgcattttatattaattattccactgcatgtagcgatgatattttatatgatgctgagcatctctttaaactacatgaatgtgaaacttggcctggttagtagcatgtttatctttcctctgaaagcagcagttttatcagagccaaatacaacaccaagttgacactttctttgcaacaatgttacattttttgcttgcaatattctgaggggcttcttccatcgcttccattttgcttgctgattggggaaagaaattccgtgcacaaaaggaatttaaaaaatatgtaagcagcaaatgtgaatgtgtgtcagacaaacagatttccagcatcttagtgcttgcttcgaacagcttggaagtgtaactacaggcccagttcaatttgagttttgatgaaaactctgaaattcacatgtgatcctttctctatacataggccctcaaggatgatgatgctgaaactggattgacagatggagaagaaaaagaagaacccaaagaagaggagaaactgggaaaacttcagtattcactggattatgatttccaaaataaccaggtctgaagtggagaaatgtcttctaattccattacattttctgaaattaccaagtagaaattgcagcaagatacctcttaaaatattttgtttgctgtgaggggaaaatgcaattatcaaagctatggatgaaataatttctaagaacaggcagtcccctacttgctaatttaacttctggtaattagaattcacagtattcaaccgattacatctacttgtggcactttcagcaggcagacagaatacaaattaacttgaagcagtcggtctgcttctgagagcttctagccacagtctcaccttctcagcttcctcagcctgagctgcagcaaccttccttggactttacagatttagaactagacagggctaggggccttttgagttgggccgctattctagccaaatttttgaaaaataatataatgatttgataagggatcgaagatgaaaaattaattcttgtccattaaatttaaaagcaggatggccttatatgatactaggtgaaactcctagtgctaatgagacagcaattctaaaagagtgagaaaaccagagacttacttctagtgcctaggaatattgcccaaaaagtgacaaggaactaaaggaggtaacaaaacggacatttttgcttcaatttctcaagaagtcatgaaatgtcacctagatgaatgataatattggctaccttttattgactgcctgtcaataaaatagagattgctgaaagacaactgttaaaaatcgcttttcatttgaagacattccaggatccacaacgttgatgaaaatgttcctcaccttctgaattgttaaagaaatgtgaaagctggataagaattaggggaacaggctaagttagagaccaggtttttaaaaatctgtaagacaggcagggtgcagtggctcaggcctgtaatcccagcactttgggaggccaaggcaggcatatcacgaggtcaggagatcaagaccatcctggctaacacggtgaaaccctgtctctacaaaaaatacaaaaaaaaaaaaaaaaaattagctgggcgtggtgacaggcgcctgtagtcccagctactcaggaggctgaggcaggagaatggtgtgaacccgggaggcagagcttgcagtgagccgagatcgtgccactgcactccagcctgggcgacagagcgagactccatctcaaaaaataaaataaaataaaataaaataaaataaaataaaataaaataaaataaaataaaataaaataaaataaaataaaataaaattaaaaaatctgtaagacatagcccttctccaagtaggaaagttttaaacctctccagttcattttgcttctctcatctttttgggtaaagaactgatgaatgtaaaataaatacagttactagtaatgcagcatgtgctaatgatttccagtttgatgagaaatgaacaataaataaatgaaacactaatgctcatctttgataactaacatccaaagtcagtaatgctgtgagagctctaagcagttgcagaaattctgtgctttatttaggaattgacagttctaataatgtcttcactttctaaagtttccagagggttcctcatgaaggatgtacaaatatactgtcatattaaaaataattttttgatcagcttcattatagccctggctagttattacataatacattctagaaaactacattattggtttacaggttcaggtttgtagttataccatttttagttaattacatctgatatttgtggtcatttctatcacttctatgaaaatttgagcatcaggatttggttaggagcaaaacctcttatttatatattctaggaaagatcaaggacaacttatattggtcttaatatataacatattttccaaaaatttaatctggctttctatatgcatccagtatttttttcatcatattgaccattcatattttccagtggaaatctagtggtgtctcattctgattagtcataattttgaagctttcaagttagctttaattattaatactataagtatcattttataaagtagtatttttaagaaaataaataataacactgagaatttttttactaaaatatagtgagagtacatttactgttcccttttcagcaaacatcaaatctaaaaagttatttcattctgagaaactgatgaatttttaaaatattacacattggtttttcccaaatgttctcagttaatttgatttataaagtgattcctaagaagcaggaagttaaagtctgaaaaacttcataaagtttggatcaaatatatgtttaccaaaactaaaagacaaccctaaaatattctaattaagacgctttcatggtacagagaaatgtgatatttatctcttaggcagaagtcagaacaaggttgtaaaaagtaacctcattctttattaacaaaatatccaaaaactctaaattataaatcatctagtttctaaagagtttaagccatctctctagcattttttctgctcaaaagaaaattggttataaaaagtgaggatgaggaagtagaatcttacttattcgcattactacataaaggtaaataccaaatacctacttagcaaacaaagagacagactgtttcctttactaatcatgtctttataatccgatgcctattttagctgttttttgaccatctgtctgtgttttgtttacctacaatctagcactcttattgccactgttgtatcatgattccacaaaaaaaaaaaaagatattgaagcattaaaatagaaacaacataatcattcaggttattgggccatgttaaaagttgagccacctagccaaaatgcacttaagtacacggtgggtcacaattaaaatggttatgcattttttttaagagggggaattgcttttttactctactagctaaaaaggcatgaactcagatttttcaggctgagatgtaaaaacctatggtgttactgcatttacaaaatagcatataccttgaataacagtaagagtctgctttgttacctatatggatctaaatcagtctgttgacacaaaatctctaatggcagagtatctatgatagtctactcacacctctttttttcttcgcaaaaatattaaccataccataataccttaatattcataatgaggcttaagaatgcatcagtaagaaaacagacttaaagaaatgtaatagttctgtggtgtttggaaaaaataaaaaacacagttactcaccattaaaaaacctcacctctaatctcccttgctttctatgaagctgaaattacatttcttttactccgtgtcctatatttaaacacagaatctcatagataataatcattctactgtaagttaaaataaatgtagtctgcacaccagtgaaggtcaaatataatagaaactagaagatcttattttttatctcaaaatgctacccaatttctaagaaatttctactcagctagcctgaggctttgataaagaataaaagtttcccactttgtaattacaaacttgtgattgcttaacaatgcattttcacttacaaatcatgctctggaaagaaaaacaatgcacaagagcttttagcaactggaaagttatttgattacaactcttttgcaaaaatgaactccatatttaactgcaatcagcaaccttttaaaagcctcttttgtgcttaaaaccaggcttcccagagcctgcatcagtcataattgggtttctgaagtctacatagctcagttcatttgccttctgtgttcagattcataagagaatcagagttttattaaaaataaataggaagagggagaaatcccaatatgcagcattgtgaacaaatcgatcttttccaaaatgtccactgatatttatgtatgctgtattctgtcatttatttcagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtatttgttaacatttatttataacctttcctttgttgttttacttaaaagactgatctcatcctgacacatacatagacatgcacatgaatgcttgttcaggcactcacaataattccagtcagaatatgcaaaattcttatcttcactacagtcaacattcgatattgcctttcagcgtgttcagagtaggattcggttcagtcatttcagaatggaatggactagaacatgactaggatgtcatagtcacatctaaaaagtgagatccctccctgaaataaagccaaaggaatgaaatcattatttttctgaatttcaaagtttgtgaaaataagtacatctgttacaatcccaggattaagtaagctgtgtcccaatgcttaaatggtacaaatagacatgactcttgtaacaaaattgtgtgtgtagagggcaatttgagcacttcaaagtcattcttcttaactaatcaataaaaggaatatgaacatattttttattgcatttctagccttcttcctttactctaggttctgccctgatgttcttcatcttgttgaggcacctcagttgacaaacaacagagagattccagccatataatatctcatcaggaaaacatgtcctgcaggtctccaggatcttcgtggatcttggcttgaaatcattcattaaaaacaattcttttggtggatatctttaacgtgcgaaaaaaactttttaatgcattacttagaacaatatgtttctgaaaaatgaaatatctgtgaatatgccagcaggctaattcaaaatcaccacgtccatcagccaggcttagcatatgccttgtgttggcaaacattctgggatgaaataaattgaaaatgagggcatgagtcattttctcaaaccttgttttcaattatgtaaaggggaagtgtctttctattcactctaaaatttctgagttttcaagacaaaggtccctcatgtattgtcagtaatcttatttaaaatctggtttttctgtacctaagcagtgaatttaaagtagcagtaaagacattctggaaatactcagttcatgaagagtatctgctcatgaagcttaatcactatagtcaacatactacgaaacgtaaaatggaaataaaattttaaaaatattgtaatagtaatcacagttgttttattcatctatttattaaccttaacttaggtcagcagtttctgaccaaaacttagtaaggaaattcttaaattatatgagctaatgtattggggctttgttttgtattgcattacctacattattatttctttaaaaaatgctaataattttattagtaatttctataaaaccaagtataattattgaaatttttgaattctctatacatttttatcaagtttcattttatttcagaaaggttgatcaaactatacataaatccaaagtataatatattctgctatattaaaaaatacttcaatttttctagagaactggttagacattgtagattactcatcttgaaatgccaagaggcaatatgatacaggaatggaagtataaaagactttaaagaagcctggctttacaatggatttaaatcacttaacaggaactcaacatgccccaaattaattcatcttcttttcccccaaaacagttatctgaaggagctactaatcattcaaacaataaatatttttaagtgcttcttctgtgctaggtgttttacatatattcattcatccctaaaatagccccatgaagcagccattattacagtattatcacaatttaatagatgaataaacttatgtttaatcacgtgccccaggccctttagttggaaagtccaaatctggtacaaggtctgtctgaccccaagtccaggtttttgactgttgctctttgagtacaatcactagaaagtctagagagattttagatatacaataacattttcaagggtttatccttactctaaaaaattttgtttctttctttgagagtcagctctttggaagggtttattttccattccttctaaaatggaaaaaggatgatgcttactttttaatcatatcattttaataaaataatcaggttccaaacagatggtaaataaatgacagaaaagaaaaactctttggaaaactaaaatttcttgtatgtagatggcccaatattcttccttttcttccctccttaatatacagagttaattgagaaatgtttgctgaagcataagacaaccatttacactgataaaataataggaagtgtatgaaaattgatcaaacctttaagacaagtctaaacaatttcttaattaggtatttctacccagttactgaagtgtagcttacttggattgcactgctttcactgaatattaaaaatgtcactaataaacatcccaacccatagcatctgtcccagatatatttgaacagctggagaattcatcagttcttggccttttgccaccactcatcctaaggcatgtcatacccaagaatgaacttcaaaacccatattataatgcacctcttatattcaaaacatcaatttcctagtcagttcttgtcaatcagcaaattattttagggagtaggtgaggcacttgtgaatatcatttcaatcctttcagactcctagcatagcctttaataaatcattgctccattgaactgtggcatttaaatgccttgaaagagttaatggagcatttgaaataagttatttgcccctcagtaagttacaccctgacaatacaacttaaaacaacaataacaacaaaatattctacaagaaaaacttacttatagtcaaatgcaattggcttgtttattgttttattaatcttaaggctttatagtataactaacagcaggatccattattaataatgctaacagcttctagaactttgagataaggcaataaatcactaaaatttcccattttctctcaagtaattttagcctcaagcagtttgtcaaaagtctgaatttaaaaaataaccaaaaacaaaattatctccctgttctgtttatgcaacgtaaatattaaattaagcaccatgaacaagtaacatgttttaagcatttttgtgactggatattttatcctcatgtcttttaatttaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagaggtaagggaattactagcatttctaacatcacaagctgtactcgccagttgctgctcatataataacttattgagaaatactctttacaaagggggatgtgggcctctagttgttgacagctgataaaatagggtcaagggcactgcaccacctcgttaaaaagtgtacaggtcttctgggtgttatctgaaagaagagagacatttgtgtactggatctagaaacagcaaccctggacacaaacaaacacacatgcccacaggaactctttctaaaagcttacaaaaggccacacacactcataaactactgctttaaaatgacaacgaaaaattattttatttctcatttttccacaatcattttgtgttttctgcataggttatgtagctattacacagaaataaaatggtactttttccttgattgtttctgcatatcacagacagttcattgtttctcctaaagatacgagagcatgattggtcaaacatcaaatataattcacaaagcctgatattaaatccattttttaaatgactcacatttttatgctactcctcacattgtttattcccagttttaatagtttagcccagtatttttccatgacttgaaaagggaagttcaatatgtttagtgcatttaagcttcataataatcaattgtatctgattatgcgatgcctgcctggcaccagcatttttctctgcaaacatttcagtagaccaatactagaaaagcaaacaacccttagcttctccaaattcctaaaacaactcctttcgcagtcactctttagttcctgacgtaaggctgtaattacgcaagagattgctgacagctcagtcatttaggatctccaggtccctaggattccctggcctcttggggtcaccagggagatcagagagaacgtcaggccttcagagaaactcaatcaagtccatcacctgggaatcctctcagcctaaggttttctgtgaccaatctgaggctatgaactttataccccctatatgatgaaatgaggttttagaacaggcctattaattcccatgctgaaattgaacttttcactctaacattgctgtttgctatttgattttacaaaatgagtcaaaaatacttaagttaaactctgctcttttttttggaaaaaagtatgtatacttatactttccaaaaaagagagcagagcttaagtatttttgtatataatattcatgtatacttattatatatatatatatatatatatatatatatatatttactgtctcaatatctaagaatgttgactaacctttcttagacattgacacagatttagccctactgtggatattcaagaatacccaggaaaaataccgagttttaaaattatatgattttatggatagttctttcctataagtgaactaatagtaatgttacagacatcttcatgaaaaaaaaaattcgatcattcagttacaatgtttataattatttaacaaagtagtgggatgtttcattgacttttttgttgaagtgtttgactttgtgtaaattttttgggtgataaagtaggaccataagaaatgtttattaactgattggttttattaattgactggtgtttggttggcttgttggttgaatatgagaacatgaaccactggtacttcacaatgcccacttgtgcagggtgcatggttcacacttgttactttcacctggataattatcaggtggtaatgacatccaagatcacacccagtgggtttctgaaaaattgtgcaatgtttttttctgagctaagggaatgtggaccattgagcaagtttcctctttcagaaatctttgagtacgagcagagtttgaaacttaacaccaggctgacgggtttcactctagaatctaggggtttaggtaaactgcccattcagaattttaacctagaaagtggcctaacatgatttaccccttatcttacttaccgatgaaatagaatagaacatgaagtacccagcatagagtctggcatatggtaaatgttcactaagtgagaggtctctcatacctttttcttggttaattttgtgtgtgtgttctctttccccattttgtgtgttcatctcctcatttgttgtgtctcttccctctatttttatctacttcgctatcctttttctcaccattgcacttactgagtatctgtaggagttattaatgggaaatattaattttatcattacactcgtaaaactctagagactttcctctttgatttctactcaggaatagaaatttttggttttcagttagactatttctctttatcaaggtataggttataaaaaactgtataagacagatgtctagcttacaaagtatctctggatgactagacccagttagaaactttttcattataaaggaagtaagattccacttgcattttatatctgaagaattacatattctcaatgatatctgctctaacttttcatgccactgtccattaattgtagaaaattataattgtgtgaataaattgaagtcttagattgactttagttttatgattttaaagaaattgtttttccactttacatgagcaattttgttcatgattttagttttgctttcatctagcagtgttaagcattatttttaatgtcataatgagatgaaagatatcaaagaaagtgagaaaaaggagttcaaggaacagctttggaatctagaacaagtactgctaatcatagtaagctgttctgccggagacttggatttaaagaggttaaatcaaacccactgacagccaactctgtgatgttaattaaatggagtaaggttttattgccagaaagttgacaactataagtcataagatgatgaagtaattgtgtaacttaaaggattatgtactattttagcgaccaaataatgtgcaagcaatttagaaagaaatgggaaggaacatggatagtgtaagagcctcatttggaagtgactaggcccatgtttaaaaggaagtgatgtggaagagataaggtgtaccaggaagagccacaacaaaagcacattgttcccactattcgattctatccccaggtggaaacatcactggtgaggtttccatttggcttgatcgtgttccgcaaatttacacaatcaaagccacctcactggtttccgttcacttgccggtttgttttttcagtgatgcacggtcgactactttcttcctccacttccccaccttctaatagatgaaggtggaatttgaccttggagacaggtcaacatttctcttgtttttgtttctttaaaacagaaatatgtatcctctgagttcctagagatggttatatataaaactgttgtttcttaatttttttatttctcagtatatggcttcaaaatcatccttggtaatcagtatataattcttcagtgtgcaaaaggctaccaatatgtatagccccaagctgaatctttgagattttcttctctttaatctttcaaaaaataagtatttattgtatacacaagtcaaacctgaaaccaatctttatctttttagaataatctatttaatattttgacttaattatttcaaacattacaagcaacagctatgactccatttttcccttcttataaatttcacttatgtgcagttttaaaattgtctcagttctgcaccccaggatcaggtatatcatcaaagtatttaaactctttttattttaacattttgttcctatttataaagtttatttttatctccatgccttctactgatatttgttatctctaaaaacagcataaggaatagatagcaccagaaaaaaaaactaagcctttttttttaacattccgccctgatatgctgcaagctctcatgacttgagcagtactgttttattgttttgtttccattagagaataagtctatcacctcggctttgtgtaaaatttggtaaagagtgatttttaaatgagattctgtaatctagtgcaaatggaaaaaaattgattgcagaattaaaacaagttggaacataatttaattagtatccaagcagaagggaagagaaactactttaatgctttaatggaaaatcaattttgcaagaaaatttcacatttttaagcctaattagaaaaagatttacttcacagaaaagcatgtgaagaatacatattcaatcaaatggcaacagttttttaacttccaatggtcaattccttagtacttccttggaatgagttaaagtcattattccttatggcatcttttatgcccaaggatcatgaaagaagtgatgctatttctaagtacatttagcaatcagacggcaactatgctctccaagaatctccacccaacgatcaatgccctgattggaaatccttataaaaggttaattgttggaattttaaacatggatgccaataagaaccttcctggtcattcattcacaacctatcacatttgagaaatacaacaaaaacattaatttgcatccatagcatttcaggaattatacttgtttttctttacttgttcattgtctatcttcctcactggactgaaactccatccaggcagcaaccatgtctatggttcctcaccaagtgtaatcacagaggcaagaacacaataggcgtgaaaaactatttttgaatgaatgaatggagatgtttattgtattgtaagaaatgtgtccaaacgccctttttaaagtccgtgttaatagtcattgtgttcatattttacaaatgaaggttaaagtattctgaaagctaatcagcaaaatgtcctagctctgaatgctgaagatagtttagtgcctttctgggtttttttggtatgtttctttaaagatagaggcagtacagatgcttagcaaaatcaaccttgttattgtttttgtttttggttttgaaaatgataatagattttgtctcaacaacttttgtttgtttgttaaaggcttatttagtgtctccctctttgtaaccctctttttcatcctgtttccataatgcacatggagctcatagattaccttaatttttatttaaatgtaagactgaaagctatggtgtaagtctctgcctacatcatggaaattgatccagaggaaaatgggaaagaattagttctagggagaactcaaagagtaggaataaaatctaagtttatcatgcctagaatatttgttgttaatcaattttataatatagtagatatagtttagtagtattgaattattttatagtatattaaaactataatatatattagtgtacctagtatctctgcgtccatatcatgggacttggaacatattgatttccctttaaactgctacagaagtatagatgtgttttattttttacagtatcttgggtcatagctgtggtttatttgagtttgagtctttggttagaatttctgtcaccaattataattgtattcttatgtataataaatgttatccacttcgtgatgtggtttccaagaacatgataggaaaaagcaaataacttgaaatatctctctagtatgtaggactgtaatttgcttgcctttctggttaaaaagacttttcaggcagaggtaaaagaaatccaaattctcactttagagtttctaaacaaaaatccaatattttttattttaaattccctagaaaagtaatataaattagactctaatttgaagcaagaattaaagcaaggagagatcctggacattttcaaaatgcactttggctaccttccattgttctccctcacgttgtcatactttagcctactgcacctgccttccttgtcacagtgataaccacccaaaggtctggtctcacagcctggctctctagcttccaaagttcatcttcattaaagcttatattaacttctctacctatcctataaacacaaataatagctatcatttactgagagtctactatatgctgacaaaaaaaaaaatctcataacattcttcaaaattggcattaccaaatctgttttacaaaacagggaaggaagggaactgagacccaggaaagtttaagtaatgtgtccaagtttacacgggcaatgccataactacaattcaaacacaggtctaaaagcctacacttgccattttttgagattgagtctcactctatcgcccaggctagagtgcagtggtgtgatctcagctcactgcaaccccccgcctcccgggttcaagcgattctcctgcctcagccgcccaagtagctgggattacaggtgcctgccaccatgcccagctattttttgtatttttagtagaaatgaggtttcaccatgttggccagcctggtctcgaactcatgacctcaagtgacccacccacctcggcctcccaaagtgctgggattacacgtgtgagccactgcacctggcccacaccattttctttaaagagtctctcttggtcttttcaggtctgtctggctcccaaacccattttctctctacactgccatattgccactaagagagtgcaaggatattgtctgttttgtttatctacttaggcccagcacattgcactgtgactgcaacatccaaagtgcttaaataaatattttcaagtagattggttgaacaaattagaatttaacaaatatgcattctaatgttctatcacctttgagagagtcatctttaaaagatacccagtcattccagttgcactgtagtatcctaaaatatttttgaattccagtccctctctccaagtatctttctcaatgtataatacattatctgttctcaataatgatttgtctttgctttgaaaaggtaaatctcattgaaatggccataactatgtagggtcaagtataggctattagttgatgatcgaattgggtaaaacagttgtaattactgtgggaaagtgatgagatggatgttcttgtgagttttatattctgattctgtcctaaatgctttgagcattaacatcattacatggtctctcaaatggtttgctatggggaaaattctcattaggagatataaattctgatacacatagtaccaagaaaatataattgttttaatagaaatcaatgtaagtattaggttttctttttatccaaagaataaaaggaccgagagttttcagctgaattttaaataaagcagagcaaagtggatttgggagcctggatttcatgtgtataagctggcagagcagaaagtgaggagtgggagttgaaatgggaacaaatataaaacaaaaggagaatgagaataatgatgtagacaagagcagccttgtttacatctggtttttcatattactgaaataatgaaaagggttttgagtgggaagcaatgtgagcaacacaggagaatgttttgttctgtcttccacagatttaaacctattcaaatgtaatcttttctcttgagttcatcatatgcttgggagcaatattttttatcttgtttgtgaatcttaaaattagatgtttttaccttctgtcttactcctacctacctttgagcaggccaaatgtttgtgctgtaaaatctttaatccattacaatctgttactctgcaattagatgaaatgtcagtgattgacttgtactagttgtactacagaataagggaggagaatgaggactcgctgaaaaacaagagcttaaataattaaagaatgcgagagagaggaagcatacacagacacacaaacttacttgctttaaacatgattaaattcttgccaattatgaacaagaacttttaaatactgtaaattaattttatttattcattctttcactgatttcatcatatattaaacctcttttataagccaggtattgtgctaacttcagggaatacagtggtgaataagatagacccccacgttcggccacctgaccttccgagctggcggggctgaggctggagtcctcccaggagccacaggggaatgaaatttgcagacttccggggcgcctggccctgggcgttgggcgagcccggggatggtcggaagggctgggggtgggggtgggggggcgtgggggggggcggcaggaggagcccgaacgaagcctttgcgattacagtcatggccacccagatggggcagtcttctggaggagaagggctgtttaccggcaatggcaacattggaatggccttgcctaacggcatgtatgacttgcatgatctctctaaagctgaactggcctcacctcatcctgtcttgctggcaaatgcggccttcagtgggaaagtaaatggcagctgctgtgattacctggtcggtgaagaaagacagatggcaaaattgatgcctgttggggatgacagcttttcagatagtgaagaaggagaaggcctcgaagagtgctgaaatgaaaggtgaacctcatgggctgagacgtttggaactcagcgttgtagaacttcagcctgcatttgaagcatcagctgctccagagatttacagctcaaataaagatcttcctcctgaaacacctggaacagaggacagaggcaagaactcgaagaccaaatcctttcgctgtaagtcatgccaatatgaagcagaatctgaagaacagtttgtgcatcacatcagagtgcacagtgccaagaaattttttgtggaagtgcggagaggcaggccgcggtggctcacgcctgtaatcccagcactttgggaggccgagacgggagaatcacctgaggtcaggagttcgagaccagcctgaccaacatggagaaaccctgtctccattaaaaatacaaaattagcccggtgttgtggcgcatgcctgtaatcccagctactcgggaggctgaagccaggaggcggagcttgcatgcggtgagccgagatcatgccattgcactgcagcctatacaacaagagcgaaactccgtcaaaagaaagaaagaaagaagaaataaagaaagaaagaaagaaaaaagaaagaaaggaaaagaaagaaaagaaggaaaagaaagaagaaagaaagaaagaaagaaaaagaaagaaagaaagaaagaaagaaagaaagaaagaaagaaagaaaagagaaggaagcaatagacaaggaatctggctcttccactgcagaagagggagatttctccaaggtctgtattcgctgtgaccactgtggctacaataccaatcgatatggtccctatactgcacacctgaaacaccacaccagagctggggataatgagcgagtctacaagtgtatcatctgcacatacacaacagtaaacgatatttggaaactgtaagcctggaattaggagacataactattccttcaagttttatagaatatcacttgggagattccaaaaccatagctattacatggcaaacctaggataagagcagtagtatgagtgctggcagaccagctgccactttcctatacagtgaaaaaggccggtgaaacaagtacaggccagatttttaaaaatcatactttctcaaggatctccacaaactggagggtgtcctggctgtctgtgtgatagcctctttctacaagtgaggcctcaaatgaactgcagctatcctggtgttcctgtgggggcactttgtatgaaaaaagggcatgtactccaaaacatttttgtaggttctttggccaggcgccaaacagtacgaaagagtccaatgtaggatttttcttactgatagcagttattcattgcagtgaaataaaatatgatcccagtagggaatcttgaattctgacctcccatgttctattttgaaataaccactttatgtttctttttttttttttatctgatgatctctttgaggccagcttcagattttggtggtacaacatgaaagattaggaaaagcattaataatctgtgggtggaaaacttattagaaatctgagagtaaagtttgagttaaaagttgtttgaacatggaattgactgggaggccaaagatttttaaaagcagaagattcttaagacctgaggaataagttatgtgataatggtgtgtgttttgtgtgcatgaatggaaattgtaaatgttgaattctaggctccgataatcactgtcaacagaagatcaagctgcaaatatttatgctttaaaacttaaattataaagctagttaaatctttctaacaactagttttaatgttcatgggtacattttacctaaggtactgttaacattgtatagagaaagattcatcttaagcacagattggctatcaggaattagtttggggatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttcagtttaattacatcccatttgtcaattttggcttttgttgccattgcttttggtgttttagacatgaagtccttgcccatgcctatgtactgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttcccaattgcttctttttctgaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgattcctccagctttgttcttttggcttaggattgacttggcaatgcaggctcttttggttccatatgaactttaaagtagttttttccaattctgtgaagaaagtcattggtagcttgatgggaatggcattgaatctataaattaccttgggcagtatggccattttcatgatattgattcttcctacccgtgagcatggaatgttcttccatttgtttgtatcctcttttatttcattgagcagtggtttgtagttctccttgaagaggtccttcacgtccctcgtaagttggattcctaggtattttattctctttgaagcaattgtgaatgggagttcactcataatttggctctctgtttgtctgttattggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaatacgctttatttccttctcctgcctaatggccctggccagacttccaacagtatattgaataggagtggtgagagagggcatccctgtcttgtgccagttttcaaagggaatgcttccagtttttgcccattcagtatgatattggctgtgggtttgtcatagatagctcttattattttgagatacgtccccatcaaaaagtgggcaaaggacatgaacagacacttctcaaaagaagacatttatgcagccaaaaaacacatgaaaaaatgctcaccatcactggccatcagagaaatgcaaatcaaaactgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacccgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaagcaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatggatacatatgtaactaacctgcacattgtgcacatgtaccctaaaacttaaagtgtaataataataaaataaaaaataaaattaattaattaattaatttttaaaaaggaattagtttggggaaaatgtttttttgtggattctttcatactgcaaaagtaaaaccatttgccttctggggaattgagctaaattctcatctagtctaagactaaaatgctaaaaacaaaaacatgaaggaaattaaaaccccttattattaaatcgatttgtaaaaatgttgttactggaaatttattggacttgaggccttcttccagaaaataaggacttgattgtcagggcctgtattaggttctgaaccttaatgccatgtattcgtacttatcagaaattatttcagtgaaaagtacattagcagtatgaacttctgatccagttggaagttcttccatttgaaaaatgtgatatttgcatggaactgttttcatctttttcttttctagtcccactcccccacactggatagaatttaagctagaattttcccttttgataaaagaacaaaaaatgaacatgttatttgtaagttgatgtgtagtatctagtgataaacttgaaacactagaatacatgacaagcctaatcttaggtagtcttatgaaaacgaatctcttacctatcttttgaaactatattcacattgatttttaagattttttaagttatattttttccttttttcttcagagctgcttcttattttggcaccacttttttcttttattgtgtaattcacaaggggctgcattttttttttttttttttgataaggcttgtaactatggctggatgttttgctctagtcttctaagaaaggccattttatttttcagagtcacttataaagtcatgtgtaactaactttgtagactgttttgcatatgactgctgctacaaattaaaacccaaatagacctcattgcatgtcactctatgaatgttgacaatgaaaggaataccttgcctgtggtatactgtcacttttggactgaaaagctgaggaagaaacttaattttcttttttgcataagtcagaaaaacttacagctggtgttcccagtttcctggttgactccagcagatgaaatgaacagatagtgttaattcagactgaagaaattatctgaatcttggcttgtgtagatttacaatctacatgcaatattaactaaatcagatagcttttacagtttcacatgtgtacataggttccctcccagtcccttccatacccattagttattgaactttctaattctattgaaacattacaacagtgttttgttgcaccaattttataaacttatgccgtgcaatacgtgttatttttctgaggcagaccaaaggtaaatttctcaaggttcttgctgccttctttagcagtatttgagggaggatcttttatacatttgtaacagataaaaatgaagcagattgcaaatccttttttaaaatcttaaaccatgtaccaagtttttggtccaaattgtgtaggataagttaaccttaaattgcattctattaaccaataagagggtatttccgtaagcatagttatgttgaaatacagttttaaaaagcaaaaaaaaaaaaaaacaaaataaaagatagacctgctaagcttagtcaattaaaaattaatggtgagacagaactacagggtagattaaagctcagcctatatgcatcaccatgactccgcttactactgatgtctccttcggcttgttgcttaatcctttcataaaatgggattagtatttactcacctccatgagttgtgacacactctaaatgagataattaatgtaaagcacttagaacaatacttggcaccagagaagctctcaaaaaaatattagcggggccgggcgcggtggctcacgcctgtaattccagcactttgggaggccgaggcgggcggatcacgaggtcaggagatcgagaccatcctggttaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaattagcggtttttgttattaaaaacattggtcagagcccttatttccttgccagccgaaaagcattgctctgatgactagatttacatccttccttttttgaggacagtgggacagcctaagtgttcagaaggcattgtcatacatggttttaataaaaaagtggatatctgagcctagataccatgtgcgagagtctgtgggatgtgaaaagattgcacaaagacgaacccagtttaaggctcagcacgtgtgagtggaagatagtgctaccatggtgtgacctcagtgattgtgcaccaattaattcctctaagctctgacaccccacaaaggaactcaaagtttcaggctctgctaaaataagacagacaatagcaagtgttggcaaagatgtgaaaaaattggaattcttatacgttgctaatggaaggtaaaatgatgtagccacttttgaaaccagtttgacagttcctcaaaatgttaaataaagttgccatgctatccaacaattctactaagttctacccaagaaaaatggaaactcatgtatacacaccaaaaaaaatgtacaacaacagtagtagcatttttcataacagccaaaaaagtagaaacaaccaaaatattcatcaagtgatgaatggataagcaaaatgtggtatatccatacaatagaaaattacttagctgtaaaaagaaatagtcttgatacatgctataacactcatgagccaaaataggcaaatccacagacagacagaaagtagattcatgcctaagggtaaggttagggtaggaaatggggaatgacaggtaatgggtatgggattcttttggagtgatgaaaatcttctagaattagatagcaatgatggttacataacccagtgaatatactaaaatccaccaaactgtacactttaaatgggtgaattttatggtatgtgaataaataccatttttctcaataagctgtttcttattttttattttctttattatttttatattaaatacaattaaaaaaattatttgagacagggtctctttttgtcacccagaccagtgtacagtggcacaatcatagctcactgcagcttcaaactcccaaacccaagcaatcctttcacctcagcctcctgagtagctgggactgcaggctggcaccaccatgcccagctaatattttttgtttgtttgtttgtagagactggatcttactatgttactcagtttggcctcaaactcctggcctcaaacaatcctctcacctaagcctcataacctgtggatcaccacagccagtcctaaatctgtttttaaaaaaaagtttcagggacagagatcctaaacatcaaagcatgatgctccaggctgactggggttccatgtgaaacagccctcaggtgtgctggaaatgtctttcctggggctgtttcaaaagttttgggatattcgctgaaaatattctagtctctctttaaagtagaacacttgtctccaaaatcacactccttattaccatttctattgatataagggcagtactaaggttcactttttagagatgaggaacccaggcctaggacatatgctagccaatgagagctcaagatgtaaatgccagtttttctgattccacagccattttctagtagtctactctcccttaagacaagaagtttatgcctaattctcctgatgtaaaaacaaagttttaaacatgagaaccaatctttttgcagcttgttttcatactgtagcttctcagagattcccccaagttgctcttttccagacctttttcctactaacatcgtgactttttaaattgaaataaaattggcatgcaataaaatgcacagatgttaagtgtacagttcaatgagtcttgacaacgctatacacagtgtaacaccaatcaagctacagaacatttcttatccccaaagaagttcctcatacctctttccaatgtgtcttagtgcaagctcctagaggtaacttctgttctgatttttcttaccacagattagtttgcctgttttgaactatataccatggaatcatgttattttgtgtctggcttcttcagctcaagatgatgtttatgagattcttcatacagtaatatttcactcctttttattgctaagtggtattctattatgtgaatatatcaagatttatccattttcctattggtggacttttgggttacttccagtttgagattgttaggaataaagctgttgtacagctttctgtggacatatgctttcatttctcctgaactgctggttcataggtaggtgtatgtatcacacttctttaaagctaaaatgaccaggaccccaggtaatagtctatacaggaatgtgttgtgatacctactgtacaggcttcagtcatgttttcttttcattctcactagcctccacgatgatgctcagtaccaccttgattcttgacctgggcactatgttgtctatcgtccaccgtacaactggcacctcataacacacgtttattctctaagtgtaggtgcatacccacacaatgctgttagataaaaagatgccttgtttacctgtttcgttgtctcgataggtagaacataagcttcttataagtgaggaaagcatcttagcacttttgcacatcacagtaattagctcttaggagaaagtatggcatggatcaaatgagcatagaactcggagtccaagtcacatcaactctctgagcctcatttccacatatgttaaatattattgaaaaaatgtaaaataaattatatacctatgtgtttgaaatttaaaagttatttttcaagcataggtctgtccaatgccaaatgaattcctaaaataaacaatcggatacatcgagtagctattcactttcactattttatggggggaaaacaatccattgtttacagaaccgtttaaaaagtttaggagtattttcactctcactgcagggctagtgaacatctcagtatctttgtcaccacttccttccatccttcccagatttcaagtgcccgaaggcaaagtagaatgacccctaagcttttttcgaaagctgatggaataattccctgtcagcctactttatgcaaaacaacttccggcactggctgtcaccctgccaaccatatctccactcttcttactttttgctctactttaaatgtctctcaaatcattaatcatatgcaattattttccccctgggacgggccacagcaagattgtgaacaagagatggcaaagtactcactggggcgccttgctcctgggcttcaggagctggcagacttctggcttgaaaaagagcaggacattgcacagtgggagaacccggggcacacaaacccagctcaagtcaagctatctactcacaactttaaaatgcttatagggcactgttgtcagaggtgactgtcgggcgaagtgtcagagccctggcatcaggaagtgctcaactcacgtgttggtaaaaagaatttaccaacaacagcataggtttgaaaaggaaaagtttattggaaagaaagaacactgcagaagagtgcagcagtgcaccgcagtgagaggactgagtgcactgctgtgggtttttccttaggggtattcatggaccttaaggcgggagcttaagggtaatttggaccgtattagtcacatagatcatgataaatgatcaagtttgtagacattttggtgtgttaatgtcagcaagggttgtaaaatgagttttggaatggcattactgatataagatactgagctgtgaagaattgccccaaatttaaaaatttttaaagaatgagaaagctaccaaaaatgtatggttccctaaatgtactgcaatgggaactatggcactgaccattctcctaaatttccatttctatataaagagatgtatagaaattttaattacttagaaagattgaaaaaggcctggaaccagaggccaactttggatattaggaaagtctaattacttctaattttcccagataaggagttgtgcctccggagggcctgtttaatagtcaccgggtgacccgtactctcttctaaattcctcaaataaggagtttttgtctccggggccttttcaatggtcaccaggtgattttcactctcctctgtgacctggtttgtcctcgaatggaaccctgcttccagcatcccttctgaaagccttctacatcaatatttctcttttcatgtgaactataactatgttatatgcaagaataaatttctgggccctggataacactagaatacagacagaaacatttatgagtgaagcgaaaggccccacgtacaattctagatgaggacaaaaaggaaaatttgaaactatctctagtcaacttttcttattctctaagctgcagatactctggaatgtagtcagaggttgagatttgccacaagttaaccaactgctcttcactttaagctgtgatttctacatgaataaatcaatattccgacaaggtgcttccctgaattttaacgttctgctagtgttttaaagataggagaaaaaaatgtttttcagaaaccaacatagcgtcagaaatagtctgctcttaatcgtatctcagtgtcaaaaaacaaaaacagagtgagattagaatattaaaataggcagagagtgtggaattttatgtttttattttataacgtatttttggatagcctctcaagtcataaacagggaatatagaaagcagactttgaaatgcccgcctgatataaaataaacattaatatttaacttagaatcagaggagagatgtacgcctcttttcaaggtcatcaactttccaagctgtgtcacactgatgttctgtttatgttgaagccatgctgccatgtttgaagatgacataaaggcaatggaacctatgtgtcgcagtaggattacctaattttggtttaaaaaatgccatttttgtttctttttggtaaacagtgctctctatttcctggaaaatcacgtatagtgcaaatttacctttactcatgtttaaggtcacaccattgagtatctgcttaagtcaagcactgtgctcagtgtgtaactcatttactcacaacaacactgtggggtaggcgccattattatccccaatttataggcaaagaagctgaaactcagagaagttggaattccacgtggccaagtagctaataatggaagggctgagattcagaattttgtctgaccataaggttcttatccatcatgttaaatttactctaacttagaaataggtcacagggcctatgcaagggatgatgttttggtctgcaatacatacactccacacatgccctatagttgtctgtttctttactccaaactcccagcaattctgccaacaccgcaacaccacacagtaccaagggagggctgcaacagccagcatccattcaacaccactcccaagtctcttagctgctcccaagatttctgggccactctttccatgatatacatatgcatgaaaaatctcatataaaattcacatgcttctgttttcaagtccctctattccccatcctttgctttattccattccacaatagtgcaagttcctggaaaaacgcaataatgtcttccatctctttcatcaccttcccttttaccaaataggatgaggagcatggagtagaatatccatccctgtaattatacctaaaacactaaagatcagtgaagtgtgtattttaatgttctccaaatagtatttaattaggggtacttgaatatatgagaaatgtctttgcaaagtaaatgttttacgtgcttagagttttctaagcccttgtgtttcataatgcaatataagctctttattagtaccctctggctgagataagatattgagctgtgaagaattgcccaaaatttaaaactttttaaagaataaaaaagctaccaaaaaatgtatgattccctaaaatgtactgcgatgtgaactgcagcactgaccattctcccaaatttccatcccaaaaccctgcttctcatgaaagagagagagaaaaatagggagaaaaaagcacatgctgcatcttacaaaaccagatagttactaaatgcttgtcatttggtccccaaattatcctttcttgaaatccaaatctttaatattttaaagaataaattgcagcatttctgccttgaggtttttatgtcatcttcataggaatcattttgaccaattttacatataacttagctaaatttttgtgttagatctgaatcttggagcataactagtctgtattagatgaggaacagttgtcattttcagttatgactctccaaacgtcatatcagctggtgctatggctctgatttcctctatcagcagcacctctctcgggtaatttatctttttttctttttcccctttttttttttttttttttttgagacagagtggtgcgatctcagctcactgcaacctccgcctcctggggttcaggtgattctcctgcctcagcctcccaagtagcttggactataggcatgttccaccaggcacagctaatttttgtgtttttagtagagatggggtttcaccatgttggccaggatggtctctatctcttggcctcgtgatcggcccaactcggcctcccaaagtgctgggattacaggtgtgagccaccacacctggcctctcgggtaatttctgaagaccttgattctcaccaccactgcaaacccccaaacccaacccattctacctgctggcttgtgctccctcttcagaactttcctaattttgtgattctagttgctgttcagtccccttgagaggaaaaacaatggacaaacttaatttaaatctgaaataactgattagttcaatgaaatctcacaaactgtgttacagatattattaagacaaatttgcaaattaggaaactgagactcagaaaggctaagaaatttatctggaatcatataactaaggaagtaatggccaaaaatttaaatcaaaagtttgccttactccaaagtgtgtgttaattactattttaaagttctgttaaagcagggacttcatgttaaattcctagtattgggagttcaggaaatgttcaagaaaagcatgagggtccctggtaatgaacttatgaaagaaatgtatcatgtgaatatggtgacttttccttttttaacaaatggattgaaggtttcctgaaaaagtgatgagggataactttaaaaggtgcctatttaaattagcatacaggcagtttgaattctagttcttcctcttttagtatgttaaagggaaggaaatggtttatcccagtgactgctactccatagacacctgaactgaacctgaaggtagaaaaggaatgggacttagctgaattttaacaaggatcatttaggccagggctgctgttcagggcactgggtttgagtctgagactagtatttaccaaaatatgttatacaagtcatcaggggatacattcatggaaaaactcagtacacaaggacaaggaccaaaccttctttcagatcctcatgttgagcacataatgaattcagtgccctgggctagaatttaagtaactgggaacagaaaccagttcatcatgtgtaatttctataggaagataatgcttcagatattgtgtggtctcctccaagtggagcacagccacttgcccagccattagttagagtgcccggacgagaggagagaagcagaggctgggaacgtaacaggggagtgcagttgattgttcctctcagggccaagatgaagtgacccaccgtttcccaccgcccctctcattctcagtatacagtctggtcaatgttccctaagaaaatgattcattcagcatgccccatttccagttgaaatcacatacacttgacttcagaactgagaacgaaaatggttcttcctaaatgcaagttctggcatgcctaaacaaaaatttcatatatagtaagctaaaatctcctaaagagtttaacgcataacttattcaaacgtattctgagactgtgaaaattgaggactcatctatcctcaaatggaaactgccgctggcctcatcttctgcaccttatctttccttttaaaaaaaactctgagatttaccacttacatgcctgcatctgtttggattaactttcatgttccatatatttctgtttttattagttcatctttgtcctccaaatgtgggtcatcatacaagtgataagtttaagtaagatttacattctctttgttcttatgagtgtatcagtgaatattattaatattgcctcacatttgcaggacactttaatgtgctatggaagccattggaacccagccccgtatttctgaaccaaattctctcctccctcaaactctcggggcgttgggcatttcctcaattatgtggcgtctatggcagtttctaatctgattggggctcttaaaatagaaccagaatctcttttttggagtgagagagcgcagtgatgagtatttattaattaagggaaaagcctccacttgaggcagctgggaatgactttctgaagacactaaaatccaaataaaaagaaagacattcaaatgtgggaagaaaaagtaaacccagtaagaccctcctgaaagtgttaaatgttgaaacgatatctgaaagaaccaacttctttggaggatttttaaaaataagaattggggcatggatttgtagtcttgcttcaaggcaagggaatagacaaggtgatctcccgtgggatctaacagccctgtaattcatcaaagaaggtatttaaaagcaaagccatgggggaaagagaacagtagcatcaatctaaatcaagccttacatgcattttctctcttttttttttttttcacttctaatctctccctgcttttttgtaagacctatcacagcaggacatactctctacaattactttgacaaacaatggtaacagcacttgggtttttaatgtcttccaaagtaatctatttttgacagtgaaaagtagaggaaactgattcctgaagctatgaactaaaatgacagatttggggatctgatttaccagagtgggttttccatatatcagcccttgctgacattcctgggcaagtacccacaggcacaaactcccaatggaaagtcggataaatgtaacacaaacaacagtcataagttgactttcctatcaggtaccttgtgaaaaaataggtacaacattttataaatcttttattttaatgaagtttacttaacaccgaaaacgtcagtccagagatgtgaaatcttacattataaagaattatggcaaatagaaacactaacaaactgagcctttagctgtcatatctgaaatactatacatacacatattcatggatgccaacatgctgtaacataattttacatattaaaataggctcaattttcaatgataataaaatggttactgatactatgacttcatggaatattagatagccattaggcatacttatatggaaaaatgttttagtatgttaaatagaaaaagcaaaatataaaattatatataaattatatatatatgcttttgtagtgggttttaaaaatatttgcatatgtataaaaataatttgggaatccatgaaatgagaataattattttaggaggctaagattatggtatttttgtttctattttcttttttttttttttttttttgagatagagtcttcctctgtcacccaggctggagtgcagtggcgcaatctcagctcactaccacctccacctcccgtgttcaagcgattctcctgcctcagcctcctgagtatctgggattacaggtgcacgccaccactcctggctaattttttgtatttttagtagaaacggggtttcaccatgttgttcaggatggtctcaaactcctgaccttgtgatctgcctgcctcggcctcccaaagtgctgggattacaggcgtgagccaccgcgcctggcctgtttccattttcaatatacaaaaatacaaatgcacacacacagggagataacacatttgatgtaacaaatgaccgtgctttcagaattcagtccagtatattatggttgaagaacagacttacattaagtgttctgccacgagttatcagaaaaagtcaatagacccacatgaccccgccttcattcccttttctcctcttaacacctctgccagcaagaacacacacactgagtgggccattgtaacttagatccatctggtaagattctttttcttcttccaaattagtttgttccaaaaattatccagcagattgttcaagagaggcatttaatatttgtctttaagaaatgagaaaatagggaggtcaaaatgaattagcatttaaaaataagacctatagcacccctgcggtgcatctgtggggtttgagatgtgcagcatcatacaaatatcactaggaaactgagacatttggaaacagctaagaagagccacgttgctggaaaaaaccatgactggcaaaaaaaaaagctttttgtgaatattccataacctacaaagaacgggacaaaaataaatacataaagacttataccctggaataacacagcagaaaatatcttattaaaaggttttcactacctttgagataccatgacataatcatattaatccaaaatacttccttgaagcatggatttttaaagcttgactttttaatgccagttgggctgtgttataagtagccatcagattttttgtttccttttcctggccaactaccaaaaatctttggtagttggtgagtttgctctactacaagaaaacctggtaaccttgggatactctgctgttaatatccgattcctattcaagtatcttcccaggaaaagcatgggggttgcagggggaggccaaaccatctgcttattttaacaaggcttttggccagcttctcatggttaaggagcgctaactctctggctagcctaccagaagctcagagaatgagagttcctggtatttacagtgttactttttaaatcagtttcagaatgtgattagcacaccttcctaggtaggaaaaagctatgttatggctgaaaagaaaagaagcagatactcttattcttggtggatgtgggaaaacaaacaatttggatactgaataaagaataaatactgttaagcacttaatttcatacacaaaatatatagagaatttattttaagctttcaattgccttttagatgccaaattcagatctatttatagatgccagctttgagtaattcaaaaatttatataaaatcatttctgtgaaacttacagtttatggaaaacagagaaaggtttgcccatttcaggtaaggcctatgatttcctccttttacactgatttagtatggctacagataaggttcatggaataagaaggtttttgtagtcagacctgggttcggattgcctctgccattcatgagccatgcaaacttgaagacagctaacctccctgtgctttaatgttctcatgcataagatagagaatataaaacctcatcacagtgttattgtagggattagatgagatgcaatatgcaaaaacacccaaaactaacaagtatgcagtcaatattagctccctttcctcttttccttcttccaggctcttgggctactgtaatttacacattaactcattctgtaactttaatttcctactacctctttaaaatacagaccatatttattgatggggggaaaatatacaaagcttaaagcatgtgccgtaaaatagttccttaaagggtagtacagcaaaatggaacacattttcttgcccattcacaggacgactgtgaattttagcataattattgaaaaaaactcagctactctgactttttacaatatctagtgatcaagaaaacctttagatcatattacttttcctctcaatgttgtagttaggctattcactcagagaggcctgtgacaagctatagttaataagtcttccatggtgtcaaaagtaataatattaacacgcctttgtgagttaaattaattttgttttgtgcactggcctgcataaatgtgaatgacatttcaaaatatgatcaggcagaagctgagaaggagccaagtggcaaggcagaatgagatgcggtcattagagcagagcagccagctgcaagcatttgtcagtgcaggcaaagaggtgcaggatattattacagcaaacttagggggttgttctttcagttcattttgccctttggaaaaaaaatactgatttttgtctttagagaaaaatagagatgtttgacatccaggctctccatgtttggaaatgaaagaccatcttcctgctaatcactgatttcaagtgtctttcaacccacagattttttttctctgcctgcgagaggcagctgattggtaatagcttttaaactaatgaccaaacagtggcattttaaagtcttaatggttgtgtttatttcagagacttcttcagattccccaccaccaccatacacaaaggcatatacctcctgcaaatagaacaaataaatatgctgtctgtaaacagttaaaagatacaggttgaacctaggaagaaaacacctcaggatgactcagggatcagatgaccaaaatgactggtgtaataagttttatactttttaccaaatggctggacaagcccttttccacttgagttctagtattttgattactgcaatcagaaatcaaattataagaaaaatggagatgttcctattaaggcagtcaccgtaaacaagaactggataataatttaaggggctctgtacctcttcatatgttaaacttgacaatttaggcaacatcccatagtaatgagcctctacatttctttcatatatctagtatcacaatatttttgtctgttcagaagtactacacatgcaacaaacaatttttaaatttgtctatagaagtttctctattttaataaaatgaagagcactatattcagagctctgcatattgtttagtatccacagcaatcctacatgatatgaaagcattgttatcctcatttcacaaaggaaaagtaaaggaattccctgaaagctataggactgttaagtcacagaatctgtgttttaactcagatcaatttcactccaaagcctgtgctctaggtaacatatagccaaaaatacccatgccctatttccttctggcaaccaatccactgtgacttctatggtaaacaactatgttctgtagcttctgcatttaactatctcaaatcaaaaggcaccagcaaaggaaatggcttattctggaagattttgcattaatctgatgattcacttcaacaaacatacatcttcagatcatttcatgctgggcactggtgatgtaaagatgaattagacagtgctaggctcaaggacttcataggcgatgaggaagggatgatgctatctggaagtgaagagagttcagaagagatggtcagaatgtaaatttgaaatgagttctaaaggatgactaggaattcaactgattgagaataagggcttccaagaagaggaagcagggaaagcattggaacatgtaaagaacaagatgtccagatctgattataatctagtactgtacatgtgagaggggaatggcgtgaggggtaagccagaaaaaataaataagggtaatattttagggccttgaaggtgggagttaacattttaagtctcacatttgggaggcagggaggatattaaagctgtcagtggccacatcagctctgtgtgtaagaaagccaattttttggcagtgtgaagatgaattggaggctcttgcctccatttaggagtccatgaacgatatggctgtgaagacagaatgtgaactaaaattgaaaaagtattttcaaaacaagaatttgcagaattttgttactgatcagatagagaggtgaggggcagagaaagctattgaaaataatttcaattagtttggttgactgagaaatgagcaaacaggacaataaatgaaattacaggaagatgcactaattttaagggaaaacattaagttctgttttggacatgttcattaaaacagagttcatttctatttaagatgatattacatccttttttaccccaccacaacttgttttaatgttttatatgcagtatttaatgttctcctaaatagtaccatacccacagtcaaggagcattatttaatttatctgattccactatctctttaccaacctaacacttctttaaaattactcatggccgggtgcggtggctcacgcctgtaatcccagcactttgggaggctgaggcgggcagatcacgaggttaggagatcgagaccatcctggctaacacagtgaaaccccgtctctactaaaaatacaaaaaattagccgggcgtggtggcaggcacctgcagtcccagctactcaggaggctgaggcaggagaatggcctgaacccgggaggcagagcttgcagtaagccaagatcacgccatagcactccagcctgggcgacagagcgagactccatctcaaaaaaaaaaaaaaaaattactcacaaagaaatcataaaaccatgtttttttctttcaaaagaattccaaaggaaaaaaaatgccctgaagaatagcaagcatggcctttatctttgcagcttaggatgctgcattttcaggtttcctcatggactttgtgatttccatttcaacacatcccagttagcagccaggtataacaaaccgctacaatcatccgctctttattgtgctgatccaagctcatggccacagaggggttaagtggaaaatgaaatccaaactgtgttatccaagcacaagattcagtggacttcagctctgaaagacccactgggtgaggaggccgtaagcaaccctgcagaaggagagccttggaaagggcccaagtgtggtaagatacacacctccacatagatgtcttacaaggcctcactccatgtgctcttctgtgtgtctaagaaaaacctggtaagagagctgacttaggggaatgtctctatatgaacacttacatgacattatctttccattaattaatatactgaaaatataagtgtctgctatgtgccaggcactagctgagcacgaaatacacaaagttggataaaacattttaaaattattcttaattacctatggatgggaatgctactgtacttgaataataatgaaataactagcatgcatgtacactttccacattctaggcactgttctgaccactttatctcatctcatctcatttaatcctcacaaccaggtgagatcagtacaattattatccccattttatacaataggaaacaagcttagagaaatgaaacaatctgcacaaggtcacctatctagtaagtggcaagccagagtttccaagctgtgtctgtctgacttaaggcttcagctgcaaactcctactctgtgtaacctaacaggtgcttcactcacacagccatctctacactgtatccattgaccttcagccatatggaaacggagaagatagcacttattgcttgtttagagaaggtggcttgcttttatctttttctaattcactccttaaaataatccctttcttgcatttatccctcttttttgcagaaagcatatctttccacctattttatcgtatttgacctcattaaatccctataaggagagaggaataaattttattacccctcctgagtcaaggcactgtaatacatctcctcttagtcaatctgtttaactcaggcaacctcaggaatgtaaaggaaaatcagaagcttgtgtttggacatgattctgctcctctgagaaaccctttcacctcaacagtctacagatttccatggaagaccttgagacggtcattcaggaattgtagcctgctgtttcctgtgcattcaggaagacatgaaagcaattacaaattgcttaacagatgatgcataatattagagatgaagaatctggctgtgaacacttgcaccagggaaattctgctgtgtgatttctcttccagatcagcaccttgtgctaacagtatcgtactggcatgatgctgagtactcctaaataatgatccagtataagaagaaaattaaaatttcagaaactttcactacatagaagaaagagcatggatgtctgtgcttaacagacctgttttctgagttctaataacattaggaaaattacctcacagggctgactctcaatttgttcattcacaaaatggagataataactatatttcagggctgtgaagatatgaaataacttacgtgaaatacctagcatatagaagctgttccataagtgatagcctgttgttgacattgactaacatttattgagcacttagtatatgccaggtgctgttgtatgcacttcatatgtattaatccgttaaatccacagaacggtcctttcacttaggtactattatcatttggattttcctgatgaggacatgaaggtccataaggtttaagaatattaccagatcacatagctagtaagtggtaagccagaatttttgaacccaggagactaactgtagtcttaattatggcactcactgtctctaaaatcatcttgggaacctaacatctttcaggcatacagacttaacttccagtccattttcgtttcctgcagttccttattcataaacctaggaaatatttcttagtgaccccaggaaaaattgccccagcttaactctgtaacctgttcaattttaccctcacatgcaattgagaagtgttcttaatttataacagcaacagcttctttcagaaagctttcccacctaactgtaccaatctcacctataagcgacatcattggctcatttctctaccttgaatttcactctggataaatttagaagtcaccttttgtaattttacacattttctttaaatttttcccacaacataaacctacaagattcttcttttttcttaacagcttgcaaaagtggtcatatatatctatgattcatctccttcagccaaatggtctgaaatattcaaggacttcaactgcctaaaggcttttttcagataacacaattgtgcatatactcttttcagctttaaattcaaaatactgtccattagatttttcatattctcctagttgaaagactttttaggacatctaaaatttgtgtgaatttttaaatttatgtcttttgagttattttcttcttttattttgccaagaattaatatgcattttaaagcaatagaaataatttgtccctttgcagcattttttatccctttgcagaatttattagacaatagttactacctttatgaagcagatttcctggacatctacaaacttctttaaattacagtgttagtagtaaacatgcttttatgagattccacatgtggaaaaaaataactttttaagaatgtttagtttgatctctgcccaataggatatcatataataaaattataggtaaaagccacaaaaaaaaataaagtcataaaaaatgataaaagttatctggtgaaattgattagcaatgtatggatcatttttctcatttacatttttctagaaacttattaatttttcttcatcaaaatgtgatgctcaaaagttgaaagccagaatgccatcacaaataaggaggaaaattgtcgtagtttagaatgcctaaagttacaattgcataacatatgctgttaaaaaaatatatcctctattagtcatttctcacaaaaatctgtgatgaactttacataaccaaaaaatccctggtatctcagcagggtcactccagctgtcagtgtgaatacatgcaaaatgaaacaaacaagatatacctattttctttctttgtctgaaaaggatggctttcattcaaattcacatcatacatttgcagataaactatatttttgcattgtgtgatttagtgacatcacattttcatgcaaaggaccattgaattccctaatgatgttctgattttcttaacaatgaacaccagtgaactttcccctaggcaaaccagatggaaactaaatcgtttctgcagaatgaacgatttgtgaaatcttggcaaattgaattccaaatatacttagagatgatcttgactttctctgtaactctaccacaacatgcaatgcatttaaggcctacatgggaaatacactaattagttgcataacctttatgcagaaatgaatgagaacagaagatcaccatcaaaggaataaaagtcagtaactccgaaaaagaagtaatatgcagatgggacatcttcactaagaaagtatgagtttaatgtagatattgtgggaggtattcccttgtcatctttgaattggttctttttaacctgctttgtgaaggaggtaactcattaagcacgtttctttacattgtttcaaatacgtcatttagctagttatatgaaaatctgaattcaaattcttaatctatgtgtctacattttctacttcacacactctcttacctataccccaaaatggaattaaatggactgtgcatgaaaaagattttgtttctattacccacaatctaattatattattttcacagtgacattatgaaactatccagtagatgcaacatgtttgtcacacaaaagataaattgtgctttcttctttatttcaagtaaagaatccttacaattctcatagcattccatctacagagggttataatttccccagatgtgactaaaatggccatagttatcattaggttttatatcttgtctgagtccatttaggctactataacaagataccataaactgggtggctcataaacaacaaaaatttatttctcacagttctggaagctgagaagtctgagatgaaggtgccagcaaatttagtgtctgatgaagtccgcttactggctcatggtcttttcaccatgtcctcacatgtcagacggggcaaaggaattctctctggcctcttttacaaggactctcatcccattcaggaagactcagccctcatcacctaatcacctcccattggcctcacctcctaataccatcaccttgggagttaggatttcaatgtatgaattctgcggaggagacacaaacattcacagcacagtgtacctattcagaaattcagatattccacctcagctactatgtcatcaagtaatcagggcttttttgcatttttacaaggttcactcatatctaaatctaaatctaaagagggtttttttgcatctttacaagattcagccactcaatgtctttaaaaaataatgaggcaaagtcaggaaaacgctttttagaaagggttattctactggcattaaactagcaagaaaaaaaatattggcatctttcatttatagaacaggtttaatttctcaacacttttatgttttgacttgtttattcctaccagctctttgttataaaagatagttacattattatttataaatctaacaacaaacaacaaaccagccaaattcccaatgttgtttatgtatcatttttcaaacctattcatttttctcaaattgtgattgttttctctttgtcttgtttacattttttcctgccaagttaattctccaataaactttatacatggtccgtgacattgctccccttctggaaacattgatacccaaaatcctactttatatttttacctttgcttttaatgagaaacccaaatgtatcttaactcttcaaaaaaaagttactgagtatacgctatgtgctaggcagctttttctttttaatatcactattgcctgtagcttagtttttcatttttacctcatggtcttgaccaactaactccaaacttttcttactgaggtacaaactaagaatgactattttctctgtcctatgcctttcccacagttaaaaaaaaaaatctctcttgtctgtaactctatattcatatggtgcacactgttaggcaaaccgattaaaacccaggacatatttaatgaaagagggagaaaggtgagcagatatttacggcacaatattgcaagtgctatactgagggtttgggaaggtgttacagaaatgcaaagaaagaagaagggccaaacttgaacgagaatggtcagggaaaggctcggcgaggatatgacagtgagaaataagtaggagaccagtaggaaaacaagggaagggaagttgtaccaggcagatgaagcagcacgttcaaaggcttggaggcacaagaacatggtgcaatcgagaacatgcacgcatccgctctccttgttctatttcctgcaaccctatatgaatttgctttcacgtagtaagatttctgttgtgtaagcttaatctcctttgatatttctttgataatactttcatcatttttcttcttatgtccatagacttcatcctctactctggcatcatcttcataggttgccctttgtattcttaaaaatcttttcaagtgggatcaccttttccaaaagcctgtcaagaggtcaggttatgtttaaccaggaccctcccatgtctactgtgttaatccttcttgcttgtaaatattaggagagccaggaacattcacaaagctggtcttttttatttctcacgacacattgacacatctaactcactttttccttctcccacaattcattcccccactccaggtgacattcttcccctactgatgagtatcaaaacatcccaagcctatcccttcaggtgtgttgacctccctctttacattatagtaaagtgcttgtgcttaatagtaaattccattctgcttccaacacggcaagcagtgctttcctacacttgtacgattttatttagtcccccaagaccctttcaactagatctttctttctggaatctaatgtctcctcttgtcagatagtcctttttcctggaacttgggttttatccacagaaagcctgttatgtttgtctgtttttccagcctttcctcgtatttcttctgtgtgttcttatgcctttcctttccttgtatgcctttgcttgtgttctctgatgctttttttttttttttactcgcaatcttttctttaatcttctgtggacttcaaacacaggtccgtgtttgaaaaggcagtggtttccctttcctctgcaagaaccatcttctccaggcacctttatcttggctcttgctcttccgactagcttatttaaattcctgctgtacctttcaatccattttgagagaagtataaataatatgtaacattgataacattttcctccattcaatcaacaatagtttaccaacacacacacatacccaaaatacccaatgacaacctctttttagggtccatccattcaaaaacacataccctgtgctaaacctctcatgctaccttttccttatctgagacttttctccaagcactttcttctcatgtgatttgtcaacacacatataaaggacatctctggctgttccagcaacagccagaacttgtttctgttctggattaaaagcagctggaaagtagaatgcccatgttcaccttgacagctttctgttccatacttatgtttccctatcctaatgccaaatttctctgctgctgttaatgaaactttactacatcataatgggatttttcaatgaaattgccatatgacctatctcctgtgttacagtcttgaagagaactaacagcctttggctttaacttgcttggggaaatcaccagtgcctactgctttttctcctgatacagcctacaaaatatatccattttctctatcatctgaggttcacatcaaactctttatttctgtggatttgaattactgcaaatatgtctcctgggttcttcccaattgaactgataattagggtcctgccacatagtccctctccaggcaacagctctcatccattatgaagtaagtccacaaaaaaagtctttcaaaatccttccactgctttccccacgattcctgagttgattttccttatcttctctcttctttctgtcctcttcctaatggaagataaaatagacaaattggcactttttcccctttattctcttcctcaagcttcttttttctcctctatatctttctctatttttcctacggctttgcctctctaactgcaattctttgcctttttttgtgtcttctctccttttttaagtgtcccatttgcatttgctgttgacagaggccatggcaagctagagccaaaagtagagaagctggctttggccccctctgacctccctaacactgcactcattcattcattcattgagacaggatctcagtcttttacccaggctggagtgcagtggcaatcatagttcactgcagcctccttataacttctgggctcaagcaatccttccacctcggcctctggaatagctgggatgaccggtgcacaccaccatgctgggccaattatttattttttatttcatgttatgtatttatttatttttattattttttattttggggggtggagacagggtcttgttttgttgcacaggctggtctcaaactcctgatttcaagagatcttctgccttagcctccaaaaattttgggagtacagcatgagccactgtgcccagcccctaacactcctttaaatagctcttctctcctcaccatcttctgtgtgacttgccttagtctatcccatgtctttcatgtcctcctttttggttcccctccccccagtgttgggaccccttggctcacagatagattgtgtgccatcctcactgataggtaaatagacatttacagtcaatattgcagtagacaaagaagatattatttatccattttaatggtgggaggagaacatgctcagagtgcacctaggagctgattagtggcagaactcaggtctgctgggcattccccacagctcctcttttatgacagctccctgacaagaaggaaaactttccttgggtaatgacatctccaaattgcgtggccattcctattccctccagagatttcttcttggatactattgtcccagaactaaaaagagaaaaatactctttggatagaacaacatcctagcttctgagctttctgcatcaagaccccattttccccatgatgtcctctcaagttaattaggatgcactagcagaagtagctacagagtgacagaacttcaggatacaaagtccttgcagtcattgagtatcattagtaaaaaggtaatgctgctctgtcaggaagcctgtgtataaatcattcagatacatatctctgccactaaagattatgcttctcagagttaaaagtactaaacaatgccttccaaggtttatctgccactgtttttcatgaacgctccaggatcaagagcacactttctggcatattgctttaaaatgcctcctttctaactgtgcaggtcaaatctgcattgttatttagaaatacatgttgcccatatttcaaaattacttggtatccacacttacatttacattttaacagaagataatactggttcccataatccaaatcactatgaggcagctttatcccagagcctcaaagtcaggtgaggacaggaaagtagaatgtttaaaattggatttgacccagaaaaccgaggacatgtggttgacagagggagaatgttaaagtgacaaagcaacttggtaaaaggtttgtctttggacgccatccccaaactgttctccattagtttctttccacttcgcatgtccttaggcaattggccatttgcctggattcctacttagccctctaccgagagcagcacccaagctatggggctcacctaccatcttccccatttttcaccatttccattgacttagagaaatcatccatattccaagaaaatgtcaactaatttttttttcttttttctttttcctttttttttttcttttttgagacaggatctcactctgtcacccaggctggagggcagtggtacaaatcatagctcactgcagcttcaaactcctgggcttaggcaatcccccgacctcctacctcagcctcccaagtcactgggactacaggcatacaccaccactaattttctttaatttttatttttagtcgctttgttgcccaggctggtcttgaactcctgagctcaagtgatcctcccaccctgacctcccaacaaactgggattacaactgtgagccaccacacctgaccaactaaaatttctcttttttttttcttcaatccctccctgcctccctccctccctcccttccttacttcctttcttccttccttcttccctccctccctccctttttttttattatactttaagttctagggtacatgtgcacaatgtgcaggtttgttacatatgtatacatgtgctgtgttggtttgccgcacccattaactcgtcatttacattaggtatttctcctaatactatccctcccccatcccccgaccccacaacaggcccgtgtgtgatgttccccaccctgtgtccaagtgttctcattgttcaattcccacctatgagtgagaacatgcagtgtttgtttttctgtccttgtgatagtttgctcagaataatggtttccagcttcatccatgtcactacaaacaacatgaattcatccttttttatggctgcgtagtattccatggtgtatatgtgccgcattttcttaatccagtctatcattgatggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccttgaaggaattgccacactgtcttccacaatggttgaactaatttacactcccaccaacagtgtaaaagtgttcctatttctccacatcctctccagcacctgttgtttcctgactttttaatgatcgccattctaactgttgtgagatagtatctcattgtggttttgatttgcatttctctgatgaccagtgatgatgagcattttttcatgtgtctgttggctgcataaatgtcttcttttgaaaagtatctgttcatatcctttgcccacgttttgatggggtcgtttgatttttcttgtaaatttgtttaagttctttgtagattctggaaattagccctttgtcagatgggtagattgcaaaaattttctgccattctgaaggttacctgttcactctgatggtagtttcttttgctgtgcagaagccctttagtttaattagatcccatttgtctattttgacttttgttgtcattgcttttggtgttttagtcatgaagtccttgcccatgcctacgtcctgaatggtattgcctaggttttcttctagggattttatggttttaggtctaacatttaagtctttaatgcatcttgaattaatttttgtataaggtgtaaggaagggatccagtttcagctttctacataatggctagccagttttcccagcaccatttgttaaatagggaatcctttccccatttcttgtttttgtcagttttgtcaaagatcagatggttgtagatgtgtggtgttatttctgagggctctgttctgttccattggtctatatgtctgttttggtaccagtaccatgctgttttggttactgtagccttgtagtatagtttgaagtcaggtagtgtgatgcctccagctttgttctttttgcttaggatgtcttggcaatgcgggctcttttttggttccatatgaactttaaagtagttttttccaattctgtgaagaaagtcattggtagcttgatggggatggcactgaatctataaattaccttgggcagtatggccattttcatgatattcattcttcctgtccatgaacatggagtgttcttccatttgcttgtgtcctcttttatttccttgagcagtggtttgtagttctccttgaagaggtccttcacatcccttgtaagttggattcctaggtatttttttctctttgtggtaattgtgaatgggagctcactcatgatttggctctctgtttgtctgttattggtgtataagaatgcttgtgattttgcatattgattttgtatcctgagactgctgaagttgcttatcagcttaaggagattttgggctgagacaatggggttttctaaatatacaatcatgtcatctgcaaacagggacaatttgacttcctgttttcctaattgaataccctttatttctttcccttgcctgattgccctctggccaactacaatttcataccatgatggatgccatgttgcccattagggggtgaaacagtgtttcatattgttttaaaggacccatagagatctaaagctttagctaaaggtaataaatggtagaatttcaagtacctcagcacactatagcataaagaatcttttgacaaggacacttttggaattcacttttccctactctccactaaaaagtcacagtagtaattatttacaaattcctctactttctctatagtggtccttcctaatacatgtttctataatgacacctacaattttatgttgaatttttgtttatatgcctgttcatgccagcattgaaaaagcttcttagggcaaagacatgttttaatcatcctttgtttctagttctttgtagcatgactggcatattgaaaacccaacataagggtttgacatataagactaagctttactcattttctacaaaccacagatttttaagtggatcactaattatacttctgaaaacactgtttagaagtcatttatttattattagtattaattatttcaggctaggctacaataacaaataggcccaaacacgtaatgggttctgcaaaagagaagtcttggcaggtagggctctgctttattaaatcttcaaggatcctgtctcactgaacctctgccatcttcagcatttcagcatgtagcttccaaggtcactctgaggtcactatcacagacatagaaaagaaaaaaaatcatgggtaggagttctgggggactgggtctaggagtggtgcacatcacttctgttcacattccattagctagaacccaatcacaagaccacatctaactacaagaaaggctgggaaatgtagtctagctgtgttctcaggaagaagagcgtggacttttggtaaactacagagactctggcagtctctgccagagtggaatacttaataaatacattcattcttttttttttttttttttttttttttgagacagagtctcgctctgttgcctaggctggagtgcagtggcatgatctcagctcactgcaagctccaactcccaggttcacaccattctcctgcctcagcctcccaagtagctgggactataggcacccgccaccatgcccagctaattttttgtatttttagtagagacggagtttcaccgtgttagccaggatggtcttgatctcctgacctcgtgatccacccgcctcgtcattcagaaagatgtgaaagatgagtgaaagttaactaagtaaacgggagggtggcaagagggcagaatgtcaagcaaaaggaactgtttatgtgaagcctctgaaagtgtaggtggcgtggcacagttaatgatataaagaaggctttccccttgtggctgttgcgcagagggagaaagaggcatttgatgaggcagaggaataagtaggaaatagaacttgaagattattctaaatgatcataagaatttgggccttttaactcaagagagataggagacctacttaaggattttaagatttggttttttgatgttttgttttttagagacagggtcttgctctgttgcccaggctggagtgcagtgccacaatcatagctcactgaagactcaaactctcgggctcaactgatcttcctgcctcagcctcctgagtcactggaaccacaggcatgcaccaccatgcccggctatttttttgttttttgtagagatagagtctggcttcattgcccagactggtctcaaaatcctggtttcaagctattcgccctccttggcctcccaaagtgcggggattataggagtgagatacgatgcctgttatttaaaaggtgactctgtcaattgtattctaagagtaaatttcaggaaaccaattaagagggtattggagtaatctatatgagagattatttgatcacatggtgaagactataaggatggaaacaagtgaacttattgagagattttatgataaataaaatcagaactcaaaagaagtcaatgatcaacgatcagtgataatgcccagttttctggcttaagcaaccccttggatgctaatatcatttgttgaaatcgagtgaaccagatttagaagaaagatcataaattcagtttttggcattcgagtctaaaacgagtgtgagatattcaatgactagtggacagttagatataaaagtctggggcttagagaaaatatctaaactagagatacaaactggagaatcacttccatattataactaaaaccatatactgggataagattagtttatgaagaaaagaagttagttataactacaccctgcaaagggagaccaagagtgagtggccagggaggcagagaaactaaaatcaggaaatcattgtattatagaatccaaggaaagaaagggagtcaataaattctgctgaaagttcatggaaatgagacctgcaaaatattaatggttcggtaatatggatgtcatttgaaatcttagtagcaactattttaataaaatgatggagagagaaatcaatggaacatgaaaaaatggggacagtgattgtaaccaatttcttcaagaaatttggctgtgcaaaggagcagagagacatggcacatgtagaaaagaggatagttgaaataggaattttgttatgataatagcgaacactcacacagtacattttgtgagccaggaactcttctaactccttttttacatactaactgatgtaattctactgactccatcactattcttccattttagagattagaaaagtgaggcacagaagagaaagtacattgcctgaggcttagtaggtaataagaagcagacttgggaattgaacctaagtagcctgactatagagtccatgttgttacaaagtcactgaggaatcttctaagcatattttaatgttgaaagaaagatctcaaatgttattttgtcttttgtcagtaataaaatatttggcacatactcccaatatttctgtctttctataaatcatatatatattgtgctataccaatatatgatgtgttttataaaacatataaatgaaacacaattttgaaaatatgggataaaagtaaatataaatagaaggtctaatattgtcttctcatactccaatggattatcttatgaaatctgcaatgaagataactaaagaagagagggaaaggatagagaaaaagaactgagtgcatttactggtttcgactacatgtgcaaatttccacaaactccgtggcttaaaacacccatttattagttcagtccagtaaaacagagagaaaaactagacaggtagctctaataaagtaaaatcatggaaatatatgatttcccagccagaagaaccttcaggactgtgttatccagacctgttttataaagacaaggaaggtggatcccgatggttaagcagttgaccacatttcacctccttcaaatccttcttatacagacattccctgaacttcctgtttcaaattgctatccttattccccacctactttacatgtttccacagcacatacctcaccaaacatgccttttattttactgttattttgttgactttgcgtgtcttactgaccactgtgcccaagtgcctagaacagtgcctggcacagaggaggtacccaataaatatcagttataccaaaaaatagtgaatgaatacacatggtggtccagtgctctttccaccactctatactgtactttactgtcactttttgtttgtttttgttattgagacagggtctcgctctgtctcccaggctaaactacagtggcacgatctctgcccactgcaacctccacctcttgggcccaagtaatcctcccacctcagcctcctgagtagctggggctataggcacgcatcacaccacacctggctatttttttgtatttttttgtagagacaggatttcaccaagttgcccaggctggtctcaaactcctgggctcaagcagtctgcccgcctctgccttccaaagtgctggtattacagccatgagccaccacacccggcctactgtcacttttaagaagcattttgattttctattttcatccttattttgatcacatcagaatatctgcttttctgtgaattattatttctaatgggaccacaagtgtatcagttaatcaaaatataaattatggacatcatgaggaaattttgaatttctaaatcataaagtggaaatccattttcaattaaattacatgaattttacacttacagaagagtaacttggtttaagctgttcaaggggtatagtactgtgtacatgcattcctgtgcctagaacactcatgccctcttgtggacagggttcatcctgacttcctgccgaaccttccttatctcagctcaggtaaccgctcctccaggacacctatatgtcccctgccctcctcctcctcccacagacaccagctctggttaaaaggggaaaactagaaggcttgtcttaaagctacatttgcatggccagcacattggttttacaaagaacatgcatttggggtggcttgcagaaatttataacgattattgagggaataaatctctaaagtccccctctccttagttactagaccctggaaggtttcaatcttcacctcctatagcatttgtgccacttctgtagtacagtcaatgcattatatttttactcatctaggtatccatagagcctagactagaacctagaagagtctgtggtggaactcagtaattattttttaataagaaatgaacgaatataaaccaatgagttacagagtatgcctaaagaataagcatccaaagatacactctctttcacctgaacaatttactatacatttgtagactaggccagattcagtctttctagcctgaacacattacacagcaacatttcacactgtgaccatctggtccattagatgtaaataccgatttggcagatacttcaggagtatgagagtaatgcaggaataaaatgaagttgaaaaatgctaccacccaaaagatatatttaaagccacatattatcttattaaaattaaaaacctaacattgtccttcatataagtgaagactgttttagtatttttactaatggggactatgcaaatggtctgaattttcatttgagagataattgggtctccatttgtatgtcacctctaaacaagactcccaacctcagagaaaaaccatctactcatcaaagaatctgttgccaatttaacacatagaaaaatcttcttacaattaacataaatagaatgtccttttaaaatgtcacagcattaattcaggtacttttgaaaaactcactcaagagtacagtgtttccatcaaatgtatgaacttagccccatttgcaaaggtcactaaaatgaacccatctttttccacataaaacgatgtatggggctacagagccattaaataaatattcattttaaatcaagctttttatttatccattggagatgacctctgttctaattatctataatgcttttcaaaaaggaaaggtatttttgtcgttgtctagtaaatcattaatttgtgtctattcaatggctgcatttttttaaaaataatgaaattatcaagctgctcagaacaaagctgccttctgattgtcagctgtatattctaaaagagcaggtaaatttctctgaatctcacagctggaacttttctaacactaactggcagtttccacctagtgatcaaggcaattgactaaaataaattacacataaagctgaaattcctaatagtaataaggccccttcatgagataatcacaccagcaaaagcactcatgtgttggctgcaaccctacagggtcttgaaattatcttataaaagctatacctccagaaatggttttgtttctagtttcatgacagggctaatatgacagtgtccatagcactaggtacaaaggaggagctccaaacaaaattcgttacttgactggattaaaatggagacactgttgttaaagcactaacatcagtgctatttacaaagcagatgactggtgaggacctcatttcaatacagtcaactgacaattatttcgaagcttttattatgtgcctggagctaggcatagaaaagtagtatatagtccctgctcttctggagtttaaggtgagttgagctcacgtgtaagaaataaatagggaaaaagtaatctcgaggcaccattctaccagctataaagcaattgctagcagaaatccaagtgggctagaatagtaaggaggtttttttgtttgtttgtgtgtttgttttttctttttttttttttttttgaacatggactagggcttaatggttaggagtaatttgattaggcagaagggaataaaggattgcagatggattttccaactaagcaaaagtctggtaactggaaggaatatagctcacagagaaatagtgattgctgtagcaaacttcccaatctttgtaccatcttcatgaccaatgcatttattaactgggctgtcaggagtgttgatggcttatagctcataactgagttcccccttcctggcatcaccctcagctgaaaagatgctcacccaagatgtaggagcagcccacatccaatgtttgggggattcaggatgataaaatctcatccttgttgccccatttccaaatatctttgaagaactctcccagctccagagttccccatagaattgactgaggtcttgatgtaactgtatcacagcccaacttctcaacctgtgtaatcctgattccctcactcccaaagaggggttgatctaaaggacacacccctataaacctcatgttgaaaatctgcctgagtctgcttcctcagagaactcaacatatgacaaatgaagatgctgaaaagaccaacctgacttattcagttgtaagaaagctgcatgttctcattcagtaggcatagacactattccaatgctgggaacacagcagtaagaaaaacaagtcttttctcttatggatctgatattctggtgaggaaaacctaaatagacataatagaatgtcaagtaatgacgggtgctaagacaaaaaagaagcagggcaagaggagaggtaatgtttgtgtttaggactgcattggactacattagatagagtggccacagaaaaagtccctaaagaggtaacatgcaagcagaaagctgaataaactaatgaaacaattcataccagtatctaggagaatattgctgacagaaggaacagcaatgcaaagatcctcagatagaagtgtgtttggcatgttttggaaagaggaagtgaaatctggagaacagtggtaggatacgaagggggcagatcatatcaggccttttagtgtaaggaacagatgttattctaagtaaaaagggaagatctcaaagggctttgagtaggattgtcccatgatcagatttccattttaaaaggatcatgctgccttttatgtgagaaggaaactagaaaggagcaagaagagatgcagagaggctattatgaggctattacagaggtctaggtcagaagtgacaatgacatggacttaaggttgccactggtcatggcttgcctgggactgaggggtttcccaggatgcaggacttttagatcttaaaccaggaggatcttaaacaaatcaggatgtttggtcaccctacttggactagagtaataaccctatgaatgaaggcatgtggtcaggttcaaaatatattctaagggttgaagaagcagtgaaacaagagcaaatggtttagacatttaggacagaggcaaaatgtaaaacttcttgaaagtcaggaagaggggttcagacctttcaaacattcacttggcattagtatgtagtatgcattgaattttgaagagactataactaaagaggtctttaatcagactacttcagaaaatatgacagaaatgtcactagggcttaaccacaatggaactgatggtaaaaatggaggtggaggtgattgaaatggtggtgttggtagtagcagaggtcatagtgtaggatggtgaaggtggtagtgatagtgacaagtatcatatagagatggtgctcatattgacatggatgtggaagtggaaggaaagaaagaaagacagatgaaaaaagacaaagaaagaaagaaaggaagaaaggaaaaaagaaagaaaggaaagaaaaagaaagaaaaaaagaaaagaaagaaaaagaaagaggaagaaagaaagagagaaggaaagaaagaaagaaagaaagaaagaaagaaagaaaaagaaagaaagaaagaaagaaaggagggagggagggagggagggaaggaagggaggaaggaaggacggacaaacaggaggaagggaggaaggtaggaaggaagaggaaggaaggaagaaaaggggaaggaaggaaagaagggacggagggaaggaaggaaggggaaggaaggaacgatggaaggaaggatctaacttgagagacatttacaaaatgagaaatatcaggacttgtgggttaaatgaataaaggaaaacaaagagaaaggaaatggagatgagttagtgaccctgacagaaagatgttggaaagaatagttgaggggagggattggtattgaacattaatttagttacagatataaagtaagagtggaataaccaagtggatggccagctgggatattagtttctatcattccagacagcagtgtactagtaaagaaaactcatgattttgagttaaaagagtttgccccagttcctctctgagacagctatgtaacctacaccctctcagtctcaaagtctttatatataaaatggacataacagtacctcgttcacagggctattctagaaaaaagtagacaaaattgtcaaggagcagcaaggatatgacttgggtatcttcttttttctttgcaaattttccaagaacccttttagtccccatcaccataatcccaccaaagaaaaacattctttttaatttagaaaatcttggtttctagaactttagagtgataaataaaatatttatattaaatgtttataaattactatgcagccatctttcttccaaactggcatgccaaaactatgaaattagagtttgatgtaaaactgttcatataaaactattgggttcttctaattcttctatgttgatggacaagagatatagtaaaagcttcacatgctagaacaagactctagggacagaagtgcttttcttctcatcacagaagttcagtgaaagacttcactgaggaaatgaaaatattggtttccaaaaattcgtactggcatgagtctttaaatctgattcagggtaacaacactggcttactatataagccacaaacacaagccttgttttgactggggcagaatagaacacaccttgtggggatgacacagaagtccagatcgtcctgccgtgagggtccttcttgcgggcagtatcagggcctccccaggatgcatattcttttttttttttttttttttttttgagacggagtctcgctctgtcgcccaggctggagtgcagtggcgcgatctcggctcactgcaagctccgcctcccgggttcacaccattctcctgcctcagcctccagagtagctgggactacaggcgcccgccaccatgcccggctaattttttctatttttagtagagacggggttttaccgtgttagccaggatggtctcgatgtcctgacctcgtgatccgcccgcctcggactcccaaagagctgggattacaggcgtgagccaccgcgcccggccctcaggatgcatattcttgctcttgtttcacataaacttcaagtccctcatcctccccaacatgtgagaaacacatgacaatcatatttgcaaatatcctagatcaattaatcttggatcaaaccaccaggtagtaaaagaaagctgccctaattttcaaacttttggtagacaattattaaagctaattcttagggcattagggaaagcatatacttaaacctccaaaaatttcactaacaagaaaatggttagtataaattggatattttccttgcctttttctggaaatgagtttttctctatcttgttgatgcccataaaggacacaaatttcaggaaaatcaaggactagctttcaaatatcttggagatccagaagtaataaaatgctaaaactttttgaaaagtaacttcagttaattaatataaactacacattcaatttggcatatcaattacaataattttatgagcaaatgaaattttacatgttaaagttcttaaactaatgaagcaaatgtagatctgtaaagggtgctttaaaaaagcacttttccatatttttctttctcccaaaatgcccatatttttctcttaaacactcattcttctcccatcccataactttaaaattacaagtaacatcacagatttctcctgcttccgagcatgctttttcaaactgtacaaatactctcttctgaagataaatattatgtaaaatcttttaaacttcctatgtgtcataagattgaggaataaaaggtattggaagaagacatttgtgacatttctttgttcaacacaattgcaatgcccctaaattaatcgtggaattagattatggcccataaagggagatgttatttaagagagagcagtcatgtctgaaattcctaattagaacagttagagtaacctgatcctgcaacacaatcagttccccaaggaggctattgtggaaaatagacagaattctgcgaaaaaaaaaaaaagagccctcctcctaacgagcattttgaacagcaattttgttcatttacatttctcttgtcccataaagttcagataaatttgtccatattttatattaatttccatgatattgtctcccattcattattttcagatactctgaagagtaatttattccactagcctctcctgttgtataaattaattcctaggagtgagtaggcacatcaggtgaattcagcacattagaagtaactctttattatttatattagtgaaagggggttatgacctagataattcaaaacaggtattttctaaagtttccacttatttaagttttgaaactgtgtggaaagtgataatttaatgatggatcctgtcttcaaggagtttacaatcatgtgggagaattaagacatatacacactgagacaaaaacagagttcttggtaacatagagatgtatggtaaaatgctatggggactcaagaaatgaaacacttggagccataaacatatttggtgatgtttccagcacagacattactttagcagaaagaggcactatttctccctcacacattgaatgtattacctctcaattatagaaaaattacaatctttctcttttgaaaaatggatataatgaatacaccccccccccaaaaaaaaaacgggggggaattacattttcttacctgttaaattacatctaggcacctatttccacactggagactctggctgacttaacatatatgtcaagttatagataaagacacatatagtcataataagggtattacttgaaagtgccttagtatatggctttctgtagctcattcctatgttaaaagtctatctgcagaagtctgacataactgttgccttctgtagaatcagaattcacattttattgtgggaaacactaaaataagtcttgatttgccatatagctaattctgcatgtcagaaagcactctagagcctccagtatctgaggggcatacaacaaactctctctcttgcactctctctatctctatctcatgcttataaatatgaatgcaaattctacttatgttgaacaataatttggttcttaattaatcaccctagaaaataaaacacttaaggcaggagaatcagtaggagtcttttccgaaaaaaaaagtaaaattctctataccatcatcattgtaaacacttgatcagttgttcaaaaatgcctgagtacaggactgttgaatgttctttgggcctaaagtatggttatcagtgaaataacatgagaagttatgagatgcatttgcattgtgttactatgggtttcaattttctagcctgctgctcagatttttagaattaggaataaaagttagacctcacttaagatgagtaatactaaaagtgcgaaaccttatactttgttacatttcagctatcaggaattcagaatttctcatcaataaatagaatttaatgacacacaaatgcaagtccttttcccaaaaacctagagtattagaggtaatcctatttgaaatgtaaaaggacaaaaatttaggtcgattgattcaactaaagtgttaggcttatttcaaagctgtttaataaaaacatgaaaattttgccaagagttttgcagtgctattcagagcacaaagtctctttaaaaagtcatgttgttctcatttcctgcaccattgaattatagatatattttgatgaacattaaagtatagatgatctttgttaaaaactgaaatagatggtcttaaaaaaaaaaagctgttatcactcttgataccttagtcaatgaaaggccactgtgtaaatgccaatggacctacaattttcaaattctaatcaacataatcctcctcttgaagaatttacaatatatatgttaaaactctatttacttgtatttgaaaaattgctaatactttcttattggttttcttagcaagagaaattgggtgatatctgcttctcccttcgctacgtacctactgctggtaagctgactgttgtcattctggaggcaaagaacctgaagaagatggatgtgggtggcttatccggtaagcctgcagtgtttattgatttttttcaaatgctgtttcgtcgtggataccaaatgcatggcgcacatgctgcgactccccacttcttaattgatcacagttctctttcctatggagcctggaagcagtctcagaattcatcccaacacagtgccccaggaagccactctcaattcataggaattagcatagaagatgaaatctattttccttctttggagccaaagtatcaattgtctttttaatggcattgaaagctgaaaatgtttgcttcttttctgaaagagagtgttcatgacagattataattttgttgagcttagagggggtttttggtcaaaattcacccacgatataaaaaacaatgttttccatgagacttatttattaggtatttgatagcctaacatagttcctacgataccatttattaaagacacagcatttcaatatatatgcataatgaaatctctgtttcagagtgaacccctatggtaatgcatttaattccacagctgacattgaggatgggagagatgtggggattgaaatttccatacaacccaaccttagtaaaacgtggtggataaagtataccctggctcaaaagcaaagtcaactcaaggacttgtcacttccacggttgaacataatttttcttcttctgcatatgattaaatcaattatatttttaattttccgctaaatcattaaagtgtgaggaattttcttgatatgccacaaggtcatcataaattgactgcagttgtcattgtttgtggctgtggaattacaactaacattactggttattcaacactttctttaataaaaatattgcaaacttcaaaaggtcatcctaaggcagcatggtgattttttattctaaagcataacagctaaaaagtgctacagctgagcttcccctcacttacccactaatttgtcgaccaaattctcctggtacctgagtgtatttctctttataaataagtcacctggggaagctgtactaattctttcatgtcattaagaccctatttaataacttgctgtttttattgtgcctagcagtgtaacacagcaaatttgaagcaaagagcacagtgttctctagaagtatagagtatttaatgtgactataagtgaaaaacatgcagagaaatttttaactacaataacagttccctcctagattattacttagtttcctaaggtaacttcagacacctttaacatttccctgtcctttggttcaacagccaactatcatgacatgatttctttgtatcctgtctcttatgctttgtcccaaatatccatgccaaccatcccctcataacctatgtctagtactctgctagtcttcctaagtcatcctatctgcttcagcagataggatttgtcctggcttcttccggggtcccagaaatgagttcccatcatcatagagagatatttcaaccacgagttgttcatcccagtttgctgtctgtttccactaggacttctccaccgtctgtccccttctcgttcagtggcatcagagaggctggctgcaggcattttggaacttggctaagggaagttaggtctagcaggttatttttatggggcttacagtcatataatgtatagtgaggttattgctagctatcccaaagaaggaagggtacctgcaatgcactaactaactcagcattgtgaaatgaataaggaaaggccaaaggtcatacctaattttgtattcataattttatattctttgtttctgaagagaaccagcaaaaccatattagcttcaggatcctcacaacctgggttcacccctacatttgaattacctggaaggagtttaattattaagtaagaatatttaaagagtaaatatcctgaaaagccctaattttaagggcttctcactgcctgtagaattaagccataatcactctaatcacttgagtctacataatgtagatatgtccagcctatgtcatgccatatctcattttcaccaaattgaccaacacactcttttgcaaacaaactatacaactttctgcctctattacttgcttaggtcgtttccttcacctggaattctcttccttccaacaatgtctagccaattcctacccattctttaggcccagcttaagtattatctcctccattcattcaataaacatatattgtgtccctactttaagtcaacattgttctgagcactaggtttacatttgtggataaaacagtgcaaaagaccctcccctcctgcagcttgcattctaatgtagggaaacagaaaagaagccaacagatagcaaaagcatgagtctaccaagagataacaggtgctatggagcagtaaagcaggaagtaggataaggaatattggggattcatcttaaatggggttcaaagaagacctctgagtaggtggcatttccgcaacaacctggaagaagtgatgaattgagccacggcgcgtctgggagagagaacaaccacggggcttctgggagagagaacagccatggggtgtctgggagagacaacagatacctcgtggctcacttcttcacttcttccaggttgttgctgaaatgccacctactcatgaggtcttaagacctcatggttttaagatccatcccagtagaacaaatctttgcctttttttaaatgccattagccatttgtttacacccctcaaacatcatgcttctctctcactagactgtgttctgtatttatccctcccacaatgctctcagtgatgggtagcactaagcatagctgctgaatgaataatgaattatttacaaaggagctatggcctgaaaaaacaagtcttgcatttcaaatgtgtctaacccacttaccattaaaataactttaagcacttggatggtctgtctcaaagtaagttgacctatgtacgaggagaccaaaattatataataagatcattccaggtaattcaaatgccaaagtacatttgctggaaatgactagttaattggaaccaaagtgggttgttttgccagagtttaaactccatctgccactaactagcaatttgacattgcacaagttatttatttaactcttctaagcctcagctgcattatctataaagtgggaataatgagaggactttgttgatgatgctatgagaaataaatgaaagcacagggcctggcacaactaagtactcactaaatactattgtagtcatttctattagtaattttatcaaatcttgggataaatatgcaacatgggaaagcaaccaatggatgatttaaccaattacttgcttcaatggggaaaaaaagtttatcttattgtttgatggaattagctgattaattcaggcaaacgtatcagtaggcccacattttgcatagacactatagtgaattaagataattaacaaaacatttgagaaaataaaacatgaaaacatatgtaaaataattttcttattgctctccaacaaggttatttccttcctgcagtattcattcaaaatgcattgcacaaagatttggcctctattgtatatccacatgcaaaaaatgcaaatctcagcccttcatactttacagtgacaagcctaattggactatgcacatctctacagtagatccttgcatttgcattcttaatatcccaactttcaaatgcttgtgagcaacagtgaggatttctgaatttaactgcagtcatgtgttgattaacaacaggcatacattttgagaaatgtatcattaggttatttgatcattgcacaaatatcataaacacaaacctagatggtgcagcctgctacacacctaagctatgtggtatggcttattgctcctaggctaccaatctatacaacatgttaccatactgaatactgtaggtaattgtatttgtgtatctaaacatagagaaggtacaacaaaaatacagtattataatcttatgggaccaccattctataggcagtccatccttgactgaaatgtggttacacagggcatgactgtatttgtattgagatcttgaatcttgcaggctgcaagactgttcttcaggagcaagttggtgctgtagaacatgtgtaggactttttgccttatacgtggagacaatcaagacttctgcctcttaaacatgtctcaatagcttcgttgccttttacacatctctgtgtggagtaaatcttccttcaaataagaaatgttttctatttgggaaaattggggaagagaataaagaggtcaaagtaaaggcattggaaacattgaggcttcccaaaggtatgaggctgtgtgtctcatagttttaagctaaagtatataacttttattcttaaatttgtacctgtgtaaactcctaagtcagagactaatcagatacgttgctacttgtccctatttgtgtcatagcaatcactttcctcaagtttggtgttttgttttgttttttgtcatctcagaaatttgacacgtctgagtacagctttaatgaggaatgtcaacactgtaagtttagtttaggctttctgttgtaaattaaatgaaattctgaaagttttctatttaaggacatggccgtttaaagaaggaaacactaaactttaaaataagcaaaaattgaagtgattatagcttttaaattttgatctattccgtagaaattctgtttttctacttcaatctgagaattatttttaactgttaaaaagtcacattatcagttatagaacactttctaatttagaaatattttttaacttggttttctcatgtggttctcatgatagccctgtgagatactttctgaagatagcattctgattttaccagtgagaaaattgaagcttagagacattagacaatgtccataaactatcttcctgcatgtggcacatagatgggggtgttcaatacttgcaattgctcttatcactactgacatttgatctcagctgatttgagggtaggactgaagttcagatccccccagttctcaatgcagaggactttctaatatagcattcagccttgcccacacccctaccttcaagatgggagagcaaggattcctcagctctaacctgcgtgaggtgcctcccctgcccaaagccgaaacatcaagatgaggtcgtcacagtagggaagactagaaatggagtcttcatggattgttggaaatggagggattcttggagactggggaaaatgttcgtaactgtaaacccttaaggatactcctagtcaaatagctccagggtgccccctttcttgccttctcagaaccacaaattgattttcttgcttcacttgtggtttctggcagattcctcttcttgcctggcccaatatgaaacagaatgtgatctcacagacatgttctacttccctcattccctgaagctagcacctaattcttctgagacttttttctgtgtttgtactgctagtagccatggcaaatcaacaagggtaaaaagtgtgcagttctgctcgtttgatgtggtttgcattcacctaaattggaggagtagggaacataacaaaagtatgtcaagcatgggggcaagctggaaacccatatggtaaagggctgaaatcacatgtagctattccagcagcctcctgaacatcaaggagctagggaggtggctaggaggtgggatcaggtcaacaatggttgcaaagtgctctccttcatcatttttctgtccctttcactctgtgttctatgacccatccctagtcctcttcctggccatccctagtcctgccttgttactatgaaatgaaacctgtactgtgaaaagcaacatttggggctgtaggagagttcctccaaaacatctctaagtctccaaaagaaaagggaaatgaaatgtttgaaagtggcagcaattacttgagggaaatgatagagagggaacaggggactcgtggtgatgaaggagtcaccatcactatatgtcacactgccagtgtgtggattagctactgtgacctaggcgagcaaaatttaccctgtccccctccctccacccacacacactctgttttctggaagatgccattttttaaatgttaatcatgggtttgtcttttctctagctccttttctactgtcctagaaatgtaatttgggaaatgcagccagatttaaatatttgagatcatttaggaaagagcaactcacccaacctcaggtaactactagattccaaggagaaaccatgaaccagcagaggtaggtcattccctcaggcgatatttatcaacatgtgatattttgcataaccccatcaaaatcacctagggtacttattaaaaactaagatttcaaggactaattcaaaccaagctgtgactgagtatctaggggtgggaacctggaaattgccttttaaacaggtcctccccgtccatacacacatacccatgttatttttatgcatcttaaatttgaaaactacacttcagaggcttaaaatgctatgtcataattttaactgaggcctaggtcagccaagttccaagttagaatttttttttttttgggtcagtaacatagaatacatcttttgctttatataatggaatttcctcaaataagaagttctatttctttcatcagtccagtatcctcttccctgaaaaatacctggcccacatgtctaaattattatctttttttcttgagtctcctccactgaaagaggaaataaaagcaatagatgtttcctttgtacattctgaagttgtttcctagtacccttgactaccacccttatctgtccttccactggtgctgaaagcacaacaaagaaaaacactccaaattcaattgatgtgaactaaaagccaccagtctgggagccgggccaataaataaaatggcaaaaacttatttgaaccaattagacagggatatgcaaattaattggccatgatatcagggtcaagcaataatatgcaaataaactggcatcttattgagctaatgggacaggaatatgcataataatttggctgtgatgtcagaagcttcatcataattttaggcatgaatgttacaatataatatcaattctgggatacttcaaaatgcttaattacaatattgataaaataatctgaattcgtaaaacatgaacagattggtctaaaaaacaaatgacaagtcttgaaactggatcattctagaaaatgagtaattagaaaggattatagccaagcccggtacaagttgggacccaggcacagttatccacagaatggatagaaatgctctgcctgaaggactaaaagttttagagaaatgagcagatgtgaaatcaagagaaataagtgataggctgtaatgtatttgttcagaagagttagcccaaaaactcctaagtagattctttagccagcaggtatatatccaatcagtcaacaaacatcatgtgaaaactcctctgtgccaggcaccatgccagtccttgagaatatgagtaaaaacagcagacacttgcatagcagaatgtgagcccagacactgttctaaatgctttacatatggctaactgatttaatccccagtacaaccctatgaggtagatactatttttaatgtgattttattgatgatggaactgaaggacagagaggtacataacttacccaaggtcacaggattactatttgacagagctaggatgtcaacccaagcagactgtcttcagactccaatgaataaaacctgatgtctaggtccttatcattgctcagcaggttcaacctggagaacaggtggataactacatgctgcagtttgaaagatgtccaaaagtgacctgattccaaatatcctctatactcaagctaaaattctatcatggaactcactaacataaatcagttggttgactgtttaattagttcttcagctacttagacagcaaaggtgagatcaacaagtccataacaccagacattgaatagttatagatgatttttatgctggaaaggactgtatcagtttctccctaatgtacagattggtatgttattttagtgacttattcttcacacacaaaagaagatgagacacaaaacagtgacatttcagctgtatctgtggtacagaagagaggttgccgaacatggtagaagagagtccaagtttaagggatttgagtgccttttagagattaaagaaaaattttacctacaactaaattttagcaagggctaattctgtaaaggagtatgtgatattattgggagaggggcagtatgatgtaggagtacaaaagcttactacccttgtaaattgttatgggactctttgggtcaaaattacatatataaatactaaaattaaagaaatttgaattgcaatagacaacttaccaggaaaacacatgtcagctagataattttaacaagagaaatctacagatgaagaagtagaaacagggagttccaaagaggtctgttctaaggcactttcaccagtcaccttaaaactcataattctgaagataagataaacgtttccagccattgaaatgcaaagctcagtggtaaatttaaaaaatctagctaagctgagtaagccaaaaaatgtggtagatgtgcttcatttgggtcaagctaaaaaataatacactaaaaggaaaacgtgacccaatttagagtatagagtaataggatcaattataaatcaagaaaaatgtcacatagaaccatccattgaagacattcaccaagtgaacatgtcttttttgctaccccaaaaaaggcttgatgttgtcacagaagattttataaataaaagggagggaaaatctcctacctttgtccaattccagagctcattcatgtgtacaacacacagagttttggttgttcacctcagaaaagacagtggtattagatgactatctgctggaggaaagcagctacaataaagggatgaaggggccgtgtgtgaggacaggctaggaacagcgggactttgtggtctgaaaaggatatgatgaaagtctgaaaatcatgaaaggtagagctagagtaatacctacctatttatcacatcccacaatactagaatcaggaagtcaccttgatgtttgaaagagaatagataaaagggatagctattcaggatgatctcaaaggcacctttctactcaaaaattctttgtcaaattttctttactactttacatttgggttgtaaatacgtgttgctctaggaaatggaacagattgaaatataagactgagataagtgtaggtctgttttgtgttataggcttacaaggagacatctctaaacctttgtgttgtcttgtaggaacccctcatgcctttccatgggtaaccataaatagcccacagctgcatatctcactaatccaacccagaatgcttacatttgcatccttcagttggccacttctattcccttctcttcattcagtatacagaaaaaaaaataaggagggtcagaatttctaataggtaattgcactgggaggaatagagtccccacaaattcctatttttaaaaattatgtttagtgggttctttcaggagatatttgggagtttctaataaaactattagaaacatgtagcaaaagtcggtgctattcccccttccttttacaaaggtataagattcctgttagtaaagcctataataggtgacaaaagcatgcaaagttttgagtctcaaacactataataatgctcagaaatggaaacatcaaagacagtcttttaaaaacaactgtactggccaggtgcagtggctcacacctgtaatcccagtacttgggcaggccaaggtgggaggctcgcttgagcccaggagtttgagatcagcctgagctgcatagtgggacccccatctctacaaaaaaaattaaaaaaaaaaaaaatagccaggaatggtagcgcacacctgtggtcccagctacatgggaagctgaggtgagaagatctctcaagcccaggaggtcaaggctgcagtgagctgtgattgtgccactgcactccagcctgagtgacaaagcgtgtccctgtctcaaaaaaaaaaaaaaattgtactttattataatcacttctgcttccaaaagtatatactgtttctacttggttccttaatcccttattcttaatctcagttataaaaatatcattcttgttcccttttcaccatagtcttgccacttgctgcaccatgagctactttgagagcagggattgtgtctacttatgtctgtgttctcagagcccctagcatatatgctgaagaaacagaccttaatataccctgcctaaacaatcagttttaaatttttaaattccactaatctaactgattattttgtcttcatcttccaaatgatctgacttaatttcatcacttaatgcaattattttggcatcatatagtagtaatcctattataatagaaatatcggctcataaataaaaaccagacaatggaattcttaaaaccaattggttattttagccatcattttcagaagattttacttccttccttcatttcccccctccccaccccctttaatggttaaacgaaagaaaaacagactatctccaagagataaaagagagtgacacagaaatgcacacattactgtagttatacctcaacgacagtcataaaggcattttcaagggaaaaagtaaagacagagaatgatcccttggtcaccttttgcccagcatgaacagataaggcaatgattcagcatcttacttgtccactgttttaaagactaactccttatcaaaggaagtcaaaagaccataccggctgacagcctttttaaattactaatggcctaaattttgcggtacatcattttcaatgatgactggacaactaggaggcttcctataattttttctttcagaaataaatgattttatttaacttaaaaaaagaattaagcgcatttattttatatcctcagaaccactgaaactgcttttagccaaaactaaagcaacatgattaagaaattaatagatttcaaactactgatttcagtcaacaatatgacagtgtaattaactaataaagtgtcccgttaacaaacaaaaagagccgaatgcacatttcgtgatagtgcacttgcagaattactacatatactacatatacatatgaaactgcaagattactcagtaatctactgacgcagctgtcatttttagagaatattatgaacttccatatccttattaaggaaacaaatgctttcacaaatagccctgtgtttaaatatttatctagaattttagttttaaaattataggaaagctcaagaaataaagttaatccacaaccccaccacttcttttcatacataagtaaaaaagtaactcaaatcagccccctctaatcctttcccattcctcagagttaattgactcaaggaaataatttgaaatttcatatccttccaggttttctttctgcttatatcaattctatacatatatatacaaatatatatacattttacaaaatgggattttaaacacattattctgtaattatttttaacctaccaatatataatggagatcctttgggccaacatatagatctgccatatctagtggttgcatagcatccctttgttcgaatgtatcatggtatatttagtaattctcttataaatataactatgagaaaaactatataaattcactgaaagacttcaaatgagacctaaataaatagaaaaataacatgctcttggatagggaacaatatagtaaagatgtcatgcttcccaaataaatgccataaatgaatttgaaagatgagtaacacacgaaaagaaagctttgcctcacataaacagatcaagtattaatatccctgtaatacaaagagtttctacatatcagtgagaaagaaaagcaataggagaaagtctctattttattaatgttcctaaaatttacttgctgctgcttctactactggctgctgttgctgagaagtaaaatgttacatttatacaatgtcattatgcatctaaataagaaaggattttaaagtaagatgcaattaccctaagttcaaaatctaaaaatgtgttgcttaaaaagacagcctagactgattgcaaagagtaccagaaaaaaaaaaaaaaaagcaggtcattagcttgtagattttcatattttcatcaactatatttgcaggagtctgaatccattaaaacactcaatccagcagcattattatgataacaacttgaaaagatatgtgacagtcactaaaagtcaaagtaaaaatacataccgctatgaaagtcattttgaagggaagttcccaatttctagactttataaaaacaattaagcatctgaaagctacttttactaaaagttgccaattcgtgtatctagaaaacactcctgcattttacagcactgtctttaatgtagtgaaaatattgcaaatgaaactagcctaaagggcaataatatatcacagtatatctccagttacagtaattaggaatctattctaatcttacctgaaagatatgttagtgttttatgtttataaggatttcaccaaaattttttaaaaatagcttagtagaagagattttaaaagaggcagtgaatgtttatgaattatgcaagtctgaactttcattttaataactccattaaaatataaaaaccttaaaagcctcccatcaggaatttaactttatagaaatgctttatatgtgccctgaccttgccaagaggcaggcctaaggcatgatttaacagttactacaaggcaaagcctaataataaatacctatctgaaaatgccagcatttgtccctgcctccttggcctccagtggagttgcaactcagccataaacaggccctctcctgagagacagcagggcgcagcagaaagggagcagcaactggccctggaaagcctggatcggaagcctttaacctttctgatcctcagtctgttcatctataaaactagggtattagagacagccatattgttgaataaacaaatgagataacattaggtgaaagctccaggtagaaagcactatataaatattggttatttctaagcaaaagacagttcttggttaactcttaatttttgtcaccatatcctggctccaggagaatgtgtgttcctatatggctgatataaataatactgtgtgtgtgtgtgtgtgtgtgtgtgtgtgtgtgtgtgtgtgtgtgtgtgtgttcaaagaatgcctcttcattatttggatggcagttaactgctttggctaacttatgttggcatcctgaagctaacagcaaatcctcctcccatctcctgtaacttgtggccacaagacccagcatattttataagaaatcagaccagtagtatatttctacgatcttcagtttgttaagctatttatttgagttaagacaccgagttgtcttccaagtacttcttttatgataacagatccaagacagacacagctaatttgggcaacaagtagggacaaagaggaagaacagagcctctgtcatcctaattatcaagttaatgcctggttgctggacaaactctccctctctctaaaatgaaccaccgcaagttggaacctgctgttgcaatgttaatttgactagaagtggcaggacctggtcccagagcagctcctggttgtctttccaaataattttgccccaggtaataaatacctaattgatgcaatatgagtcagtatttgttgttcattgctacataattgagtggtcaaggtttcatctttcacctgtctctacaaattcttaatctccacaagtagtcaacattaaaaacaagaaagttacccatgtaaatttctacatgcttgcatccaaacaccctttgactctcttcagcttgctttcctctcgatgaaatttcattttccatattaaacatatctccaggctgtgcccatcttggcatttcaaaaaaaaaatagaaaaacctggttggattatacgtctgccttctccttaaatcagatgaattgctccacttgccggtaggataaatagttcagttaaagcatatactaagaatctcagataagtagctcagttaaaacatatactaagaacctaggtaagaaatgtgaaaaaaaaatattgcttattagtcctacagcagagatgatacctttttttaaaaaaaaaaattattattatactttaagttttagggtacatgtgcacaatgcgcaggttagttacatatgtatacatgtgccatgctggtgtgctgcacccattaacccgtcatttagcattaggtatatctcctaaagctatccctccccccaccccacaacagtccccagagtgtgatgttccccttcctgtgtccatgtgttctcattgttcaattcccacctatgagtgagaacacgcggtgtttgattttttttccttgcaatagtttactgagaatgatgacttccaatttcatccatgtccctacaaaggacatgaactcatcattttttatggctgcatagtattccatggtgtatatgtgccacattttcttaatccagtctatcatttttggacatttggattggttccaagtctttgctattgtgaatagtgcctcaataaacatacgtgtgcatgtgtctttacagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgacggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagcaggttgcaaaaattttctcccattctgtaggttgcctgttcactctgatggtagtttcttttgctgtgcagaagctctttagtttaattagatcccatttgccaattttggcttttgttgccattgcttttggtgttttagacatgaagtccttgcccatgcctatgtcctgaatggtaatgagatgatacttttataacactttgatttgtcattttactaattgctaaatttgcccatatcagtcatgttgaactgtgcctccctcaaacaactagcaagactgatctgaggttgaaccaattgcttaggaaacatcctctatgaagctataaacctgaaacctatctatattcagtctctggagatgaaagtgtcagagctggcagggcatggtggctcatccctgtaatcccagaactttagaaggctgaggcaggaggattgctggaaaccaggagtttgagaccagcctgggcaacatagtgaaaccctgtctctacaaaaattattagccaggcatggtggcatatgcctgtagtcctaattacatgggaaggtgaggcaggaggattgcttgagcccaggaggctcaagcccatgatcactcatactgccacactccagactgggtgacaaagcgagactctgcctcaaaaagaaaagaaaaagaaagtgtcagataaatttaagaggtacatttcagcctgatccatattgagattaagggctgctttctttttaaataaagatatgtttagtatttctacaataggattcaatacaatagaattgaaagtatgtgtaagtttagcccaaagctaaagagaaagatactattctcaagccaaattacatacagtatgtagatgtacctgtatctttatctttttttattttttttgagacaggcagatatatcttttaaaattgacttggcctcatacttttatagcacatgcagattttgattcttgtaactgtcacttgaaattttgttttttaaagctaaattagtccaatcatcttgcatgctgcaagaggaactagttattcaaactatgagaatttagtatttgcttacaagcaagataacaagaatggaatcttttttatcttgggtgggtcagtgagcaaaaagatatttctttttatttctgtgtgctattaatatgggtggttcttatcattgcctctctaactttccatttaaatttcaaaatgatttaatcttaaatgtaaaacaactgtgaaatcttattaccgagattatttatttcaaaaatgagtctccggcaacagagttcctatactctatgctgagagatctggaatattgcattcatttctgaaaacacacttaagaggagagacattaactttctgaagcaaattcagcaggaaatcagggtcatgcagagggcagatacagtctcagttaaggaacagttcaggcaattggagatgtttaagctgcaaaatacagaattcaaagaggacataactgtctgaaaaatgtgagaaaagaattgaacctactcttattaactataaagacctgaactgggatccatgagtataagtgatggaaatccatacttggttcttcccattttagttcccaaacaaaagctagaggaaagtttatcagaaatactgagttagggccgggcgcggtggctcactcctgtaatcccagcactttgggaggctgaggcgggcggatcacgaggtcagaagatcgggaccatcctggctaaaacggtgaaaccccctctctactaaaaatacaaaaaatttagccgggcatggtgacgggcgcctgtagtcccagctactcaggaggctgagacaggagaatggcgtgaacccgggaggcggagcttgcagtgagcagagatcgcgccactgcactccagcctgggcgacagagcgatattccgtctcaaaaaataataataataaaaataaaaaataaaaataaaagaaatactgagttagggatggtaccctacctacctgccataggttagggaattaacctattaaatccctccaatcttctaaagtttcattttaaaactctaaaagatcatgcccagcctaaagacaacatcagcccatggaagagcacatctattaaagacaaatgtatcctcaccaaaagtgattattttattttttccttaagataatacgaatgaaagactactactgctaataataattatagttataatctagtcagtgctttctctgctgtgcatttactaatttcgtcttgtttaatcctattcatactctcatgaggtaggtatggttatccccatatatgaatgagaaaactaaggtttggaaaagagactcgctcaaggtcacaaggtaaagaaatggcaaaggcccagctcctcactccagctgcatctgttacctaagcctgcccacttactcacagcttcccccacctagacagtgcacactgtaatttcaattggccataatccccaaatcatagaaacctcaactctagaagataatgaatgctcttgagcagcaaaatgatcatcagttgactcacaatgaatactctctatagattattttgacaaagtaacgctatccaactgtgcctgcaaatgccaacacatgcaaatccctgcgacttcataaacagcaaatgccctaatgagctaaagaaacaattgctctttattcattttcttcagtgtgtttcttatttctgctggaaaataatgtccagaaggaatttgtgttctattcaatgactataaaaaagaggaaggttagtgtttacaagtttacataatacaaaaaagagtggccgtgaaacagtgagctgtggcttcctggtgggaagacactcacatgcagcctgtgacttcctgggcagttttaatttacttttaatcatttcagaagtcatgcctcagaggtttgagataaaaagtttcatagcatcttacctttttcttttctgcccctccttttttagtttggtaaaatgtagtccagaaaaacaggtggagggggaagagccagtttaagtatttgctcctccaggaaacttcccacatatcctaaacccatctttgttcttctttacctttatactgtccacgttttttcacttgatcactgactgttgtgtttcttcaactgtgttctgtacataccttttctcattcatgagaatgaattgtttaatcatcagggttgccaacaccctcattatttctttttctgtgttcccatggtgcactggagttatctcgtcccatgatttatcacacactgtaggtattcgtggctctttctctgtgaactcctttaaggagaccaacttaattcacttttgcataaccgtcatctagcatcgcctagcacattgtaggcccccatgaagaaattaaattaaatgaaaactcgaatagttcacttaatccccagtgtttaacatatagtatgaactgaattgaagtaaagtgaattaaattcaatcagaacaaatcaaaatgaactgaaatgattataagacattattatgttggataaagttatccagattatatttataatttgtagaaaaattgattagcacagcctagctatgttgttgtgtgattcctatgatggacactcaggattgcccattatgttactaccatagaaaggtcagcagcctttaggcccaatattacagctagttctttaagctgaggccataagggtagacacagtctaaatcactgtgtattggctgagaaatgtagaccaaactccggaaggctgacagtatttctgaacaagcaaatgatgcttaaagtgaactgaagctgttgattatacaggaggattccccaacaagtagatctaaaatttcatttccagggctaagtcaccttcttggtccatggtttgctgtgatctcagagggagaggaaaccatacccacaacagcccctcatccctcccctctcttcttatctctagcttctaaatagttgtccatcagcacgcactgtgcaccccatctgagttcagctgtgtgttaggcacctgaaattcagtcaataccatgaacattatctctccacttttgggtcctaacttctcaaaaaggagaccaacaataagtaagtaccaaaaatattaatcataaatgatcacaaattctatcaggctgtgaaagagagaaatgacaagatatttccctcatccaaaaatgtagactctgatttaggagtataggcaattcttttctcaaaattatatctcttttcatcaaaaaaagtaattattggtaaaccagataaataagcattttgtaaaaatgaaaatgattgggggagagaggaatatcctctcctacaatttgtgcttaactagcttaggtttgtccgatgagatcagacatcttttaatgttgatgatgttcacctatcagtaaaactttgggagcacattcctctttatacatttacttgtaggtttgtaagtgtatatagaccactatagtaatataaaatggacattataaacttaaaagtcaaaaaatgtaaaagataaagcaaaagtaaacattttacaatttgctttatgaatgataaaaatgttattctccctttaaaatataattactaatttgttaataataaatatgcctcacttttctttaagatatctgtttaactttgtaatgtagcaattcacaagcataatattagattccatttatttcaacacttagttttatagatggtcacatcaaaaaaatgcctcacaaatgcacaatattcataatatttaatatgaacttagtttggaatttacagaaaatatgtcaatatatcacatcgactgaagttttttattttttttaaatcaaaacttttaaaagcttaaaacttttaaacttttagagaagcttttagccagcttctctaacctgaaatagatgatcatttttacctgtaggcatgactgacagagcacagctgaagaagaggtaccagctgggtcatattctcatttctcactcgtgtttgcattatcaagttttcttcaagccacagttgttgttcaggactcattttaggcaacatgctcattttgtgaagagtagtttggttacaattaaataacataatctataaaccaatttaactgggctcacataaagcgcaatacatagaaaaatgctaacagcaaataaagtgcaggcccctctggcaccccaccccacggtggcgcttccatgccaccctcaggaaaccttgagtactgcgtgtgaatcatgccagaacaggggcacctctgtgatactgtacatcagacctcagtaaatttccaatcctttatttttagaagaagaaaataaagtagaaactctggtattttcttctggggtgccagaagtaaatatttgaatttctactttattttttccacactggagatcagagaaactaaaggtttcaagtttataaaccaaaagtcggccagcaaatacattttcctttcctttctcttaccaaagagaaaaagatgatatcatgttgattaagttttgtctttatagaccaactattcattaaccagaaggacagatcattgttatttattaatgtgatacctaatttttattttaaaagggtacacattctaacaaatggtaatttcttcataattttcaaaaataatgccgggttttaaaaagaaaaacagatgatgtaaagaggcactaaaccagattagtttcaggacattcaatgtcaccagaaggataggaatggctggatgttgcacctataaagggaaacactggatgggtagcaggatggctgctcacaaggatttgaagaactaccctgtggacaaaagtatggaatcacatattcagcaaatatgtattaaatgcctacttactaagtgccacagtgaggagctggagagctggtggtagtgagatggattttgtgatacctgcctacaaagagcttggaacgagctcagggagatccactttaaaatactgtgtgatttagattaggagtaaacaaactttttttgtaaaggaccagatagtaaatattttaggctttgcaggccacatggtctctcgcaactaaatattcaactctattgcaacacaaaagcagccacagacagtctgtaaggagtagacatagctgtgttctaatcaaactttttatttatggatactgatatgcaaatttcatgtaattttatatgtcatgaaatattaatcttttttatttttttcaactctaaaaatgtaaacattttcttagcttacgacctacagaaacatgcagcagccagatctggtccacaggtagtaacctgccgggagctaattaacaggatttcacaagagctcagaggaagagtacttaacctccactggagatttcgtgggcgcttcctggagaaaccaagaaccgggttgagggattgtgcagggcaaagggataggccaaaaggacagtgagagctaaggcctggttgtacaaaacagatcgtgtagtgtagaggagctgctaagaaatgaagttagagaggcagagcccagtcaggaaagttgaactttatgttccagaggtggtgagtagccactgcagggatttaagcagggagtttgtgctgcaaactgtaacattaattccagctcaggctgtggaatcaaactgacatgattaggatcccagttctgccactcaccaagcatctgaattcaaatcattttcttatcctcttcaaatatcagttccatcatctgaaaaccaaagataatccctaccttgctctttgttattctctattcttgtacctgtctgcttcacttattgctcatagtgtcacaactggtaatataaatttcattgctaacttgttatttgactgatgccccctctagattgtggggccatgtcatcatccatataaaccaggtacctagcagggcgcctgactcaaaagtacctgatgaataaatggaaaaaaaaaatcaactcacaatgataaagccaaccatctcccaccttgtagttctatcactatccatgcttgcttcttgccttacaaggataaatatgttgtatcatttatttaaaacttggaataaagtcataaagaaaaatgattaatcatttctatacatctatcttatccataatgtttattttcttgagcaagttctcattacacttcattttgccacatggcttttccttcttccactgagacgcacttcctccaagaaactttcttaatctaaatgttacaggaaaggggtcccaatccagaccccaagagagggttcttggatcttgtgcaaggaggaattcagggcgagtctgcagtgcacagtgaaagcaagtttattaagaaagtaaaggaataaaagaatggctactccatagacagagcagtcccgagggctgctggttgcccatttttatggtcatttcttgatgatatgctgaacaaagggtggattattcatgcctcccctttttagaccatatagggtaacttcctgatgttgccatggcatttgtaaactgtcatggtactggtgggagtgtagcagtgaggacaaccagaggtcactctcggcgccattttggttttggtgggtttggctggctcctttactgcaaactgttttatcagcaaggtctttatgacctgtattttatgctgacctcctttctcatcctgttacttagaatgccttagccgtctgggaatgcagcccagtaggtttcagcctcattttacccagctcctatttaagatggagttgctctggttcacacacatctgacataaatgggcaattttctagtttacattgcagtgagctggaaatgaagcaaaatctttccaatgcataattcaggctaacttttaacttaaattcacaggtagggtaaatggcccatttcattaatgatttacaaacgtctgcatgcctccttatctaaattgccaaaatacctttatatttcactgcccgatatcacattataaattgtaaatatatgacttatctattcattagatttccagaactcttattctagggcaaacaagaaagcaataaaatccatgttgaattttagctcatatttctccttattgttcaatttcattcattcgttcaacaagtatctattgaatgcttactgtgtgccatgtattgttaaatcttcccttttagagatgtttatgtaacattttttgtttttttgttttgttttgtttttttgagacagagtctcgctccattgcccaggctggagtgcagtggcgcaatctcagctcactgcaagctctgcctcccaggttcacaccattctcctgcctcagcctcccgagtagctgggactgcaggctaccgccaccatgcccggctaattttttgtattttcagtagagacgaggtttcaccgttttagccaggatggtctcgatctcctgacctcgtgatccgcctaccttggcctcccaaagttctaggattacggtaacatgtgttttaaggtgtttattttctaaatagcttaaatcttaaccaccaatttatttttttcttctatatgtgttggtaattgtggcctagataaaagctctagcaattgtagtgacaggacaaaatataaaaattctcagggctatttaaattataaacagattttaagaagcactgtgtggtgtttctgttatccttctgctttccaagagaatatatctgcatcctgaaatctaatcacatttacttcaggcagagttgcttttggaaattcaggctttgcccatattgtctttgttgtataaacaacttagcttccctttctcccttttgttctagaattatttagtactaattatagattgagaatatccagggtcaggaagacctagtccaggtctagggagaatccaggttcaggaagagaggagagcatgggcttggttagggacatattaagcctatgacaccaattaagacaacaaatggagatgtctaatatgcagttagtccaccaaaattatattcttatttcttaagtttttcaaactgccatggaatagtccctttttcattatctcaaccatgacaaatttctcatatttatcactcccaatacatttaaaaggtgttagctagagtgtgtttctcacttattcctcatactatctaattcttaaagctcttaactatataaaatgcaggccataagccatggagttttcactcatccttatttttaattcacttgctagattatcaaattcaaattctcttctattagaaatctttgcctcactaactggaagaagctcaagtcttgattcctttatgcaatccttccaatccaaccccagtttacagatgtgtgcctttttccaggataaatttggaaaccttccgaaatatcacagatatgaccaacttttgaaggatcttctattgtggttatgtaatctgtgtcacataaacacaactcttaaaatttcaaagagaacagtccactggaaacaacctttttgattcttcttactaccaaacaggctagattacgtagcccatgaagccagtttacagaaatgaatttgtaaagaaaatcgcttttaaagaatcaactgaagagaggttagtttagtggcctcacagacttcattaaaaacaaatcttgctcctgatttggcagggattttcaaactattctgattcaagaaccacttgtgaaggtcaaaagcacaatttactagcctcattggctataaaaagaaacaaaacatgacccccagtggggtaaaggcttctgatgagacactagcattaaattgctaactcatgccaaaaacaaaagtataaagattggaatctaggtcagtagtgattaatccgaggaacaggctggaatgaaacaacctaaggaccctacttggggaagcattaaatgtcataaataaaaatggccattagatgaatttacagcccaaattaggaaagtttttctatcagttacttgcatacagaacttaggaaatttatggaagacgtgacagtgacttccaaaatcgatagaaaaattagtacatgtttgaaaacagactttgggtcaaagtgtttcttttcaaaataggggtgggagttggggatgtgttaccctctaaaatcttccatagtaatttcctcctgagaaaagaaattcatttcattttagtgttcctatcatgtttttgagaatttccatcctcattttctgttctgagagcatggtttagtaaatagtcctcagacccaataaacatatcaacagagaattttttagcaagttaatcaaaatatgaggaaaacaatgggatatgcttgaaataacaagtcacttgattacttaattaggttaacaagactgccacaaattgaaaccctgtcgttttttaaaacctcggtcgaaaatatttctgggtaatgattcaaggaatgaagaaaattggcctttttgaaggttaccaaaatgtaccagctgtgtaccattccaaggagtcctctgagaaccctgaaaatacatacgggtttttgttaatcattttaaaatctcaaagagcagtctgtgctacacaataatacacgaaatccacatgaagcctcccggtattttatggcaagtcctacttaggccaagctttttggatttgcttcagatctttatttccaagctcagtagcaaactcctgaaagctttgatttcaaataaacatctccattttgtcttttgcctcttcatgtagtaatcgtgtatatgtttatatactgaagaatcaatcatccaatagaaatctagctttgataactatgtttactaagaggatactaaaattacccataaggtaatttaagggaattcattacccaaataaaagactatgagcataaaaaactatagatattgctgagagtttacttactgtgcttaatacttcacatgtactattacgactaatttgccttcttgaaaagatgaggaaacaagcctaaggaaattaaataatttgctgaaggttacacccgagagcaagcaactgaaccaatcatctaacccaggccttctaactccatttgggtcatcttttctgatttgtggctctaaaaccccctttccagaaacaatctgacatttttagaaaccttcttttagaattgacgtattttactgaaaaagattccatttcttttgaagattaaccagagattttaaagctaatcttggcttttctttcaacatttcttcaccactgccacccccaccaaaaaataagagaaaatgcagtttctgtcatttagatattttgagaaaatattaactgcagaaacaaattagcatgctctgaaaaacaagtcccagagtttagagagactctgacaaagatgcaatttgagtgtgttcctcaagcacattcattgccatttataccttattcacaatcagcaaatctggctgtgcctgggatgaagaattttttgtttatttattttagagacagaactttgctctgccacccaggctgctgcatcctaggtgatgtagcctgctacatgatcatagctcactgaagcctcgaaactcccctcttgcctcagcctcccaagtagtcgggactacagatacacaccaccctgctctgctaatttttttaatacatgggggtctcactatattgcccaggctggtctcaaactcctggcctcaagcaatccttccacctcagccttccaggtatctgggattgctggcatgagccatcatgcccagctaaacaagttcttccctaaaagtgaagagggcttgtttaaaaggactgtaataagcttcccttgcaattccccaagtggactttgcaaaatgtcctcctcccctcaattcttccacctcctagaaacacctattcatgccttcttccttcctggaagccctaggagtttcctggggttccttgagctatggcaaccccatatgtatgattccaaatttagacagaggagtgtaacctgtgtcctagtgtgcaagcccaggaaagagaattagcaccaatatgtgatactaaacacttgacaatctttccctcatttaattcctacgacaaaactaggtaatactgtcattatcaacaatttgcagatagggcttagagactctgaaatctgaagtccatgcctttggctactccaccataatttctcctaggatttagtagtttttattccttgaaacattggcaacgaatggcctactatattattatgctgaattccctgattcctactttaaaacacaaccatttccattttcgaaagattatagatccatctcttgcttgcctgaaagtaacacattctttcttcaaaggtaaaactgtacacctaaactttgtaaaactctgtagttgagactgtctcaagttcctgttgaatcagataattgttatcagatccccttgaaaaagataaaaggaccaccactgttacaaagtacagagcaacaaaagccaaggcccagttaacagcacttcattgaaatgcaagaggcatctctgtgtacttacttcccatcttagacacaggagagcagggggtttgaaggatttgaattctgaatttctgttagaataacatctgccaagaataagccctgaatgtactacttttacctgtagagaaaaatgagcttatcactcaggtctttgtcgagataatacctacacctgttgtcaggctaaagatttagatagtcctggatgaaattccaggtctgctgtgtgagtgttagggagcatggttgagctacaaattgcgtggaagcaagctgattttaagttgccatggcaaagaaaatgcagagaatgagcagcttttacattaatgttttctacatcttgttaggataggattgtccagctgaggggtgctttttttgtgcttctactgacatgaacagataaaataataaacactaattatagagtattataatgatttctgggcttgcctcagaggggcgtctatctggctaggtaattacttccctgacagataggtttttacgtgagaatggagcatgatgagcctagtttattgcctgctgatgagaccacgggggaggaaggtcatgcggtatgcttattaagaccattttagtcaacgtgtttttcaatcagtcgtcagggtacccacccctggttaaagaaacgctacagatgaaaatgacacagtgattctcagtcgtgcgagtctgttgctttagggaagtgactaaatggtaagagacttctcaggttgaagtggaaggcatttcttgaaaatatgatgcctttgcctataatgctctaaagttgatccctagtgtgaaagagagtgctgctttctgtatgatacttcattccctgaaagactattttccccagctaagtcagattcaagttcctacacaattctggataatgtttaggaggtatcctgacttcaaggaatttatattcaaaaatacacaaacacatgcactcttctcccttctcccgtaacctaattgagtttgccaggaaaaaggggcaatgattttttccccttgttatttactaatagataataaagaatatatactaggggtaaaaaagacagaaaatcagagagtccagagaggaaaggaagttaaaaaaaagaaaagaaaaactaaatgaagcttttacaaaaatgcgatagtgtacacgtactgcccttcttgaaatgatccatcttattaaatgatgtggtttcagtgcttacctcttagtcctgctacacctatgggaatttggaagaaagctaggtttttcactttttaaatgatggcaaatgttacgtgctccaaacgctgagtagagattcttggattgtgatgaaatataaaaatatagtgcagtccccactttgaattactaaacaaactcaaatattgtaaaaaggcaggcatttcttgactgctcatacaacataaacttttctcccaagtagtctgtgtcgtgtgtgaaactgtagataataaatctaggcttgtttgccatgtcttctatgaatgctcgaaggaagtttatccacacctaaacgtaactgttgaaatatttattggcatgacatgctaatagaggccttatagtgctttgtggaacagacacatatacagtcacgtgggatacaggtatgttttgagaaatgcacagttaggcaatttcatcattgttgtgtgaacttcatagagtgtatttgcacaaacctaggtgttgtagcctgctacatacctaagctatagggtatagcctattgctccaaggctacaaacctttagagaatattattgtactgaatattgtaagcagtggaaacacaaaggtaagtaagtatttgtgtatctaaagatagaaaaggtacatttaaaacacatcattataatcttacaggaccaccatagaacatgtggttcatccttgaccaaaacattcttgtatttccacttcctccctaactatgaatattttcatgctgttcaatatggtacaatggcaaaataagtttatatagtatagatggctattcaagatatagttatttaaataaaaagtgggtttttttcctaaaaacaaaacaaaagaaaatctccttttgcttttctaactaccctttatgtccattttgttgttgtcccttgcagaatttacagtattagacaaaacacacagtggaagatcagaatttaattagatttgtttgttgttgaaacagctttcaaattctttcatcttatagggagtgaatccctagattactcacagacacatgaaaataaaaaactacagaagaatgttcacattgcatttcagttcttcatcatgtaaagcacttgggcctttctaaaagatgcaaatcactctttattattttgatgagctaacaagatgaattcatctctagaacactataaaaactaaattgtgaaaaatggcgccaaccatataacctgtccttgatcatacctattatttggtaactctgtggggaaactagaatcttttagaagtattatttgtgtcctaactatttaagtggatgatttaccctcctctaggaaacttaatattgagagtaggctgagaggtgatcacgttaatctggaaaatttttcataaattaaggaaattgagtttaatagttacagcaaattctccacatgcatcatgtttctgtactgagtgctgaactatacaataaacaaggaactgaaaacaagctttgaaaatatccagcagattcaagtattgctatttggcctaacaacctcttaaacatatgctcatttgcaactgcaaatataaaagcttttgtgtaaaaggctttatattttatacacaaaatataaaaaattttgtaagattagatttatatgccaaaaagaatctttcatatatataattctgtaattcttagatatcaaaaacaagactatttgaacagtttagtattaaaataagtgacaacttacattacttatgagggcacgtaatcagagtggctgtacctgaactaggtacaaaaatgcttaatactcagcttaacactagcatgtaaaatgtatgtgaattcagcaaaacatattttaaatgactttacattccattgctatgtatgttatagacacaaagttatggcactgagatgaatcactacttttgacaaacattttttgacactctcacctgggagatccggagcaccatccactgacagccaaaatgatctaaatttatagttccattgtttcaaggcttgaatagaagcatagcagaaaacaagaatgaaagctgattttctattgttggccgatgtgaaaaaacgtcatcacttattatatgataggtttggttggctttctcctgagttacgtaagatgttatgttcctgatctgtttatgtatgggtgtttaatacccaaatctttgaattattgttagattatttactatcttttgctagtagttattcccaccaagcaatttataataagcagctaatggaagggaccactggatttttttttttttttttttgagacagtctcactctgtcacccaggctggagtgcaatggcatgatctcagctcactgcaacctccgcctcctagattcaagtgattctcctgcctcagcctctctagtagttgggattacaggcacccaccaccatgcccagctaattcttgtgtttttggtagagacagggtttcaccatgttggccaggctggtcttgaactcctgccctcaagtgatctgccagcctcggcctcccaaagtgtcgggattacaggcatgagccactgcttctgggcaggaccactggatttccatatggaaaaaactactatcaaaaaaagatttttttttccaaactctacatagataaggattgtataatcagttactggaaatgcattcttaggattgtttgcataatttattttctatgtatttgtggatgctcaatcaagctttatgtatattcattgatttttttcaaatctgattgccctagttatgcgtgtttattccccccaaaattgtcagccacaattaaaattaaaattatgataccaaacttactggtggtagcatgctataatttataattcaagatggtatcagagccacattatatactaaactggttttgtatatgcagtttatcataggatttagaacaaatcagtgtattaggccagagttaccaactgaagggagcatcaaccaactgtggttatacaattacccattgttgttgttgttgttgttgttttttaattcaggaaaatgtgttgtatatgaatatactaaataaaggaaataaagctattaatagaatgtgccactggtgtcttaggtgaaaacatacaccaagattcataactcccctaaaattgttattgtcagttagctggataaagtggtctatgactaagttaaaaagctagaaaaatcttgtagtcaaaaggaaaacaaactttgttatgtatactcaggctggcccacagaaggtggtgcatggcagtgctggtgaatatcattgctgcagtctctaatactgctgcagtgctgcctagctgctactttaaaccaacactggctcatctggggccttgaattaccccttaaaggttgtatggtgcattaccctgctattttaaaattactttaaaccattcctaaagaaaggtaccacatccttctccagagaagaagttattagattctttacaaaaacacatatttatttaaataataaatttccaacaaaaaattcacaattataagattcctttgaaaattaccagggttttccccaaatacatttttgggtttttttttttccttccttagtattcattagttttcttttttctttttcttttttttatactttaagttctggggtacatgtgcacaacgtgcaggtttgttacataggtatacacatgccatggtggtttgctgcacccatcaacccatcatctacattaggtatttctcttaatgctatccctctcctagccccccaacccccacagaccctggtgtgtgatgttcccctccctgtgtccatgtgttctcatttttcaactcccacttactagttttctattgtatgaactatcttccatgcttattttgcttttattaaaaataagaaatctgtattcctggtattccctggtgtttcgatcttttacacacctattagaaccataatttctgtaacatcataacgcttttcaaaacgtctcagtgcctgttcctgaagttattagtttccaagtctcctcaatgcctagcctcgtgcatccatgggtctgtagttgcgcctatagcattctcattgctacttcagtttccctgtgacctcctacttcacttctctacgggtgtgcactctccttatctttcttgctttctctctcaacgttaaattcacatatatgaaagacattctatgggaagaataacctactccagcatttaatagagccattctaaacatatctgacatagagatgtccgcctgtcacctgcctattcaggaaatgagcttgagattggagatagatatattattgcaaaccacaatcaaggctaatatcttaacctgattttatcctaatttatctctgtttatcttcattttcagcatttctgctctttctaccctctcttacccaccttgtaatcttcaaatactatatctaactgatacccttcataaagggaatatttttgcacatattatgcactttcagttgaagagacagtaaccctccaagacagcaatggcccagaaaagagactagaaatgtagtgataattcataagtcaacatctgcctctcttttctaccttagccaagtttaatgcagagggcattacacttagttctagtctcaagtctaccataattagaaccataatcatgggcaaatcatttaacttgtctgggcatcaatctctcaatgaaaaaactaagctatttgacacatatggccccttttatgtttaaatcaattttattgttttttactaaatgaggtgtagaacattgacccatcaaatgaaatcactgtaaagaatataaaaattatagttaaataacatttcaaatatgaagctatttaaatgtcaactgtgcaggcaatttttaaatatttctagtcaatcataatcactgctttctcagtctttctattcttcctataagcatttgattaaagttgataacacagaattctcttttaatatgcattctgttggggataccaattaagatttctttaacttgtttattttagaaattgtttataacgccaggcaacagttgtaaagaggataacattcccagtagatggttttgaaaacttctataatatctaattatgtatagatccagactgtttatgtttggcatacaaataattgctgggagttagaatggtttgatcaatacatgcaattaagtgcacatatgttaacctttttctttaaaagttactttgttatatgaacatttattttttaggttatatatttaatcccaaatctttgctatctcatgaagaccagtttgtcataaacacttaataaatgtcattttgttcaattaaaacagaagggcctgtacatcctatgcatacatactttttcttctactgcattgtacaaacatttaaacctgtgtgtgtatagcttcaggaaactgtagctggagctgggccagaaaatgtctacagtagccttacaatagttttctagttccttggtcactactatgcatcacgagtgcctttacctatgtccttttcctcttcaacctatatacacacagactttttcctgcttctttaagggggaaaagtctgctaattcaggtgagggactatgtgtttgaaaaagtgttttcaaataaaatacttggccagtcacagtggctcacatctgtaatcataacactttgggagggtgaggtgggtggacaacctgagtccaggagttcaagaccagactgggaaacatggcaaaaccccatctccactaaaaataaaaataaaaaataaataaaaaaatagccaggtgtggtggcacacacctgtagttccagctacaagggaggctgaggtcagaggatcacttgagccagggatgtggcggttgcaatgagccaggatcgtaccactgcactccagcctgggcaacagagtgagactctgtctccataaataaataaataaattttgtagtggtagaagtttctaagcagggatttccatgttctactcatagaaaaacttacagaacaagcaggtactttaaaccccaacttctagggctaactacgtcatggaaattattctataaggacatgatctacatcattacatcacacatgagtccagccctctttgtctaagcctgtgacacatacttaaaccctgctgtttaacaaatcaactccaaagtaacccatctttgaatgtcattaaggatgagtatctgcaatgcaagaaactttgttatcccatgatgtttagaaaaatctgcttaataagtagatatattccacttgtttgttactctccataggtactctctctctacttacaacagaattatatgtaatcagttgttctcattcacataaacaaaccctgacaagaaataaaaatgtggtaatatcagttctctgcatcaaggaacatttttaataaactgtactatagaacgtcttactaatcagatcttttaacaaaacatatgttagccgtaatttctgtactaagacactgaatctatattacattgtaaaaatttgagtatgagctatctatacgttcccagcattgtatcctatgtaaaaaccctaaattaaataatacacccaaagaaattgagaccatttttagttaatttaagaaaataatgtcagatatttccagttgctaagcatttaatatgaatcaggcactgtgctaagaattttatagagagtagcccatctaaccctcacagtaaccctatatggtaggtactgtaattaatattattttacagaggaggaaactaaaatgttaaaagcttaattgtccataattgtaagtggagctagaattcaaaccaagtttttctggctcctgaattatatttttataccaccacctaccagtacatttatattcaggtttctttggctatctcaccataaaatgctgccaccccatcttaatggttgaggagattcaactctcagttctaccataagcagtagcatgcaattttagctatagctctagaagtatccaagattatttagctcaatttcccagctctgtaggttaaattcattgtctttaatgtgtttcactctagctacccaatgcaaattatgtcactaagaacaaaggaatagtcactacttgtttgtttccaataattcttttttttttttcttttttttgagacggagtcttgctctgttgcccaggctggagtgcagcggcgcgatcttggctcactgcaatttctgcctcctgggttcacaccattctcctgcctcagcctcctgagtagctgggactacaggcgcccgccaccatgcccggctaatttttttgtctttttaatagagacggggtttcactgttttagccaggatggtctcgatctcctgaccttgtgatccgcccgccccagcctcccaaagtgctgggattacaggcgtgaaccaccgcgcccggcctccaataattctttattatatactgtgctgtattgaattaccttggattccattattttgccaaatcatttatttataaggtaaattcctagaagtaacatttctgggtcaaacgacgttagtaatattgataggtacaaaggctttttgttattgtttgttttcatttttattaaagttatgcatacaagcacatagatttaagaatcaaacaattctacaatttttttaaaaggataagaaaagcagacactcccctcacagtgcttgcaggcacctcttttagctttttttttattttcaatttaccctcttgtctctagatgatacgctgcttggtgaattttgtttcagcgttacccactgactccccgccatggaaaatgagggtttagctcttttctatgcacacacatatttccaatatagttatgccataattttgtctagctcaatattcaattcacattattgggattatgtggaaactgcacaattgagccctatagtaacctttcaacacttttcctttctcatctagcattgtttaattgtcccattggcttaattttcatgtgtttattaccaattcaatcccaacctcactgctgattgtctaaatctctctcaaattgctcatccttatgaagtagccttccccagaacctgacttgctacagtctagactggttgctctctaactcatcctggagattcctgccatctgtgtgggagcttctaatgtcttcctctttcagtgttggctccatcttggtggcaaacatccagtagtaactaactgcctgcaaggtgactttgggaaagctgcttaacaactccaaacctcagtcctctcatctcaccttaattgtgtcactacttttaagattagtcatagcctcttgacccagtggttaaagcagttgttttcaattggcagaatgcattagaagttctggggggcatttgttaaaaatgctggtgcccaggcccaccccagtgatcctgattcaatagctctgaaatagggtgtatctgaatattaaaaatacctggtggttattctgatgcaaagtcctgaagaatcactttttaagaagcaccagctcaaagatataaaacaaaaataacaagtcagcagtgattttcaaagccaacagtaaaagaagctttcaaaaatcccttcccagttctaaaatgtatacattgggggatgccagaaatatattgcttaagatttttgaaaagttccctaggaattttaaaaaaactaatttaataaagaataacacagtccataggtcattaacttcaaatcatgtattaggaagatggcgaagagctaaagtggcccatttttattattttctgaaagtggaaaagatgttgccaaaagcaaagaaaagaagacattatcttttgtaatcattgaaatagaatttttagttgattcccgccccccaacagttttgagtagacagtaagaattacaaatgattacaccacttagaaaagccagagaaaggaataaatagatttatttttgttcagaatgactgatttgttgtgatcagaaaccaaaggattttaaaatactgagtacaaacctgcatatgaggtttgtaagacaatgggtagaatactggatgtcacaactaaaaatgaggccagtatcacggtaattttgcaagatgtgtgtcaaatatcaatccattgttgaaaggtgtccaattcatattgtaaaccttagtaaaaaatgtgccacatccacaccacatgaacagcacatatcatcacaaaaatagtgttctttgaagaatgcgtaggtaccactagacacctattattaatcattgtttctccaaagaaggaagagtttagatatggttttgggagagtatcttaatgaccaccacatttcaatatttttaaaatatatgtttgaaatatcctaaataggcaagtttccatggcaatatactttgggcaatttgaaagcaaacaaataactatgaaaaatgttatttaaaaagtttttattttctagcatatctacaaaaatcacatcaactctttgctattgtgaaaaactacatgtcataggaaaaacaagtaatgatataaacagatttcataatttgaaataaactatcagctgaacaaagattacattaagaacatacccaataatacagattgtagatgcacaagtaagaatttacaccggtttacagcaaatgaggacaggaggatggaggatactttactccccatttgatcccacatatggtatatgatttacttggagtataaaggacaaagaaaaagggtatagggagactatcaggagaggtaaaccaatttaagctaatgcaaaacgaaaaaaaagacaaatgtttatgtctgatgacataaaattaaaagattactagttcagtcagtttaatgaagattaatctggtccagttaataaagaaaactgagtatatgtattgtaaccatgtctgaagaggcaatcctgaaagcatttttttttttctgaagcacaactctttatttttctttcttttttttttttttttttagttatactttaagttctaggttacatgtgcacaacgtgcagttttgttacataggtatacatgtgccatgttggtttgctgcacccatcaactcctcatttacattaggtatttctcctaacgctatccctccccaagccccccacccccgagcaggcccccacatgtgatgttcccctgtctgtgtccatgtgttctcattgttcaatttccacttataagtgagaacatgcagtgtttggttttctgtcctcgtggtattttgctgagaatgatggtttccagcttcatccatgtccctgcaaaggacatgaactcatccttttttgtggctgcatagtattccatggtgtatatgtgccacattttctttatccagtctattattgatggacgtttgggttggctccaagtctttgctatggtgaatagtgccaaaataaacatacgtgtgcatgtgtctttgtagtagtgtgacttataatcctttgggtatatacccagtaatgggattgctgggtcaaatggtatttctagttctagatccttgaggaatcaccacactgtcttccacaatggttgtactaattcacactcccaccaacagtgtaaaagcgttcctatttcttcacatcctctccagcatctgttgtttcctgacttcttaatgattgccattctaactggcgtgagatggtatctcattgtggttttgatttgcatttctctgatgaccagtgatgatgagcattttttcatatgtctgttggctgcataaatgtcttattttgagaagcgtctgttcatatcctttgcccactttttgatgggattgttttttttctttcaaatttgtttaagttctttgtagattctggatattagccttttgtcaaatgggtagattgtgagaattttctcccattcggtaggttgcctgttcacgctgatgatagtttattttgctgtgcagaaactctttcgtttaattaaatcccatttgtctattttggcttttgttgccatctgaaagcatttctttaagcttctctgtcagcctccctcttcttttccccactccatccttctctctgatttcttctgccttctggggaagaaatgaagactgagcaatttcatcagtatatacccctctactaagcactagcatcctgtgctgttccctcctgggacagagaagaccagaaacagctgctatgtcaatttacaccttgtctctgactaacctagaagctatagcaggggctgcattaaagacataatatgtcatttgtctgtaatctgctctaatgctttggcatctggtcacatgtattacttaaaatcagacaaatacataaactcttcacatagcccagatagctcggtgatagcacctggtaaatgctaggggtatgtagccgggtattaacttgaattgcaatggaccagcagatatgaaaatgatttgggatattaccaaagcagttgttaaaatggaaataatattgctcttactgggaagaaaaaattgaaaacagtaaaaatgcagctacaaaaaaaattacaggcagaagcgctatagtattttagatttaacctgtgtaggcaactgacaaacactgataaagacagatggccatgacagcatataaaacagtcctcaggatgattcagtatacaaatgtgaacccatttaagctaataaagatcaataccaaccagaagttgatgatgcataacccaccctttattcttatgtctcattttaaaggttaacacatttcaaaatttatacatttaaagatgcttaacttttaagataggaattgatttggcttattttatgttaaagaaaactgtttcagctcacatcaataaaatataatacctaactagaattcatcaaaaacaggtttctactgcaacatttcaacaaactagatgatatgttttacgcttattaattactcaaatgctaaaacatctggactgtaaatttaatcttccaatgaaatagctacacaatacagttttttcactattaaatacattaggttattaccctgtttacctaaagttacctccataattaccaatagaattaaggttaagttgataaatttcatgagaatcccaaagtttgaaaactattttcacacaacacacacataattttattatcttatattattttttaaggccaagataattttaaagaacttgatacataataagccttaaatacatttgtcaaagagatgagagaaaaagaggaagggaaagaggtagagaggaagactggttgtagaagagacatgaataaaccatggctgcatttaaaaattcctctgaatgatttatgaattcattacagagatcaacttttttggttttttggttttttggtttttgtttttgagatggagtcacttctttcacccaggctggtgtgcagtggcgcaatctcagctcactgcaacctctgcctcccagattcaatcaagtcttctgcctctgcctcctgagtagctgggattacaggggcccacgaccacgcccagctaatttttgtatttttagtagagatgaggtttcaccatgttgaccaggctggtcttgaactcctgacctcaagtgatcctccagccttgacctcccaaagtgttgggattacaggtgtgagccaccatgcctagccccagagctcaacatttattacggattttgttttttggcttttgttttttgtagagacgtcatctcactatgttgctcaggctggtctcaaacacctggaatcaagcaaatctcctgccttggcctcccaaagtgctgggattacaggcatgagccaacatgcctgactattacagactttgatagtagtctacttgattcataaagatatttcctttcctagtctatgtgtagtaagcactttacttagagcataataaaagggggaaaagaatatagaaatatcaaagaagagaaaaattgatttaaactgatgcatatcatatcaaaataaatttaaaataacatactcagtaaagaactatccagattttcctaattttctaaattaataaatttagggagacatctttatagtttataagatagccattgactattttgttatcatactatggctgcaatatacccaataatactctgtatcctaaattagttactacacctgggaatataatttttaattgcttaatgcttacatacaaaattatctataaccatttctaagcagaatattttaatactttagaaattgagtgaggtatttagtatgctgaccattttataaggtccaaagagtatgctaatggagttccaggtgagaacaagaaatttttataatgatggccaattttcatctgggaccaccctcaatgcagaaggattggttgatgtcatgtctgccctaaactgaaactatttcacttgaatacaaatttagaaaaatatgttgataattcttcagcatattgcaagtaaatattaatttaaatattaaatgtataagtattaaattaaatattaatccagtctttctcaaccctcccagtacatcagaatcaccttagtggatttttaaaatacagatgccagggctctatcccaagagaagcagttagttgaaggtcataggaaataattattttttgaaagttttcccagatgatactaatccagtacaaaacaggattaaatgaagtcatcatagtccttttctgtcagaataaaggaatagagcttccattcaaagaatggaagttttataaattctatatctaggctaaggggacataatcataggttaagtggagaaaactgtgactcaaatactttgtgtgacttgattgaaggatgatatttttctgacagtgtgtcaacaaatatttattgagcatttatttggtgccaggcattataatgttggtactaggaatagagagattaacatgatattttcccttcagcaatttatattctggaagagagagttaaataataaacataaaataattttgggtgctggtaagtgcaacaaagaagacaaatagaataatgtgaaaggtaaatgaaggggtggacttagctctggtgaacagacaagtttctttaaaaaggtaacatatgaaaacctagaggaagagggtttcaggcaataagaaatgtgaatgctaaggtcctgagatgggaagaaactttatatatgttcgaggaatatccaggaagctggaatggccagaacttggcccagcactgggagagtgaaagggatgaggtctcagaggcaggcaggaaccagctggtgtagaggtttggaggccactggaagggggttgcttgtattccagttgcaccagggaactagccatcagagattttgttttattttgtttgagacagggtctccctctgttgcccaggctggagtgcagtggcacaatcacggctcactgcagtctcgatctcctgggcttaagcagtcctcccacctcagccttccgaatagctgggattacaggcctgtgccaccatgcctggataattttatttttctgtagagaggggagtctccctatgttgcccaggctggtctcgaactcccggctcacgtgatccttccacttcagcctcccaaagtgttgcgattacaggcttgagctaccatgcgtggcccatcagaggtttttaaatgaaaggagatctgcctgcattttggaatgttactctggttgctgtgtggaagttggcctgaagaaggaggtcaactttggaggcaggatccctgatgctgcaaaatgatggtacctgggtactgggaagattctaattgatgacctaagtcttacaaataatggtttttctttatcattcttttaggtcaaaagctctatgctacaagacttaaagatgtggggaggatgtgattcatataaaaaggaagcatcctgatagatttttccgagtatatgtgaactcctaatccaaacagcttttcatccaggaagtttccatcatgctctccactatccactgtaaattccatatcactatgcagaactgaggttcctgacatttttgtgtttctcagaaaatgttggtgcagctttttagtcttgtaaccgaatgaggttaggttatgttcatgctacaaacattagattccaaatcactgcttaaagctgaaagttaaccttctaattgaattaatttctacatatgtttttcctgttccaccaattatattccatttgtcatttgttatgtttcaggaaaagtgttcagtatgaaaggccagtctgatccacagaataagggtaggagggctcttgctgtaacataggctgagctcctctgaactaacagggaaaatgtgatcaaatgctattgaatgaattccatactttaagaagacagaatactaagggccatgctctgagttcatagcagtagttatctcatatttaataattgacttggcttttaaatactgtcttaaaatatcttctgaattattatgtttaattcttaatttatcctggctttgtactgttagccaacttaattttaaatttcctgataacaaggagtaggtattatatggggcccatgtgtgttaagcctattatgacataaaatatgtaataggaagtcagtaaataggtgccgaataaagtaaacgtttaacagaatatggtccttatatggtccttattatggtccttgactctagaagtcaagaataaggtccttatactttagactttaaaatgcatttaaaatatgataaatgttaacttatacaaatcaacatatataaaatttgtcaacagtagacatgtatcaaaacatttgcaaataggatttattgatgaggaaaattttctgggaaaacatctaaattgctattttagaaggaaaatgattgtaatatataaaatggacatgttttttaaataatgcattttgagtaggagagggtacagaatctaatatcggggccaaacaattttctattcaacagtaattccttttacagtatttttgccatggcccttgtagctgattcttctccaacccctgctccaagtcactgtccagctcaacacgaccatacgaataaccagtacagtagatgaaaataaatcatgtagtctcagaaagtcttctatatttctgtctgcttagtcagtcaatgttgacaacattaatacatagtccagtattgttgtccctggtttcctttgaaatgctacaattttagaatcctattatttcagtgacatttattttcttaggggattggattagggcatgaataagaaggaatattcatcttttccttgttcttttcaagttttaaaagggtttttaatattgttatttttgatgcagattgttatatgacattgaaacaagtcatctgcagtaatttgaatttttttttttttttttgcctttcaaaattccaatcactgtcttcagtaggtaatcccaaggaatattatgataaaagataacataaaaattcagatatgatattcctgttatttagaggttatatttaattttcctgtaagtcaaagtattcaaatatgtttcaaatatatttccaaaaatataattccaatcaaacttaaattggctttgtttatagtcggaacagtctatgttaactacgtttatcccatcttccataacatattaggggaaaaagcagactaagtgttgtcaagtatactcatttgatgattgctgatggatttagttttaaaggcaccttttaatatacaaataaattaaaattctcatgtagaagatattacagagtaaagaagtagctctgaaacattggggtttctgaataatctggaggtcttgttaaaatgcagatttcccttcccactcccagatgtctgggtggtgcccaagaatttccatttctaacaagtccccagctgatgctgaccttgctggtatagggccacaccctgagtaccacttgtaaaaatgatgctcatcagttctctgcttttcttaaggaataaaattgttcaagctaatcagttatatccacaagtacaatatcatttaagagaagcttctagagatctttaaccatattcatatacagctctgctggacaaaccaaattgacttgagttaatgcaaagagcttatctgagcatctttctctccaaagccaagatgactggaatatacctagtcctattcttggaacttcactttttctccaagaatacacaagtcattccctctccttcaagttcaaacttcctactcggctttctcactcctctatgcctaacttatcctttatgtttatggacatagtataaactatagaaaaaagtaggtactaggacccatggcaagtcattaagttgagccacgatttcatcaaaatgtaaaggtaatagtacctacttctggctattgtggatggaaaaatgagatgatatgcacagaatcaagcaccatacccagtattcaggacgtctcccctcctactgcctgcaaaattaagttttttcctatcttcctagaacttctggcttctacagttattgatctccctgtcaactgcattccatgaaattccctgctaatcctagagtgtatcagacggaaactgaaaaagtgaccatatcagacagcattttcagttttctagaaggcagaaaaacacaaaggggataatttgatggctgcttgccagaaagtagcaggacagaaattagagctatggaaatttgtaactgtcttaatcacctctggtgaaacacaacatccggcagaacataacaaatgagaccacgccatgtctgatagtaagttttagactgagggcacattgctgaaaggcaggtgttgttctgatcacctttgtactcactgttgcctgggctattgccatgttttcataagcctcagtagtgcatttggtttccatggagtccatccatgaactaaaagaacaaaacatctaatcccaaagcagaatacagatctcttgtagtttcattcacccttttaaacaatatcacagtaatttttagattcaaataatcattgagagaccctgtactagcagttagggacatgtcatctgggcattggctctattgaacaatatgatcttaaataaaccttttcagtgccttgggtctatggcccatctgtaaggtggacataatgctgcctggctaatctgcctttcattgttattataatacatatcaaattgcattgtagaataaaaatgtcaaacaagggccaatggaatactggtgacaaagttgaatagcactagtaactagaatcaagtcaattatcagctttcaaacataccgaatatcaagaaagtaccataaggccaggcacaatgactcatgcctgtaatcccagcactttgggaggctgaggcaggaagattccttaagcccaggagttccaggctgcagtgcactatgattgtgccactgcactccagctggggagacaaagcgagacccggtgtcaattacaaaaaaaaagtgtgccataataatctcataatgctttcacttcgtattcatgaagctagtaacataagcccccttgataatacagcctattacaaaatcaaagttggccccttctactttggaacaaatgtattttatgagtgctttggttggctaatgaatttctgtagaaagaattttacttttcagttttcttcattttgataaaggagattaccacatggaagaatgatattaaagataataattaaaactcaacaaaactcaaactttttttttttttttttggagacaaggtctcaccctgctacccaggctggagtgcagcagcacagtcatagctcactgtagcctctaactcctgggctcaagagatcctcctgcctcagcttcccaagtagctaggactacaggcaggagccaccatgtccggctaattatttcatttttgtaaagtcatggtcttgctatgttgcccaggctggtctcatactcctgggctcaagcgatcctcccaccttgaccttccaaagtactgggattagaggcataagccaccaaaactcaaacatttgtaggccaaaactcaaacgtttttaggaagaaagagattaagaaggtgggctgccctgggacttactgattgtgtaagccagcattgttggcctagtgagtgttttagcactttcagaatctcagagcccttcacagatcctctgacaggagttgaccctttggcttgagtcagtctacactccacccatcgcaagctcagatagtagaaatttctcccgtaaaaagtttccataatgctacacgcaaacctctagggaacagtagctcctctcttgcctggaagtgcaggctactttctgaagctgccatgtcccacgtggccagtaagtgctgccatgtaaacttgtgcaatttcccagtctcaatacaaaatcaaagcttcaagctttgggagataaaatctgggtttcaagtttgataaaatatttttcacagtagttatctaggattgatcaattctgaaggctctaatttctgttcttcaagctaatttaacacaaggcagcctgaacaataccactcttggatgggcagcctaagaaacagattttcgcaggtgtttcctctgtgctgcaaacctaaatagccccctacattcaatcacatcgatgccagaggcaggaaaaaaactgcaacaaaagaagaaaagagagcaagctcagtaaagctgaggactgctcaagagccgttttgatgtagagatctctgtgaaagctcattaaatcctcagtgtgtgaggcagggcttagggaaaaatagaaatagggataataagacaccatatccatccatactgacatatttgcaaagcattcattagttaaaatcctccaaggaaactccatgtgactcctcagcatattaaggacctgaatcagctcttctggttaaaccacagtccagattaacagttacatactggagagatacagttagtttttgttttgttttatttttcataataccacgaacaaacctattgcaaaagcaattcaaagcatggttcccataatgaagaaccagttgggtcctcttcaggaggaaagatagccccatataccatgaatatctaatacatctgaataaatgataataagtcattagatgacgggtgtatatgagaaaagccaaacttactaagttaggtccccactgcttttattttctggaagacattcataaggaaagatgtatcttcatgcttcagccaaaacccagatgggaataagaccttctattatacaggattccccagagaaacagaaccaatagtgagggggtcaggggaagaggcagttgggagagagggagaaagagagagaggctttatcttaaggaactggctcattcaattttagagtttggcaagtccaaaatttgcagagtagcccagtagactggagacccaggaaatacttgatgttcagtccaaaggcactctgctggcaaaattccctcttcttcaggggaggtcttttttctcttaaggcttctaactgattggataaagcccacctagtgacctcattgtaatttaattacttctttaaagacattgtctccaaatacaatctcattctggggtgctaagggttacaacttcaacatatgaatttaaggggacacaatttcacccataaaatacctcagtgggttttattatgatctagatattagaaagagagagagagacagagacagagacatggggaggttgataaatagcagatgtatttctcaaagcagtgattctcaaagtataggcccaggcccagaagtatcagtatcatgtgagaattggttagaaatgcaaattctcagcccctaccccaaatctgctgagtctgtaagtggggcccaggaatttgtgaataaaccttccttcctggtggttccaatgaaggctaaagtttgaaaacaactctcttagaagttgctttattaaaagaatgacgccacctaagaagttttccaacaaacatgggtgtaaatatcgtttaatctgtgtgttttcattaaatatatcaagataagtcatattttataagtgagccttggatctattttactcttataaattgaaaacaaagccagagctccaaggataagcaccacaacactgcaaagaaacttggcctctgagtacagatttcacagggtaaaagcaaaactgtgagtacccaataaagctaatatatcaaataccagagcagtctaattgctgtctgtctggttggaagcctccattaccttatgtaattcccatgaatggcagactaaattataatggtggtacttaataaaattcattctaccctcttcttaaaaatgaaaaactataaatagaactactgagtggccacttttgagcaagaatgtaatttatattatgtcccaaaacaccttccacaccctcacaaaagtagcatttgcaaatacaccagcattaaacaagcctctcccccatgttctttgagaaactacagtacacaggagcaagaagttttaattcacctgtgagttatttccaagtcttgctggatggtcagatctgtgaacagtcatacacacaaccaacttatctggagaagtcagcttcatccgagcatatattctacttagtggtcaagtacatgtaactaaaggtaaagcctacatccaggaagcttacgtgacttgcgacttgcgtagcgtaggtttcagcacataagatgctagatcagattgcataatgcaacgagagctaacactcataattacttatgtaaattatatggcaagaatttcccaggcctttagggaaaaaatgtttatttgcggagcctaattttttatatcagctatcacgaaaaagattgtcaaggagcatatttgactattggacttggatctagatgtaccctctttgtgacattgtcacataatgacaacctggaggttaatacattaaggcagcctgtatgtgagtgaagcttcagaactacttgaaaattgcattatttaactgtgtccagatggaatagagaacattctcacactgagcaattataccagcaggccattgattgggaagttgatgtttgtctttttccacatgaacaagggcagtcccattgctggaagctagtgctctatcatttttaaataaacagaatgtttgtcattagcattttctaaagtattggagatatctgatctggatttgcttttatttcttcttgatcaaatgaaatctgcaaagcctccatatactcttgtgcaatcttaacacttacttaaatcatagaagctcatagaatcaaaagtatacttttcataagaatttttaaaccccaaaattccaaacaggcagaaataaatattacctagagttcttgcagatttttcaatgaatgccttcctaatcaaaagattataatttaaatattgattaatttatctagaattttagaagatttagagtaatatcaacccagctatgggaaatacaaaaataaatcattaaacaaacattttatgactcttgctatatctcaggaattatactgaagtttgacaaataaacgtctgaccacaaacaatcatagacccctgccctcaaggcttcacagttgggatataccctaagcaatatctatttcagttaagaacacattgggctgcaagtaacagaaaatcctctgtaaacagtagagtaggcaacttgggaattacttttttcacataacaagaagtcagaatgcaacctttggtttgcctactctatgatgccatcagggacctgtgttttttccttcttttcagctcctctatccttagtatgttggcctctgtttccatgattgtctcctcatggtgcaattgaagacagtggctgtcccaaccaagtttttcctctttaccagtaaagcaaagggtttctcagaaatcccactcagactttccttagatcttattaactggagagtcaaagggccacttttatctaaaagactaaatgagaactaatgggacaagatcatcatggctggcttttaagtacaagaatgacaggaaagtaatggtttaaaaaaattaatatggaaatgaaagaggagaaagggagtcagtaagaccaagtggagcattgctaatataattctgtcataagaacaagaaggtctaggtaatggatcctcttatgatggcttagtttgtaatacctttcatgaaagaaaaaacattatggacaggtggtcagatacttcctaaacaacagtcacaagttgcactgcactgtggtgactggtatgtctgtagctgcaggttaagcactatctcaagcatagaggtgacccttggggcaagatagtgcctctgagcttctaagggttacatgttataggtctgatttccaccttattctatacactctctgaaacttccaaagattctgctacataaatcaacctcatgcccaagttggtggcagcagaaatgaaccttaacttagcccaaaagggtttgaagagaaccaagaaataaagctagaaccagatccagcactatcattattctcatgctactttttaaagtcttgtccacattagtcagtgatagaaaactgatgttaggaacactgagcacctaagtgtcactcactctgatctctagttgctgcttctgataaatttcaccaattagcacaggcttagagtcagattatctgggtttgaataccagttctgctacttgatagtggtgtaatcttggggaagtgcttaaattctctgtatttttcaataaaatattgatcacaatagcacctacctcacagaattgtagtgagaaagaaagtgagttaatatttgaaagtccttgaaaagtgtgtggcacatgtcagccctcccggaatgtctgctatttttattactgcagccattattattctggtgtagaggtgaactaccctgctttggaggtcataaagaccttgattcaaatcctgccattatcacttactatccctatggccctggacaagttaattcatggttctgagcctcagtttatttatctgttaaaaagggataataatgcttgtttcatcaagctatggcaagtattaagatggcatgtgacagtgcttagcacaggccctgacaaataagtaatttgtattcttttttatcctccatgatacactcttttctctgggtttatcactagaactcccccgggatgatctgttacttatgactaatcatactctgtgtacttataccactaatattatttgagtgaaacaaacttaaattcagcatcaggaactaccttgaaaggaaaatagactcataagagtagtctcttccagttttgagaagaaaagatgccatcctacaagtatggtaaaggtcttgatgagggaggtaagaccatgacagtaccaccatgccttcgtctcacttccccaccacaactgagtgatctagccaccctctagagttgctaccaccatttgttgggaaggcatgaagtcaaagaaaagtttgagacctgggatagttgtccccatttgtcataccattgggatagctctgatcgtcacattcttagaaatgcaaatactaagctctgagaagatacagtcttctttgtgaatcacctccatcccaatttttgacctcacttttaggtgggatgtatctacagcacagagtctgtgactctgagatacatcaaagactatttggtggcccctcctgaaatcagaagaggatgtaatttgctgtggtttttgcaactctcttacgcacagtccaagcaaagaacattatagttttagagtggatgtggctgtccttactctggtatactcacaggagaaggacattgctgtcttctttccttccatctttgatcacatcactactgtattgtgacctcttcttcccagaagaacaacagttttatcctcttaatcttgttcaaactgccttctaacactgaccaccaccaaaagatgttgcttcgagaagaggctgaatggagaaccttaaatgcatggggaatattcctgagtctcattgaaatcagtttatcctgggtattacacttgaatttaaagcaaatgtatgcacaggcaatcctgggtgagctactctgaacaggagatggcagtagcagccaaggatttgggcagccctttctagtcctaacagaggggatttcctattggttcattgtcgattctggactgcagttttgcctcaccaaagccaaggtggctaaataatatgcccaagatcccagaccttgctgaatttcacaactattgaagaattagaaattgctcaaattgaaggctgaacgaccaagtgaacactgtggggagcttttactaagtctcactacagaggaagggaggaggcctccagaaaacaaacagatatgcccacttagattggcattagtgggtttattggaaggagcaaggatcggagatacagtgcacattcttactgagactttgagcaagtcatttagcgaggtgattcagcccatgctttcatgtggattcagggaataaagaagtcttcctcacaggctttacaaagggttcagtaagataacagccaggaaaactcattttgtaaactatgacatgctataaaaatacaagaaggacattttggttggttttaggtcatttctttgaatttgtcctggcgcctccaaatttcctagaccacatttttttctttccttttctttcttttttttttttttccaagtaatatggtcagaagctgtttgactatgagtctattatttctctgataattataatttcccggagagttatggcacacaaattactttgtaatagctctaaattctttgctttatcctgagtctacaattatgcacttatccatgctcctgtcatctgtggtactgatttatggaacctctgttctctgatctcctcatttcttacctctgcctcctttaaaactcaagaaatgtggcagcaaggtcaaatttctcatcgggccagcattacattctcaggtgtaatcattaccgtcttaataaagcaagcagttagttccacaatggtctgtttaatccactagataattgctaagccttaattatataacccagcatactgtcccttgctataattccagaaccaccatgttgtggtttgaaacatctattaatttggtgcaaatattaattaaaaatttatttctagccaagaatatgatggatcaagtgccatgtattaaaaaaggaaaatataattaatcttaaccaatttcacttggagcaaaaacaatgtaactggaaagttttctggtaactgccacacactcacagacttttttcaaaatttgaaaaaaggtatgtctaaattttaaagtattgcagtatcagtttggtattatggtagaggatttataagccatgcaactgcacaaaatttttgatatcgttaataaggcaaagatatattacttcgctttgttctgcttgtgacctagagtgaattttattcatagcaaaattagaccttactagcttcttatacctgaatggcctagaggtagagaaatttccagaacagccttattagagagtggggtgcatgacaagaccataatctaaagccagttttcagttttattatttactttgctgccttgatcatttttctgcactcatttggcttgaaggcatagacattccctgttgattatctcggcttggcagtgggtttctgctacacattttgattcctaatatggtagtaggagaggattttgtatgagttccagcgagtttctctgggcttgtggaatgcagcaaggaaagaatcctacagagatgaaaacatgaacatttgcattgattaaagagaaaaaggaaagaaagaaaaagtatcactctaaactgttttttttccttttcttactctgttcacttcacttctaataatgtcttacacttttgggggtgggaggaattaatgctgtgtgttcttttattgctcatatcttcatggccatttcaaaaattattttgaaatgctgagtgtgtttacagaggcagtgttaacaaaatagttttcatcatcatcaaggtttgaatccctgaagcaccctatccctctgttctacaaattagccacatgaagaaaactgagagaataagtttcatgttgctaaaagagaataataggctgatcatgtatattcacagggtacaaattacattgtcttaattttgcagcaatatgaactattactaaagaaataccttacttgcctatccatctattgattgtgttggagttcaatacagtttttctctcagggtcataaagccattcacagaatcaggggtgttcaagggcgagaattcagtcatgggttcttagtttgtgtttctggttgggccagtaaagccccttcctcatctctcttttccacttatcactacagatgcagacttaaaaccatggcttcaggctgttcaaagtcaaaaaaaaaaaaaaaaaaaaaacagaacgacaataataacaacaaaataaagcaggttatacaagctcgtatgcatctcagatgaagaactttcctctagtaataggctccttttccctaaatgtatttactgaaggcctctgtattttaataagctatattttcactggttttaaaacttcattattttcaccattattcacatccatttaatgtgttacttttctataattaagcattacatttggcagttatgccctcaaaactgactatatcaacatttaaggtcatgtatttgtaggcttattgggggctgtatcaaaaaaaagtcactaatgagagatcatctacaaatccaagaaattcagcatgctagtgtagatgtgaaagtgtggttttcataatgctccaaatattttctttttctggataacttattttaaggagcccttcagtaaacagttctgatttgacagcaataaccaaccacaaacacaattagtcagtatattagataagcccgagattggttgaagaataatgcaaacctcaaaataacaatgatgtaaatgacatagaaatttatttctctggaatatgaaataatgtaaagataagcagtccaaagctgacatggggtcttcatctatcacaaggaacctaagctgccgtctttctcttctgccgtcctcagcatatggctttcatgccatggacctgtgtggcacatgaggctccagacaatgaagagaaaaagggaaaaataagtgtgaacctatgtcctttactgaaagtcccacatagtacttccacttacatctcgatggtcatgaatctagtcttgaccacctgcaagggaagctgggaaatgtagtcttttattgtaggtggcaatgtgcccagctaaaaattagggtgctaaaactaagggaaggaggtgaaatgggtactgaaggaggcaacacctagttttggtcatggtcaggttctctggctccttgacttgctatcattgtcagatcatacagtgacttagctttccatgcatattcatatttatttatataaatcaaaccttttgtgttttactaacataaatataaatatttgaaacaaacataaatatatgtgtttacatagaaatatatatgtaattgtagaaattttgaaatgtagataattagaaaaaagtgctaagcaatcataaaactcaccacccagaaataagtgcagttaattttatggtacatttttccaggttgattttcatatacacatgtgtatctatatacttctcttaatacaattgaaacatacaaagcacatcatttttaacctcttttttttttagcaatgatatattgaggcgtccttctgcaccaatattcttttcaacattgttttaaattgctatagatcatttcatgatatcattccacaatttaaccaacgtcctattgttggcatggcgagtctgtacaggtctgaaatgttacagtagatagctagtcagacatgaacagggcagtagaaagtttattaaaaagctttagagcagaaagaagtaaagtacacttggaagagggccacacaggtgacttgagagatcaagtccacagtttgaccttttgatttggggttttatacactggcatgcttcctgggtcttgtgtcccttctgccatgattcttcccttggggtgggctgtccgcatgcacagtggcccgccagtgcttaggaggagccagccacatgcagagtgtgtttactggagttgtatgcatgcttacttggggcactcttcccttaccagtcaagtgtccctataaggtaatataccagttaaactccaccatcttgcctcttagtttgcatgcttcagcccattcgcccaactcctgagatcttatcaggaagctgatcactagtctcaggtttttctatgtattgggagactactttccctggggctggctgcaaccaattattattttagagagtcagttaataattgcctgaccatcatctgatggttgcctgacattcctgggtgggggacgggacgatggtctctcctgtcctgctcatgtctgaccagccacctactgtaacactattgttaatcattttgagtttttctgtattataaaccacactgcaattaacatctttgttactaaatctttgttcatatccacaattacttttagaagatagtttttctgatcaaataatatgcatatcttaaagctttgatatgccaaattcctctccagaaaaattaacgttttacattgttaccctactatctgagtatatgccaatacttttgctcagcaataaacatcatataatttttttaaattctttaccgattcaatagaccaaaacatcagcctcaggttaactatgcctttgatcactactgaagtggaacatttcccctgcctttatatttagccttttttattattgtggaaagatatgagaggagagaaagaagctcatgggctcaaatttggaaacactaacttcagactgaaaggaaaaagcctctggttctgaagataagtcatgtatgctaactcagaatggcaacataaaaggagaggttatccttccatttcaagaggcagtcaatgaagttgtcacctgacctcttccaataaggtacccagatattttcctcctttgaagaaagaagccaccatgatcttggctcgcattgtgttgagtttgaaggacactgcttcatatgtgatttatgggttttctcccagcacagtttttcccttgacttgactgtcaagctcttgtctctgtagagtggcaagtgaaaatattccaaggggctcaaatttaattcaagtagtcaataaaccacaagatctgtctgctcaactattttcataccaaataggatactccccatctaaatgtgtaactgagctgaaaacaactttgtgcctttaaatatctgatgttgtgtcatgtttcactacatttaaagccaatacagtaagtagccagatcacaatatgccaaatagctgtttgtagcatttcctgatatttgctaagtagagaatttcaaataccctaggcacattctatttgtgaatgggatgatatattttcttgcttctgtgttgtataaaatactctggagtagttaattctttgcaagtttttaaacctttcctcatggtcaaaagctaaatcataaatcaagaattaatgtaagagaaagtttgaatactctctcttaattcccagttagattatcaggacaaaacttcaggtaattgcatgcctaaatagtaaggtacaaataaaaacaggaagaaaaaaataatcctctaacagcaaaatcaaaaattaaatattgaaccataactctcttttcctctataagcctaacagttcttttccatatatgtaaggaaggcaaatatgcattttttgtttacaatttaggctgggactgctacagtgactcacctggagtacaccccaatgaaaatttagtgggcaataacacagaacaccatgcccataaaattataaaacattattggggtttgcccatcctccaattgtcttgctgaagtctatttttcttcctctataggagaagctatttagagtcaagcatcattaaatcaaaatgcaaaggaaggagaaattgaatgtgggttaattgcattctgaatgcaactgaaccgcagttggtacaaattactggcctataagaatgcattgtgcctaccaggaagacaagtattttggtgaagccggagtatgggtgtgtaccaggaagtggcagcagatgaggattctgagtgtgtttgtgtgtgtgtatgtgtgtgtgttggcaggtggggacacattagatccttgtatgttgtactaagcagttggtactttgtcctgaagcatagctctcccaggagaattgcagctactgtccaggaggatcccagtctatgcaatttggcacactctgtgtaatcttctctcctttatcgcacaaagaagtcctatacctgcaatcttgctagagaagtaaaacctgtattccttatcagtagatctacagggtaataaagggaacactatgatgggagcagctgtaatggaattgaagacctctttcttcttggcatcaactgcctgaagataaaaggaatacaattaatataaataaagggcagaaaggcactgactctaaggcaatgaaattttgtaataggagtggaaagaaagcagagatgaatgagggctacaagaatcacaacaggctcctgggaggaggtgatacttgctgtccctgccagatgtaaagcataattttcagggtcctcaagaattaagtggcaataggactcaaaaaaccatttctccaaaaggaatatagtgatgtgcaaaacagacaaatctctggtctcatggctcaccacagaaaacacaggtacttgtatttttttgcagggccttgttaggttacctgtacccaaaggatttaggtaactcttcctttatatattttccattttatttatttatttatatagaattatttgcttgcttatttacaatttgtttgtttgtttaaattataaaagtaatatgtgtttatgacagagaagtaaaaacagaccagaagtataaagtttctctctcccctgccctacccagtccttccattaagagataaccaatgttaaagtgttgcatgtgcatcctttcagaaatttttcatacatgtgcaagcatagatttatgttatatataaatattatcacactattttactttttcatgtaactgctgtagtgatagcaccataatgctggtataaaagggactccaccagggcaatctggttggaaagatggtcttgaagctccattgcaaaacacttatgtaaaatagaatatcaattgttcatatcaaagaaaggaatgtgctggaaagtggagacagtaaagccccagcaagtaattccttggttttaccacttaaacatttttgtatgatagcacataaatagctgcctacgattccctcgagtgaatggaccataatttattgatcattccccaacagtagacatgcagattatatgtagagtttttgccttcataaacaatactattttgaatccctttgtacaaagcttatacttaggcaagggaacctataacataattcctataagcagaattcctgactgaaagggaatatgcattttaaatgttaatagatgttgccaaaattaagccaattttccagtttgcagttaatgggagaggatgttgttttcttaaggctttccttgtagaaagaaagtgctgagtaatgcggccacagaactagttctgctagcttaagtttcaaagtctacctacccatttgcaactaggatccaagccaggctttacatgttcagctttctctgagcttttgataacgaagctgtttacattagtaatccagctaaactgtggagtggcatagtcccatttacattgagaatcatttttgttttagcttgtgggagtgtaaattactattaaaggagttccatttcaaatccaaagaacattctattgagaagaaaactaataagagagagggaaccacgaaggccaagtctgagctgctgacagcaatgcagatagaaagaaacaaggcaaggcagagaaacaagttcagggaattgaataagaaacggtgtcacagtcacatgatcacagtcatatgatcatgaaacaaaaggtatggtagatatttgcctggaagtcccttaggaaatgatggcagcaagaccagacggcaaaaacaaaaagttgaacatctttgccattttcatttcatgtccaaatgcttcttagaaacatacaaccttattggcattaacattttgacattttatgtatagatcctcttctaaatagagtttaggtttatattcatattattgtagtaaaataacagatgatcactattttttcaaagattaaaaaatatgactcagaaaaatgcgagcattggtaatttagttttgggctttgtcaaatatcttttaaaaaactcagctaataatacactaaggcttctcatacataatttgtattgttgattaaaacctaagaatggaaagaaaaggctaagtctaatttttttgctaaaagaatgagtaaaaagtaatcagccatgttaatatttcaaacagcaaactatttgaaatgcatttctgctttgaaaggaaaatttgagatgaacaagttctattatacactattgataaagaaagaagatataaaaggtacaatatactcttaaaaatgattgcactttcaaggaaacataaaagaatagcttcttttttggccagtaagaaaactgaagccctgtgtagtcataaatagcaaaaatacaacgaaaatcctaatatgtgtgtgtgtgtgttttctcttcttcaagattcctataatatctaacaatgatatatttgtaacttactctgaattgcaaagcatgtatcaattgtcagttatcaaaagtgtctctgaaaatttgaggtagcaaaaaacaaagaaacaatgaacatgttcatttagtcttccctgcttttacaatttgtcattgaaacctgtgtcttcctcctaatcatattttcttaaattgtacttttatttaggatttggtgattgagagtttgcgttttctgtttgctagttgattgcttaggtggccaggtggttggtttctcttcatccaattgcatacaatgtatttctaaaaggatttttaaggaaatgtggaatatcatgtagtaatatgccctgttgctcattcctcctaaatctctctcttatctccacctctgcctcctttcccgcaacctgccttggtttaggccctcaccacttctctactgatgacaacagcctctcaaagcccagcccccttggctcctgccttgacgttactaccaatggcctcatcctaaagcaaaaatctcattatgcctctctcctgtttaaaatatttaattggttttaattagcttctcactaccttcatgatgaaattcgaattccttagaatgctctgcaagccctttcatgacaaggtccaggcctgcctctccaaatggcatcacttgtaaatggcatcatttaccctatgctccagcagtaataacactatgcattcacacaggggaggttttgtgggtgtcagtgctctccctgaactgtcatcatagtatccccccactcccaccccccacttcaacctggagaacctctaaagttgtgcttttctgtttttcttttgcatatcatgtcctgagaatcttgttaaaaagactttacttctgtgggcctaagatggggcccgatgttctgcatttctaatcagttcccaggcaatgctgggaacacatattgaagacaaagctgaaaaaccttactctaccgttactccctctgtgaaaaactctcctgcaaagctgatctacacaaagcgtcctctttctaatgtttatgacttgtatatagaacatgtacaggtcttcttagatgtctcatgtcttatttaattacttggttataggtctgtccctgtaatcacttgtccatcatcaagggctggaacagtgactgctgctccttgtagtcccagcgctaacatttggtccagatgtataggaatttcctagaagtattttgcatggaaattagcgaaaatttttcacttggtgcccgaatgatcatttcataaggtgttgttaaaaatgtccactggatggaaggttacactaactttttagctctcaaattcgtggtttttctttatgttattgacaatctctccaatggggttttggttagggggaggcttaaaagtaattgatttatgattcttttaaccaacatgtaagtcaagaggctggccaagagtttgaagagcccgaacctgttagacagtaaaccaattatctttgtgaccttgtgggtgacttcaccacccccactgcatagcacagccctgcctgtttccaaaacacctggccttgcacaaaagaatgaagaaagagccaaggcacagagaatattctccagcagagagtttgggcaagaagtcttaaagatgtctgagtagagagacaattagtggaaacaaacatctgtccaaggtctctcccatcatgtcatgaacttgacaagaaaggccagcagtaactcttccaaccgtggtaaccaatggccctgaaatgtgttcaatatcaggtatatcagagcccgagagataagagtggttttcaatgctgtatgcacgttagaatcacctgggaagtgatatttgtaaaatatgaacacctgaggccccaccccagaacagctaattcagaatttctgggggaatggccaaggggtcagtagattttaaaactcaggtgattatactgtgaagccagagttaacaaccactgatagagggtagtaccttcttcccctataggtgcctcagaagtgaacatctaacttcagcttacacatcccactaattgaccactgagtcttacttattttaggcaaaacgaaaccaatagaaagttttgccttttctctatgtagaagggactaatgattctataagaatttttaaatttctactcacatttcccatcacacagttgttgagaaattggtaagttgagaaaaaatgtgaggtgtagaaagaaggaaattgaattcatttagaaaagagaattccaaatgagcttaatttccttttttctaaatcttaataatctaccttgcttttcttctccttccactgcaccctttctccatgaattcatcagtcatagtggtaagctcacagtatccggcagcaggtcaggtgggatcacactggctaacaaaggatctgagggtacaatgcagaagttgccagataatgggattcaattacatttctaagcatagacttctccagtgttggctgttacactgcccaatgtggaaaagcactgctttatctacatggcaagtgcttcatacattttagttgaatctgactcggagtacctcaatttttttaatgaaatatttgaggtctacaatagtaagtataaataataatataatgaagactcttgtacctatcacactaaagaaataaaacctaacatctataatcaaaatagcctatgtcctctttatctcctttctctcattctctcctcagaggtaactgttaccttgaatttatgattcccaaccctgttttctcattttgtttgtcattccaatgtatgtttttatgacacacacagttttggttttgtatgttttcagccatataaatggcactttactgtatgtattttgtgcattttcaagctttatataaattgtatcatatatccttctgcaacttgactccatatttcattcttgggatgtatctgtgttgattaaagtaacgttgttactttttattgctgtataacatgccatggtaggtaaataccccagttggtcagctaatggatttttgaattgtttctaatctcttgctgtcacagacaatacaacatagctccttgtgcaaatgtgggtgagtatttctagatatttacataagagtgggattgctggaatgtagggtatgcacaatttttaaatttcctagatgtattaaataacaccccaaccagaagtgtgtgagctttcctattgctcatatccttgccatgttggcactgttagacttttaaatgttcagccaattttaactggtgagttttcccttaaaaaccctgaagagggcagcatatcctggtaattgctgcatcttatacctgcattccagtttatgggtccctcccttctttactggttgaaatcctttgacctcagttactcttcaacccactctctcacctcagtcagctctgggcagtatcttagaaggacagacaatataacactatctcaaagctgaaagttacctccagctttttcattccacattcctggcacacttctgtcctctgacaaggaggaggtagggaaacagaaacaagtcagtctggaattaaaacactttttccagttcaaagtagcacaagagagatatgatgtgagtagagagtagtcttccaccattctaaagcagtggtttgtaatctaaatagaagggcattgcacactatcaaaaactatgcttatgtaaatgggagaaatactgagaagtaggaaaaagtattgcaaagtggtagtagcattgtttttcttctagaataaaagatatttactcctttgccttctcagttacattgttcctggttccctaaggaaaaaaaaagtgttcagcttcagaacatctcctagaatttctctcgtttaataccaagctaaagtcctgccacttccagagttccacagtgggaatgcaaccttcacaaagatgctttcctttaaacaaagcagatgtgaaattgagccatgcttaaagatttgacatggctgctttaggagggaatttattgttagtactttcaaagtagacctaaaaacaccactctgctttttttattcctgaactggattttaagatcgtattgctttaaaataaatgaatgaataaataataacattttattttggggaggaggaagtagaaaaataaatatgaattgttttggaattgattgctattttgagttattaaattgttttcccatccattgtggtagatgaaacttcctccaaatgagatctgctgctttttcattactgtcttgaactcttttatatgctggtgtgttttataaatttctaaggtgcgccatttagagagtctgtgcttctgaactgtttgaccatagtttccttgttcaaggaacacctcactggagttcaaaggtcacactttggaaaaatgctagcatagctattctaaaggtggctacaccatcattactaaccattctggccagaaattcacaagacccaattatatgtcatcttgactgaaattctttcatgatagaatatctgtcttgacatgttggttggtatacatattgctcttgcattgaatgctgttatggagacatttgaagccagtctaatttttgctttatccaatgtgacactttttttgtttttttgttttctgttttttttttttattgttggtggtggtgggtgtttttgtttgtttgtttgttttctcaaattcccaaggaatgtctttatacttgaattgtaagtattcaatcagggctgtgttaagcattctgttaccagtatttcctagaacatggtatgttctttcaatctataaatgtggttattctttctctttagtgaaatttccttgtgtggtatttgtgaatacttttcctgttccatttattgaaacttctccttcagggacatcaatttcctcatgttaagtgcttttgaactccaatctgtcaccttctaattcctttggttcccttgtatttacaagccattcctcgaggccggtaattttatttgcagccatgtttattttgttccttgctctgtcaccttttaaaaattcactctataatattgtttttgtactcagcctccttagttctgtaaccttcctggggttctgtcaactcatctttgagctcttgtttttctgagttcatgttctcattaacttgattcatagtacaaagcacttctgaggaattttgttttgttctttggactatgttttctttaaaagagggagtttcatctttcttttgcatgctatgttcctttcttttaaggttgattggttttgtttattttcatttgggagcattgccttagcatgtttggatgtttgtcactgatttcccccatcttactcatacctgaacgctttatctggatcttctctgttctatctagtataggtgacttattgactcaatttccatagactctaacttttttccccaaagctatggttaaagaacttgattttggataccatccacttaactgcagcctaaggaaatggtgcagggagtagagagggaagggaaagctctgctgaagctgtgtgacatctgagttagaactcctgggctctgcacttttggttgctcgtgctctctctctctctctctctgggatttgttagatactttgaactacattttaatccctctctttaatcagaatacatatccatcctgaaggggaacactctaggattttttaaaatcattcagcaaatttttattgagcccctctcctttgcaaggcacattctaatctaggtgctggaagtaagctgtgtgaacaaatgagacgattcccctttctaatgagtttatatgcaatgtggtatctttaccgatacatgctctgtcagaaagaagcagcccacttctgtccaatagccaatccactacccttcagacaaaaatgagaaaaataaggatagtcatttagttagtttctctccagatctgaagactatagtgaggtcttgagagttcagtaattcaccagtaaggttccaggggcaggaagggagttcagggttagaagctacactgtaccactccaagatctgttcttttgtgagccagcattgtatgtgtgtgtgtctgtgcgcccacacatgtgtgcacacgtgcatgcatgctttgttttgttttaatgtccatattattaggttacagtcttttccttatttcattgctgacttattactagaaaggagggagctagtggttttcattgttggtatcccttgtttttagttctgagagaaagagaaagagagagactctataatctgctttcattctatcacctgagcctggaggcctcaactagttcttttaactctaattaagccttagagtctgcaagtataagacagctgtgaagtagctctgccctcagaattttgtaagtactttaagacatagacaaacacacatacacacaacaaaacaaaacaaaaacataaagctgaggtggtttggttgggttccttgccagcttagcctcttactcttggctaaaaaacatttcaaggacttaaactgtggaatagttctaagaaattgcttagtcttatccctggacactgcaaaatggattgcctcagatctaagaaacccatttatcagaaaaattcttcaatttcatgatatgttatggtcgagatgttattgcacaatcccacagaaatctagtccctctcctaaatatgccgaacacctatacagatggaggcaagcagagagaggaaggtgagagtgaacacttgttcctgaaatctcccaagataccggctctgggttagcattagaaggcctaagcacctggatctattaacctaaatagaaaaaagaaataaccaaatacttgttgaaataaccaacaagtatttggttatttcttttttctatttaggttaatagatggagcattacctaaaaatgagatgaagcatcacctacaaatgtccctcaaacaagtcatacttagttcagattataaagagagtatttgataaatgctgtacgtataagggaattcgaatggcactagcttacagcttcttgtgtcactaccatgcctctaatgcaatttcccccatctagaaatgtaaccctcagccagttgccttgaaagctggttaccgtggagatgattatcagtattatgatgacctatttagaagaatttctgcatcaccagaaaacaaataaccacagagagagcctttcaaatgaatcatgctctttctctgaaagtgcctttacaaacaaatgccatggatgtattgtgtttgtgtgctgtgtgtggatttgttcattatttgtatttgcaaaggttttagtgaaattccagttgtctttaggcatgccaagagtagagagggtagtacaaacaacaggcataagcatatagacatctgtcctcttcctacaatttgaaatgcatggccatggctgtattgatttctcagcaatgttaacatttctttcatttgtacagtttttcttgctcatccactgctttttgaggctttttaaggactgctggaatgtggttggcaggtggttggtaaagactggtttttacaaactgattggccattaatagttcctaaacacactatgactacttgatgactattttgattttctcaaaattatgtcatgaaatattctcttaacttctgtttggtctcccatttttctataaaatagttttgtgtgtgattgtatgcagacctagtgttttgttttttttttaagtttttaaatttgttatccattaatcattgccctgctccttataggaaagactgattttcagctgctgccctttttggttttgttttgcttttgatttttcttcttctttttttttttttttttttgagacatttaatttgcacttgtaaaaatttcagtgataaaaattaaacctttattatgttcatagaagcagcaaataacaatataagccaaatgttaccccaaagaggtcaaacagatctaatattttccttccagtctatgaaggtcgtgtattatggcatttttatatttgttcttattgtattttcaggcacactcctttttctactctcatccttccacccactgtcacttcttctaaggtaatggcaggaatgttcatattttctgctgttatttcatatcatctagcaaagtgctggataatcgatgtttaataaacctgacccctcatataacctcaaaagtttcaaaagttctttaaccagataaactccatttttgtctgttcatgttcacaatggccttccagtctaggaatctccattttttaaaccatgtacaggcagtctgttttccacagaacattttgggtttaagtcaattaactaattttggccccattttcaatttctataccatagacttgtccttatgcccaaaatcacattgctctgaactgagggcaaatatcaaattcatattaatcacctcactaatattcttaggctggtctgaatgctatgtaaatcccaataaaaatcttagtgtgaaaaaattttcttcaactaaatataactccttctctttcaatattttttagaagtacattgacattttaattaacaagttcttacttaaattttaactccaaagagtctagcacaatatatttaagtagtcaactacacagtcagtgtaaaatgttgacttctgtccatctaacacagttgtataggaacggttttacctgcaaagcactaataatacttattggcgtatggcctttgactcatttataccatttcctaaaagaggcatgaaggacacagagagcttttccatgtaactcagagcccataaatggtagctcctcttagaatattatgtctactctcttattcaattattcaataaagattgttaactctccctctaaagtggccttcaaattaagtaaaaagttgtgagttgtttgaatcatattcacatccagcactgtttgattaaaaaaaaaaaaaatagcctttctgaaaccagacttggagtcctaatcacccagaatagttccagacaagattcagaatcagaactctgactctgcccaacaattccactaaattaattcactctgcactctcttgaatggatttggaaggcaaatcatgagcttgctttagagtatttcctctttgtctaatcttcactcctagaaatgatagtgcttagcatttagcacttgcaatccttcccaccctgaagctaaactgggaagaatgagagcagagtgttctaaccttattcataccacaggcaattattcaaggaaaaaaaaaacatatttcacagcctttaattagataaacttgctttgtgaatagaacacaatcttcagaagaatgatgtggaataacttttctccagaaacattccatggctttattccctcttctctaagaaaattcatgtccttaactgctagctatccaaagcaaatgattaacaccccatgtgtcttgcaatattgtatgatagcgataatctaatattgataacctgcagaactgctcactccaggaagctatcaaaaaaatgataagccaagtgaaaaaagtacagccacacaacagaatgttaatatttatgtttctaataacattttttaaaaggtttctaattaatgtaaatatattatgatatggtttggctgtgtccccacctaaaatctcatcttgaattccagtccccataatccccacatgtcaagggtgggaccaggtgaaggtaattgaatcattgggggagtttcccccatgctgtcctcatgacagtgagtgagtctcaagatatctgacggttttataagcatctggcatttcccctgcttacaattctccttcctgccaccgtgtgaagaaggacgtatttgcttccccttctgccatgattgtaagtttcctgaggcctccctaagccatgctgaactgtcaattaaacttctttcctttataaattacccagtctcaggtatgtcttcattagcagtgtgaaaacagactaatacatattaactcactacagttattccagctaataatttttgtcatgttctatccaatctggaacagtacctgttagggtattcctgatgagaagctcagggagggcactgctggataaatcagctgtttacaagtttcattcaccattatgttagtgttcagtgagtaaattatgccatttaagatttccagggacaattcttatgggcctgtgcccaagaagtccccataaggtttagcgccctcactccaacatgctaagagaataaaccaaaaaccatgtattcattaaagaagtgatcattgaggacccactgtgtgccatcaggttctcagctagtgctaaagatatggtgggaagaaaacaataaaaacggaaatggttcctgtcttttgaggcttagagattaggagggaaaaagacatttataagtcacacaaatagaaagaatgaattggcattttataagaattatgaaagtaaactctgctttagaatgaggagtcaaaggagtttccgtgaataaatgatgttggagctgagcttaattgaagaggtatgggaaagggacatgaggaggaggcatcccaggcatgaggcatgaggagtggaacacattcaaagggctaaaaggtcactgaggctggagtggaggcagcaagtgggagcgtcctgagagaagaaactggagaggtagagcaggagccagatcattcaggctctatttgtctagctcagacatgtctgcatttaacttatggtataattactggattaaaaacaatataaggagttatacaatgttttaatccttctttacacaatgtgtataatctaagttgataatgcttatgaatgttgaattacaatgaatgttcaaagtcacaggacttctgtgataactaatattaactgtgtgactgtggagtgataacttttagtcttaagtacctcatctgtaaaatggaggtcatagtacctacctctcagggtagccactaagtcttcatagataaattggaaagactggatggtacagtgcctggtcaaagccttttaaaaattagaagaaatatgcagcacagcccttatacctgggaaagaatgaaccctatcctggaacccagagtttagagggccctattctggttctcgcctagctacactctcaaagggtggagagtcttcaagtccaacagaatacactcacctggaggccacactgaactctgtattctagatgatgctctggatacctgagaccccaaagtttcctaccaaaatgatcccatgatgattcacgaggcctttaagtgtcttttccccaagcatgcaccatctgaagacagatgcataccccatgtctgaggggtggctagggagcagtggtgaatagcacttgtacatacaggcagagtgtcctcaaatgtatatgtgaaacttcttgcaatgcacgttgtagcttagtgtgagaagaggagggggacgggacagggccagaaataaactttacccacactaccaggttctattgtgggaccacagtctgagaattataaatgtaaagctggattctctggtcattattaacatttatttgtcaagatatgagaacagaaaatacctattgccttagtccacttgcattgctataaaggaatacctgaggctgggtaatttataaagaaaagtggtttatttggctcatggttctataggctggacaagaagcatagtgccagcatctgcttctgctgaggacctcaggaagcttccaattgtagtagaagaaagggagcaggaatcacacaacaagagaaggtgcaagagagagagtgggaggaaagtgccaggctctttttaaaactcaaatttcttgggaactgatagagcaagaactcactcattaccataggatgacaccaagtcattcatgagggatccacccccatgaccccatgaccaaaacacctcccactgggacccacctccagcattggggattaaatttcaatatgaaatttggaggggacaaatatccaaactatatcacatatgttaacagttggattttttgtttttgtttttgaaacggagtctcgctctgttgcccaggctggagtgcagtggtgtgatcttggctcactgcaacctccacctcctaggttcaagcgattctcctgcctcagcctcccacatagctggaactacaggcaccagccaccacgcctggcaaatttttgtatttttattagagagatggggtttcaccatgttgaccaggctggtcttgaacttctggcctcaagtgatacgcccgtctcggcctcccaaactgtggggattacagaccactatgcccagcctggatttttattatgatttttttgtttgtttgtttttgttttttgagctggagtctcactctgtcacccaggatggagtgcagtgacgcgatctcggctcactgcaagctccgcctcccgggttcacgccattctcctgcctcagcctcccgagtagctgggactacaggcacccaccaccacgccctgctaatttttttgtacttttagtagagacggggtttcaccgtgttagccaggatggtcttcatctcctgacctcgtggatttttaatttataacttttaacaattagacatatggcacatggacttggatttgtagtgttaatctgggcaagtaaaacagggaggtctgagcctgtgatttacaaaagtctacatatcagagaattccatttcatttaaaccatcttaagatatatggatttcctatttatgaaaatcacattaggttaatcacgaatttccattatgcacaggaagactagagaaagccaagggaaatagtaagttcaaaggaagacagtccctctagtgacctctttccctctctacctaagcataccactatccaaatatcactgaatgtatgtcttatgaaactgtatatctctatgtagaggtggaaggagaaaaaaacatgaaagatgatgtttagaattaacaaaacgttagttctctagctgtaaaacttgtttgtactccctgactataaagcctcaaattcaaattgagcatttccagctgagtgaaaggtgcctgcctgctctgagttcctgtcacagttattgctgtacataagtcatttggcaagaaaacacacacggtcttaggctatctttcctactacaaaaaatatggactaatttaaatataacttttttaggaattgatgtcttctcttcccaactgaactataagttctttgaagaacaaattggaatctgctgttttctgtatgccttcattctcttgcagcccctaagagttgcttaggaaagccgggcatggtggctcatgcctgtaatcccaggactttgggaggctgaggcaggaggatcacttgagttcaagagtttaagaccagcctaggcaacatagcaagatctcatctgtactaaaaatcaaaagaattagccaggtgttgtggtgtgcacctgtagtcccagctacttgggaggctgaggtgggaggatcacttgagcccggaggttgaggcagcagtgagccatgattgtgccactgcactccagcctgggcaacagagcaagactcttgtctcaagactaaacaaaacaacaacaacaaaagagacgctcagtaggtatttatacttaactggttcattcaggtatctagcaaatattgactggattcccaccatgtgccaggctctgtgtcaagcatggggatacagagttgaacaagacactggctgaaagataaatacctggcacataacagacactcagtgagtgagtgaataaatgaatgaatgaattctgtaccacaaagttaagagaaaatatcaagaaaactggaatcaccatttaagttgtcttacatccgaagttatcaaggtgaaagatgtcagcctggcagaatgcccacaattctagaaaatctggggaaaacaagacagtcctagcatttgttcctctggatcatctccatgactatttagtatgtggtgctagaatcttgcaaagaattaaaacttttcatagaaaccaaattttctatataagaaatttaactaatacccccactctcacttctcagagacagagcagtgtatgtcaagaaatttcttttgtcaaggaaatcagtgtatacaaaatattattgtattttttactgagatctgaaatacgaatgtgtggtgattgactttaatcacaaatttgcttcataaaagtctgtggaatcagcacagaattatattactccatgtcattttcctatatatggtataatattaaagccatagtttattttattttattttattatttatttatttatttatttatttatttatttatttattgagatggagtttcactcttgttgcccaggctggagttggagtgcaatggcacaatcttggctcactgcaacctctgcctcctgggttcaagcgattattctgcctcagcctcccaagtagctgggattacaggcatgtgccaccacacctagctaattttgtatttttagtacagacggggtttcaccatgttggtcaggctggtctcgaactcctgacctcaggtgatccccctgcctcggcatcccaaagtgctgggattacaggcatgagccaccatgactggcccttgagccaccatgcctggccccatagtttatttttattttctccttctaatattgtaagaaaactagattaccaaggtagaagttgatctctccctcaaagctatttatctccttgatgtgcagtatgcaaactgattttaaacagaattttgcagctttatgaaagagaatcacatttggtcatcaatgaattaaaatgaaatatctctctggaaggataaggaaaatcaacattcaaatataaaaatttaataataaaccaactaacatgttcaaggtttctctttttaaaaaagggcctacattattaatactataaaatttcaaaccagatattatagatcttaaaaaaattgtcattttttctttttttttttaattattatactttaagttctagggtacatgtgcacaacctgcaggtttgttacatatgtatacatgtgccatgttggtttgctgcacccattaactcgtcatttacattaggtatttttcctaatgctatccctccccctgccccccaaccccacaagaggccccggtgtgtgatgttccccttcctgtgtccgtgtgttctcattgttcaattcccacctatgagtgagaacatgcggtttttggttttctgtccttgaacattatcactttttctaatgggagaaaacaactgcattgttcatcctcttccaagtccataggctcaacaaagtcacttaaggttaggaagggggtagcacagggaaagaaactcccttaaaaaaataagtttcttttcttttttttccagagggagtcttgttctgtcacccaggctggagtgcagtggcacaatctcagctcactgcaacctccacctcccaggttcaagcaattctcctgggccagcctcctgagtagctgggattacaggcgtgtacaaccacacccggctaatttttgtattcttagtagagacagagtttcaccatgttggccaggctggtttcgaactcttgacctcatgatccgcccatctcggcctcccaaagtgctgggattacaggtgtgagccaccatgcccagccctattttcttttttaagcagagaaagaagcactgagacgttttcagctaagaaaacttagaagcattacccaaccccctaggaaatatactcaaaaactttgaaaagtactagaaatagttcaaaatgaggaaatgagagtgatttttttcactttttagaagcatttccaggtctccctcagttatcctaagattatctcagtccatacactgcctaattcttagatggcagaatgtttaaaaaacatgcagatatcttaaagcaagtgcgttcaaggaatagagagttaatgaaagtaaaattgattctggccaaaccaattgtagaactgagtgagcctgagtaagccactgaagaccaggaacccgtgtagtcatatgacgtataagataccctctattctcacattgttttcattttgtactcatgttaaattgtctggggactctctctatgtggataagaagtagcattaatttgtcatattacatgtacatttattaaaaatcctagcagcaatgttaccaagtaacagtgttactgatattatttcatcaattagaaatgctgaattatttttaaagaaaaatctcgctagtgacctttcatctgacgtaaataagaggcttaacctatatctcaaaaaaaaaatcaagtcaaatttaccacttgtaattttgtttgcattactgaatcatttgacttgtttttgtctctgtgtttgttagtcagctcatacaaacagtttatcctcagtcattccaccaagctctttgcagtcatctagaaagaatcagacattattactaccattcttgtttacccttcctgaaagattttccaaagaaaaggagaaacaggcttgaattatacatgaagaatttcaccataaaatctgaacaaaaaacatccagattatacaaacgtattgtacttgcccctctactaagggtggtgctccaaccctcacactgatatgtcaactgcccataaccatgccccacctgagaattctttctttgccatatccttgttttccagcttttgtatatgcatccctacatttttagtcaagaagctggcagtcacatgctgtccatttgccaatgttggaaatgactgttggaattcaatggtttcccccaccactaagaaaaatgcttttcatttaattcataataacaacagtttgcatttatgttttttatctgtttcaaagcactcctctgccaccattaatgaactaaatcagcctttgctattttatgatctgtctcattaaaatggagttgattttctctgtggtagtcacttgcataatgttgttttcttctagcaaaccctgcacttaactaatgtaaattcatttttaaattgtgtgtttacacagaaaattttccccaaatatatttttaatgctgcatcctttcaacagcattacagggagtattttattctatatagacattttaaactataaagacacttaaatgctttaatgtagtcttctctaagtacttgtaaattatttataaagaccccctcaagtaaatgtgttgaaactgccagtggtagaaacagaaattgtttgctctgtgagccctattaatacttaattatttgtatagtattaaatgattggcttactgatgaactaaggcttaataagtgaacaagaaaacttgcagttggcaaagaaactctgaatgttaaatttattatggtttaactctgtctctgttactactggaccacttatacaagtgcctgatggctcattcctagggatttgatctaatgtgggaggaagatgtctctctgcaaataagtgcaggcacacacaagtttaggcagagatggtgttctagtgactctaggttgagaaactataaatattggttggttgccgcccaccttccatcctgccttcttttaggtagagacttctggcttctgcttgaggaaccaccctatcctactctagccttgtgcttagaataaaattgagcttacccccaattccaaaggtaggtctacctggccttcctaatgatttaaagatagacacataactcaacctagctcatcacattcttttagacacagggattaatatagaataagcatttcatctatgttagtccaatcagaatacacttaggacttgccctgggaattctggatgtagactgtcttttcccttgggtggtatagtgtgatgatataagacttgtagctggtgcagtcatttgcatccataagaggaaagcctagaatggctggaaagcaatggctgggaccttgctgatactgttggatttatgttagatagggaacagaccaaactgctgtaacaaagagattctaaaatacagggactgaaaaagataaaatttcctttttagattctttttttgtcttttgttttccttttagtggagaatggggtcttgctatattgcccaggcagatctcgaacttctgggctcaagctatcctcccacctctgcctccctaagagctgggactacaggagtgagccactgcaccctgctaaactttttattttccttacgtctctgtctatctacctcataactatatggctggccaagagtgataggcagtttggggtcatggggtcagttagggacccaggatcttcctatcttgttgttctgctgtcctgctagggtattgtcttcatgttgcaaagccagtgatgcttcaccaccctcccatcacagccttgtttcagttacaagaaaaaagaaaggaatagtggagggcaagaagcttcttctaatgcagggcttatcaatctaagctctattgacattttgggcctggtaattattttctgtttggggttgtcttgtatattgtatgtttagcagaatccctggcctctagtgcctaatgcctatagcatccctccctctctcctagtaatgacaatcaaaaatgtctcagacattgccagctgtctgggagggaaaacagccccccgctgagaacccctgctttaaggatatctatggaagttatacatatcacttccctgtaagagtcagaagataacatgtggacacactgagtcataagacagtctgggagaaatatttctagctgggtgaacttttgcccaggtacaatttcaggggctctattgctaaaaaattagggaaaatgaattttaggggacaattcaaaatctcttccacacagctgtacttttgaagctttctatcatattagccagtaagttacctttacaatttaaacaatttggaataggtttttcggtcacttgaagttcagagccctaattgataccagtattattatctttatccaacactgtaagttgaaaatagtgaacattatccaaagaaaaaaggataaaaggaataatacctgaagatactcagaagctgggtactggctgagaagggattgaacaaaacagcagaaatgaggctgtttcttatcaagagaaatatggtagaaacggaaaggccatggtcacaggagcccacggtcactgtagtagttaagaaaaaaggcaatataattatgctaaattaccaaaatgaaaactgcaggcatcttgcattatttggctttgaactgctactttctagttctcattgtaaatacaaaaagcgtttagtggctcccttatatctcacacaaaaggatcattgcttacagccagctgtttggcaattatatttctatgaagttagcataatttgagattagaactgcctgagaagaggggggtggtgataacattctagtgtattgaagtagggtatggaatagtgatggtggaagctctgattttagaagtgaatggcctttccaaagttcatctcgaagccaacagttctgaattcaaaacatattttgccataggaatcttatttttttaagttattagattagcacaggagtcctccaataccagaaaagaaagagacatgtactttacggtagtacagaagaaaatgctgcagggcaaaggaagatttgtctgaaggttcagactgaggaaatcattagtaaaatcttcagggaagtggtgacttttaaactaagctttagatgaggaaagagagaaagggcctttcagggtgaaggacggccagttcaaagacacagtatttaaaattctccatgaggaatagtaagtgcctaccatgagtacagcataaggtttatggagatatgacaataagttaggacggggctgtgaatgtatggtggagtttggatttttttagtccacaagccactaaagagttttaatgaggaggatagtatgatcaaatatagctttaataattacatgaagaatgctttgaaattgaggacattactgcaagagaattggatttctgatcttgagacatggcagtgggttagaaagagagaaatcaccagagaaacaacgtgaaggtaaattggcatgggaggtagagaagaaagaatcaaatatggctccaaatttttaggtctacgaggttggaatcatggcacaaggataggcttaaaaggaaaggaatgagctcagtaggtatctgtctgcaggataagagaagagttaaggtggtcatggccttatcgtatagcatatgggctacatttacatttctgcaaagcttgcccattggggtccctataattggagaaaaatcacttactgaattttgtacctagttccagtcttcctccaagtttactttatattatttgtttgggatatagctccacatgttgaaactgtgcctctaacaccagtgttggtgaagacattgcattccagtgccagattctgtggtcagaaattttgtttaacagaggtagcaataatattggaagcataggttgcattgtagagtgtctgagaaaaggggtgcagagaaaaatcctatcaaacatgtgttaaaataatgtcaaatctgatatactcataaaaacatgcccttgaacatcttggggcagaggaagggatgggagagaataaaggaggatcatctcatgctcaaagagagaaaaagaagagagcaaaggagagtttcgcaggaagggtactgtggaaacgccagcaaaggtgggatcaggaattatctggaaaagagagaatttctggggtgtcttttgatccacatcctacttccttatttctattccatccaggcagttgaagtcatcaaaccaaccaagcctttgtatagcatggtaggtgatggagaaggacagtaattggaacagtaaggaaacagaggcatatctcatatgccatatatgcctgtatatcatatatcatctcctcttactccctggccaaaaaaaagatggcagattcattgtatccaggatatactgatggaggcaagtaggatggaatgccatgcctgaaggactaggtggaggtgatagttcatgccacctagagctagatattggagcatcagggctagatcaacgtgctaggtactgattgctggaaggaacccttcagaaatgaaactcctaccaattaatatgagagatctatgtttcactcaaagtttatgccagaataggactaaatgaacaaaaaagaatggcaccaggccgcaggtgtctgccccatgaattgtattcagaaggggctgcccatttggcagagttgtagaattgctagttcatctttagagttgctcatagactggagctgatcaagtaattacaaaaccagtcaaacaaggtctatatcctcttccttgaaaatagctagtgagaccaaagtagtcatctggtcaccatgctaggatcctctgcttccctctcacatggcatagtcagtgttctaggtctccactgtcttggagctgaggaacaatttgatttgatttggtaagtcatatccccgtagctttaacacagtgacttcctattcctcattctgaataggaaagagtttggggtgcagggtagttttacagctaagtggaaaccagaaagaagaaaacagacagtatagagttttctcagagtagaaaggagtcacgagaaaaagtaagggaagaggtatggatattacctcactccaacaaccaatacatactaccacatctctaacaaaaataaacctcaagcctgagggattccttttctctaattcctcattttcagcagaataaggaaagtagatacttcaggcataatatgcctaagtgtatcaacattagctggcctcagaatctggaaagaagctcagtaaatcagttttgatttacactatcctacagcctcagtaataagattccacctggaactctgagtttaacttttcagctgtgtgtaatttgatctattgatgtcaggaacaggagcaaactgtacaggatgttgaatcagtttcccatctcacgctgcgagaccacctcatataggtggtaatgaaagaaatgttccctttgtcttttatctcatacatgatgacattcttcaaaatgaaccagttgtttagagcgggtatgcttctttccagaaataaattggtactgggatagcttggcttacttgtgcagcaaatgggaagactctttcccatttgctaatggtggttaccaattcagcaaagtgagttgaaggagagtctgattcacagatgctgacttagatgttagccctctcataaaaccatagtaataattaacaatgaaatgtgccagccacactttgaatcactttccatgtggtaactcaatttaattttaacaactttatgagctaggcattatcattttcactactttacagttgagggagttatgccacaaagaggtgaaataacttctccaagaccacacagctagaaaaaagcagagccaagatccaagttaggttggctctagagtctgtacttgtaaacactgtactaaattgtctctctgacatatcacaaagagcagcaggtttggagtcaggatagactggcttgaattctttaaaaaaaaaaaaaatcagcctttctggctgggcacaatggctcacttctgtaatcccagcattttaagagtccaagacaggtggatcacctgaggtcaggagctcaagaccagcctggccaacatggtgaaaccccgtctctactaaaaatacaaaaattagctgggcatgtgcctgtaatcccagctacttgggaggctgaggagggagaatcgcttgaacctgggaggcagaggttgcagtgagccaagactgtgccactgcactccagcctgggtgaaagagcgagactccatctcaaaaaaagagagagagagactcaactacttttttaagataagttaaacaaaagaagtgaagtgtcccatgtcttgcatctatttcattggcaagaaggattatctaaatgacattgaagacggggtgtcagtatttagatgatgaaggtttccatgagttcttgttttggggaacagaatgaatccatacatgagttcctgttttggggaacagaatgaatccatacagttacagagatatagagtgcctagagacagtagcccaattttttggttgcaggtttcctatgctatttacatgtttcagaaaacctagtgaatgtttagatgctatgcatgttgtccagcagctgtactcaggaaaagcaagagcaacatttgtgagtttcattacatcttattttattatttccataaaattgtgttttattatgcaatcacaaggacttctaagccaccaagagactgacaaggatttcgctttgcagaacaacccctaaaacagaacaaattcaattatccagaggcctattttgtaggagaggtaatctttgctttagaatttttaaaattgtattcttaaagcacaaatgtgactcataggcaggtgtatttccatttagagaactcaaccagtagctgaggatataggagcaaggtctagatctcagaaaaagttacgaacaagctaagcaagagattagggatatcgctaaagggacccaagttcaggacgagacttcaatacagtgaaagaactagaagacacttagttccttggcaatcaagactggagaaaatggagactcaatctaagacttcagattgttgggctaagaagatgctcaaatgtgcccatcccaggtacataacatatagtctaggcttatcgaggcacaaaagctgataaagaaccctaagtttcttccagcttttgttttgactaagttgggaattttgcctgcaacgtaagtgctttggtacctgtatcagggtcaatctgcgaaggcaaagaccgagacttcccgtttatagcagttccaaacctgctccgctttcagccctgttttgttgttgttgttgttgttgttgctgctgctgctgttgttgttgttgttgtgagattctgcctctgttgcccaggctggagtgcagtggtgtgatcttggctcactgcaacctccgtctccctggttcaagcaattctcctgcctcacctttggagtagctgggatcacaggtgtgcaccaccacgcctggctaatttttgtatttttggtagagatggggtctcaccatgttagtcaggctggtctcaaactcctaacctcaggtgatctacctgcctcggcctcccaaagcgctgggattacaggtatgagccactgcacccagcccccaaccctctgttctcttttttatgtatcatgaaatagtagaatacatctgagtcatcagaactgacagcctctgcttacaaaagcaacagatcagcaggtcctaagttaacgctttgacctcaccgtctacctctcttccccctgccttcattgtttctcaaacatgcagaaggaggtgcaacttagggcctttgcaggtactgctccttctggctggtacaagcatcaccatacagccaaatgactggttctttcttgtctttcagttcttggctaaaatgttgccttctcaatgaggactttcctgatcaaccttttttaaattaccctattctccccaaggcattaataacatcatgtcagagctcttagcaaaatctgaaactatcttgttgggttttaatttgcttactgaaatggcagatgtgcaaggttttttcttatcacttattgtgttaaatgaatcaagatactcagagtgcttctcttgagaaaacctatgcctcacttaggttgacaaagtttcaacacatgaacacaggaggcatatatagtatatacatgtatttcatcagtcccaaagaacaactggcgacatgactagctttataaaattgcaaggcgttggatgggggagctagggaactttacaaaacacacaaggtctctgaaccaaaaatcaacattggctgtgaacagtaacatggattatcagtgacattttttgcttccatttacaactgtttacagtggatttttttttaactgaccaactctttagtttgtggagttggttttacatctctaggcctggtttttaaagatattcttaattttgatgaaaatcttcattatgatctcctggactggatgtaacatttaaaaaaatctcctaacaacatatatcctagtaatgcagtctctggggtagtgggaaaaagtcaggactgggagtcacaagacccaggctgaggccctaaataagttccacttattcaacaaaaattgaatatgtgccaggcactgttttagcaaattcaaatagtgaatatgacagacaaagtgtctgtcccttaggaattatgttctactggggatagggagagggtgataaaaatacccttttttcatctgcagttttctcttctaaaaataggtgggcattagactagatcatctggaaagtttctcctagctctacatgttccgagagagaggaaagaaaatttgaaaggcttcgcagtagttattttagggaagtaaaatcctagatttaaatttttttttctttttggtcatcattgctttctgatattttttctataatgaacatgcattacaatatgaaatgaaaaaatgtttaagaaaaacagtagagattttcctttcaaccgtgagcattggtttctagtgacctgaaggtacaacattcatccattagtaatgggagctgtaaatgggaattgtcttgcctctccagtgacttattaatctttgcctaatggggctttagggaacctgctcaggggatctttatgctccttttcccattacttcagtgtgtaccggtctcttctcttttcctcgaacacttgaagttcttctccacctaggaatatttaggctcagttggcctcatctcacccttcaaccttcacatctcagcttaaatgttaattccatagatgccttaacagagcaatctaaaacctaaattcccttcctactttactactcaccatatcatccttggtatttcctatattatctctattctgcttttctcttacagagcactcttgtcaacttgtagtttcatgtcttttgtttctatataaacttagtctattttcccccacagtctgaagtttcattgtgaagacagggatagtctgttgtgttgaggctatattcctagggcctaacagtgcctgtcacatcatagatactcaactaatattgatggagtaaatgaataaatgaatgaatgaaatggctcctttgtcctctctctgttaagtgttttattcccatacagtgttgtgctgcaggcaagccctttgccagctcacaagagtgaacggttaatttttcagggattttgcaagccaattgttaagcttagtggcttgacattggccttggttggggtatatatataccatagacatagggaaatgctgcatgttaagactttttattcccacaaagagctggtttaccagcatacctctactctcatcttctaaatcaaactataaatattgagctatcatgcaaaatcatgcccataggttatttaaaatatttcaataaaaaagtattgaatttaaaaaatattaaatacatgctatataattatttacctgtgggaaatagttcttttataagctaacttataatctaaaatatgtgtctctgatctcctaaagtttgtttcctgtttttcattcagatccttatgtgaagattcatctgatgcagaatggtaagaggctgaagaagaaaaagacaacaattaaaaagaacacacttaacccctactacaatgagtcattcagctttgaagtaccttttgaacaaatccaggtaatgtcaaacataactttgtcttcccactcaatttcattccttcagaccacataaattatacacacagaccttgtaagttatcagtgcacatgccttcattagaactgccattctttctccccatgcacatttgatgcttgagctacatcaggaaggataaaatatacagcacaggatgtgctgactcatcagcccaaaacagctggcactgtgttgagcagaaataaagtaggaaaaagaaaatcaacagaacaactctgctaactcaaaaagtgcatctataaaagttaaaaagcccagagaaaactatgagctttcactatttactcccaggccataaataagtctccccatgagatctttagagcaaaaaatagtgataagagaaatatttttggttgatgctaaatatgcagcatattgagtctttattaaaagatgattaacaatagaaaaattaggctaagttgtgttttcaattatttaaatccagcttcctgtgtctgagttggaatggatggctattttattaaaaatggagccttaatatgccagacaataattatgaagggaaatattctattaaatatccttgtagttaatatgttcatattaagttgctatatgtagccacaatgataacatgcaatcttatcatttaggggtttttgaaaatatttacattttctcaccccatctccatagttagcctataagaatctaaagataatatccaataattttgggccatttcttgcaaatctttaatgggcatcagagagtcaaactgcataaagcaacactatttttacattttattaaataattggcgcaggtgtatattttcagtgatacacaagtttgcccataacttgaaggaaaaacaaagagcagacatcaaacctacaacaaagaaccttctaaaggtccagaataacaaatactctttatttattttattttatttattttaattgccaaatagtagttgtacatattcatggggcacatagtaatgttttcatatatataatgtattgtaatcaaatcagagtagttagcatatttatcatctcaaacatttatcatttgtttgtcttgggaacagtcaatatcctacttgtagctatttgaaattatatcatatgttattgttaactatagccatcctgtagtggtacagaacactagaattcattcctcctatgtagctgtgattttatatccttaaacaaatctctccctaccttccccttcccagtctttagtatcctttgttctaccttttatttctatgatatcaacttttctttagcttccacatgagtaagaacatacagtgtttactttctgttcctggcttatttcacttaacataatgtctgccagttccatccattgccacaaatgacaggattcattcttttttatggccgaatagtattccattgtgtatatgtaccacattttatttatccattcatctgttgttggacacctaggttaattctgtatgttggctgttgtgaatagtgccataccactcttaatatgccaaattgtgtcttcatttacctttaatctattcttagaagacagtatcttatgaattaatcacagctttattccaagaagaaagctaatataatagctacacttattttatatatataaaatatatattttatatatataataagtatagctatataatatatacatatataaaataagtatagctattatgttagctttcttcatggaaacattaatccaaagacatatatatatatatatatatatatatatatatatatatatatattatgcctaggtccaagttaaccactttatgtatgtaatctcatttcatacttagaagaactttatgagaaaagtactattgttattatcctaattttatatgtgaaaaaactgaggcttagaatttctttacatgtaaaataagaatgataacagtccttgtcaaagtgacattatgcatataaaagcacttggaacagcgcccaatacataggaacacacagtaaatggtcctgtcatcatcatcattattattcacatgctaatgtcctctctttttcaagttaacattttattagaaaatagatctaacaataagattaaatcagtatataaatcagtgctgtctaatagaactttgtgatgattgaaatattctatcatccatgctgtccaataatatgatagccacagctggccaatgagcacctcagtcactaatttgaccaaggaacgttatttaacttccatgtatttaaatttaaattgatatagctagatgtggctggtagctactctgtagtatagggcagtcttaaatgaccaaaaataaccaataactctaccatctttgtattggttgatagttttaaatacaacctttatcatataaattttcacatggtgtcaaattatacatacttatttactttcaacatctgttacataagtaaatgcagaggacactggttccctgttcccaataactttttcactagcctgaaccagcgggccccctgctttggacccactcacaaaccctcaagacatcaattttttccaacgatttattttgcaatatttattcagtgaacttttttgagttctaagaccttattcctatggaaactaacacctcctggcatttaatttttttaattccacaaaataaatataaagcaaggcattgagatgaaaactcccattgagctacaattctatgcctttaaaataaatatccttttcaactacaaactgcagaaaatgcaggtatattgaaagtgaagcacattaaaaataagacacatgctaggtttctggggcagcatttcagaggcaatagcgttttgtcaggacagacagaaactatgcccaatatagaatacattagacatggaaataatgagcattcctttgactgtatccctctttctctgctccttgagtcactttgttcttttttttttcctttttttataggaggcaacttttctagtcttcacctttttctagaaaaaaataattgagtatttcacatgctaaaatagggtcttaagtttgccttatcctgaggttataagacaatctgcctgtccttctgtctttctctatccctatgaaatgtattatgaaagaagcaaaatatgctaatttccaaatgcatgtgagaatgtaagcccttctcccccaaatgtagaaataaactacatatgcagctggaaacattaatccaaaggcttcacaaggatattttgtcttgaatgctactaatcaatgcattcctaagtggaataatcaaactctaaaaacttctgttacctttgtgtgtcatgtcccccaccccattcattacaatatgattgcttcctgataaatttgcttagaacaagctctaagaatcagtatagccctcttctttgttccagaaactatccagtggatagttaattcctttcacaatggaatcactccaagggaagattgtccgttttattgacaatgtgttgcatttcacattctaaattccacttgcagaagtgattgttttctctgctctgaagctgtatatcaatgacatttctcatttcattaatataataaaccagtctccagcatataaagtccactaaagggccctaactcagctggttcttaatctggccctagcttttataattacattttctgctactttcaactctggcaataaatgttacatattccatttattttaaactcttacctttacactcagctgctagattgaaaccatcacatattctgctaagtaaattcattacttaggaagtagaactgaaatttgcttttaaaaagtatatattttataccataatggtataggtttgctttcatcagttcaatcattcagaaaaggaagtcatcaaataaactttcaaaatctgatggaatcattgaataaatcccgtgtagcctaaactgatatttccatttgatatcaatgccagatacattgtagttactcagtaaatgtttactaagagaacgtatggatgagaaaaaaatatctttattactactttttaaccatacttttcactatactatcatgttttatgctcacaatcatatgattagttgaaattctatattaattctatattaatttttttgtaacatgctgtccccccacccttaaaatcagattattgcacatggttgccttgggaattgtaatcaaatagagtgggctgaacaccaatgccagaactttcactgataagacaactgaagcaaatgaatttagaggttagcacaagttgacacagactccatggcatggaggttcacagcataggctctgaaaaccaaacaactcattccttaaacaacctcagacaggttatataacttctcagagcttcaagcatccttacctgtataatggcaatattaataggatctattatgagaagtaactgagttcattcatgtaaaagacttagtgcaaagtatataataaaaattaacgtttgagtattaagattcaagtcattttcatcctcatcctagtgcttggagattgattcttctatttccaattctttagcgctcaaggacgctttatagtcgggccttatctctagagctagatgattcatattcatttcatggcttctttcagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttga

SEQ ID NO: 2426 - DNA, 587341 bp, Homo sapiens
ccaatcaggatgctggggctcggagatgatgggcggccgcctcctcactggagggattcctggagaagctgcagtgtggggatgctctagaccgagtactgcccccagtgtctttccacctcctcctgcagcagcggcagcggcagcagcagttagcagcggcaacttgaggctgcaccccgggcaagtccccagggtggtgctcagccgagaggggggcttggcgccccgaaggggtgtgtgtagggtgggggcgaccacgtgggaccagctggtggccctggaaaacctcccacacacccacacccacacaccccttttgtgttgcaggctgcccctccaagagcggaggcagcgagagtacgcgtgtgcctcgcgccggtccacgcggggagagcactggggaccgagacccggcaccacctcccggtccgccctccaggtaaggaagcgggactggcggcgcggccacctcggcggtgcctatctgctcgaatccatcccaaagattttcttctcgatacacttgggttttagtggtgggagtctgagacctagggagggatccccgggtggcctattgtgagaaatatgagactacatgtgcatctcctggaaaagcactttgcacagcgcccgtgatttagagcctggagttgatgttgggcatcccccatcttcttgcttcctctttccttctcttgttctctctcctccgtcccccacccccaatctcaatcttttctctctttctctcccacacctcccctctcgccctcctcccaccctaagcacgcacagcgtttctttctcctcctggagaggattgcctttcttagaggaaagagggggagtgaagaaaggagaaagatttctttctgttggggagagggatatgggggggggggggaacgtaaacaagatagaatacaagctctgcgaaaatcagagcacataaagcaattaaactgaataaggggagtagacaaccagtccagcttgggctgtcagagagaggaagcgtcaagtttgacttgatttcctccttgcaagagtctatgtctctcacttgattcgttcaaatggaacaaaaataaaccgacaatccaacccactttcaactgcttaattgcttttgcttttgagtgccaaccatctgacttttcctgtttccatctgtcctgtggggctaacaatttggtattgcacatcagtgttaatatctgaactttgaaagctttcttgagtaacaaaaaaaaaaaaacaattaaaatagattattactttcctgaggtttcttggtatggcctgttgttgggggatcaaaaaatgtaaagtttcaaaacatttgcaagggacaacaattttatagggaggcttggatttctactttgagaaagctaatcttctagttagctttgtgtacatgttgatattcactttctccagtattaaccctttcgtgaaataaagcaactgtttaacttttgtatggaagctacatttgtgtagaattttcactttattctacctttgtactatttgcattttattgtctggataccaaacttatgcctggctttattttcttttaataggacaatatttaatggatgtaaacatgatgtttatacaatttcagcactccctttagaaggcacatggaggctcagttggacaagaatcctcctgtactggaactaagtttagaaagtaatgctagaaagataccctaaattttaaaaatcctgaaggggaaaacatttttgtaacgtcttgttaaaagaaagaaaaatatatcaaaacaccaacatgcccctggctgcctgcataataggtcaagtaaatggtacttgttggacagagcctttacagcagcttcagcagtctctaattccatcattggggatataagctttcttttcttattattcttcagggacagctaagcgatagtactgtcagatggaaggaggtatagagaaatgcctcgtttgatgtaataggaaagcattccaagtgggtcttacctgaacacagagaaatccacagatgttagtatacaaaacacttctttttatttatcaggggaaatgcagagtcttacttttttttgtctagaactccacttgatataagaaaagagaatcttctatcttaactgtgtctgaccttccacactaattttgtatctcagagagtattttttcactacgtacgtttaatatataagtttacacaccaacttagagaagagctgaattcatttgccatcagtgtaatgtgtactattttccaaaccattttgcatttgaggcaatgatctctccctaaatagaattaccaagtcacgaaaaacgattttctttctagggctttgacatttaaatgaaaaaaaaaaaaaaatagtgtctctgttgaaagctaactctggtttttagaggtgccaccttttggttacaaggacaaagggacaatcacttaattacctcacatgtatgtacaactgaattaacaagtttagacatgaaaagatgtacaaaaaggaagccagctgccttcatgtgagaaaattaagattttgttttctcatttctccactgtcttaggaatatgtgaaaatttaggcttggtttgtgacatttattttcatgactctttacaaatgttaattatagaaataacatctaaaaatatggatatgagtagtttttcaaatacttctaaaaaattcaatatctgtgtattggaaatcagaactaattccaatatatagtgagtggattggggagagaccttacatgatatattataggaaattcttactttgttatcccacaaaatagtctaatgtcacaatttcatacaatctttgttttttctccctttgacaggatattttagtaaatctcattaatgtttcagagtaaatatgataattatgcctcgaggtatttttgtcagaattgaagactgctaatatatagggaaaatcctaaaatactaatttcacaaaaataccacatgattgagagttgttgctgagtagttttgaacttcatttcataatggagaatattagttatttcatctggtcaaattatcagatagttctaatcaacaaatatgaaaatgaataacattgtatttatacgatttgcatattagactgaaattgaaactaaaaaatagtattaattatatgcttgtattaattatatgcaagatgagctggaagattaataaaataaaatgtagaatatgttagaaatctgaaagttaatttgaacttcctgttagcctaataacaccattaacataatatcagttcatcacttttgatgtcagtatattaagttgattttgagaaaattcccaaaacagttagagccatctaatcttaaagaacacacacttaatgcagacaattatacgagcctgaaatatagttcttatgatttccagtttgtgcaacaaccaagaagagctatcactaattccaaattgaaacataatatttattttcctaatggtaataattaagtaatttggggggaacaagaaataaaaacagtttgattatataatggaacaaatctttgtctaatattaccaaaaacccataccaaagttagactttctgccattgtgtaatgtaggtatgcgtcttgcatgcattctgcagaaaatataatatttttaaaaagtaaatatctgatgtagttgtgatattttaaaattcttaaataatttatttatcataaatatatctgtaccaaaagttcaatacatgacgtggctgattttagctgaaattttttcactgaaattgaccaaagccatttaaaaagagacaaagtatatggcaatatacataataatttcagctagaatttaaggatatgtgtgtgtatatacatatgcatatatttgtgtgtatatatattccgaaattatctaaatttttcaaaaaggtttagaaactcatggacagtagactataatttgctgaaactaggggctattcatgtacaaagtaccatttaaagaaagatgacggtgtcttaggaatgcttttaagggttctttggttgaaagtctgggaatactcagagataatattaatgagagcctagagtttttttcttttaaaatggggttccatggctttgggcagaaatgatttttatatgtatcatgattgaaaaaactctcagtacaagatgatgcacttctttatacaggtaacaaataagttgaaatcatatttttacatgatttagatatgatggctgataaaacttctgtctttctaaggcttttggcagatgtttctttcaatatttgcattaaggtaaacattcttaattttttatgtaattgaatggcatgattatcattgcattgggtgggagaatgtgggttgatatgttttcattaaattcctcaagaaatgatcaacattttttcagtctttttgcaaacttgacttaaacttctccactaagtgtttccatttccttaaggagaaatttaacatttccaaaaaaaaagataaccagcatttttctttcagctggtcattttaagagtgttcttgaggagctagttttatatggactgtaagataaactgtggtagccgggtatgtgaacatcactccattcatatgtactagcaatacaaaataaacttatttaaaattatagtgcaaatgtatgctacctattagaagagagcatgccatcatttactgtctacatcaataaaattaacttttgttttattaaaaaaggaaaacttttctttaaagtggacaataaatatattgctatgttgtagaaatggtaaacactagagatgctatttctgcaatttaaaatataatattagagattctattgcaaagaatcctagttttaaaatggcatctacattacattattttaaaaaagcaatatttaagagagtttcaaaagaaattaaaacctacattaaagtaaaataacacctttatggtagtgttagaaatgaattttctagcatgtctttgacacatgcaaaacaaatattttaaagaattatttctgtaattgctctaatttttatatttatttaagccttaagttctgattgctgatttccatactttactaataatgcaaatgagaggtcaaagtttatcttttttggttactgctattgcggaaatacaaagaaagcatactggtcactcctataaatgtctcacacatagtatgttttatgtttaacattattacttatgcacataaaaaggcattttgttaaagaggagctctagaaaatcataaagcagatgaagatataaaacacgccttctatttctagctgtttgtacaaaatgagagctggggaatttccatgtagaacgggaatggcctataaactagtgtaagaattcggtgaaactacttggttaagatataatttaagatattatttccaagagttcatacagccctgttggacaacatttcatcacagatactagcttgcaaccatgctacggcaatcataaatactgttaaaaagacatttagctaagtgcctcagttagaaattaatttctgattgaaatatccacttaattaaattcaggtatggtactgaaacttggtcatatcttacctcaaagaacctatttctgtacttgtgaaatatagctttattaataattttaaagtgcttagagttccgatatttttttatcaaagggtattatataagtaaaagtaattgtgtcttatttcctgtgatagataaatgttttctttctcttttgaaatcaaagataaaatgcacatatgcactcaaatgcaaacatatttgaagagtttgaaatgtaaacattcttattttgcaattgcttacatgagaagtatatagtctcctgtcctcttccatcatgctccctgacagcagccatcatttcagtcccttgagaatagaaaggaaagcagacaaaccacctgaaaactctggtgaaagttctcatgatgtggcctccagggaacagcctcttgttttacttgaggctcatttccgctgggccatcctccttgcatgtcactccatgcctactgtgggtaggaaacaggtacttggattgactgattgctgctttgagattccttgacatattttttcatcaacatgaaggcaaaaggacatgaatactcagtcaaaacatgcagagctgtacttacgtgaacacttttaaaatgcgatactgaatcttatataattttaggataatttatgaaaaagcttttctttcttggaatttcttttgtttactcacaagtgatccaagcaaaagatgaagctgttaaaccatgagtcagtatagtatttttttaacttaacacctgagaataaagctgaaaggattgtttaaaaagtgtttcaaatcatactttcaaaatccatctgtgtctggagacccttaaataagcacatgcttcatggtcattatcccagataactgacaatttgtttttctacaaaatctctggatattatgaaacatcacacacgagcttgcttttaggatagattattaataatgtatttttcagacacaattgtatgtgagagtttctgcaagtataaacaataagataacattacagcagcaggcaacactcactaaaatatcaattttgaattgtctgctctctctttgagaaggagaaagagctaactgagtatctttttccctcatgatgtacttactggtctccaatatcctatgccatacaaacagtggacatggtccttgcttagctcctatgaaatacggaaactgcctacctgcttatttttgagggaaaaaaaacttttctagaaagatttttagacaaatgatttattggcctttgaagcaaggacaagtgctataacaactcattaagggacagttgagctctagcaatcaggttttgagttatcaagattattaggaagaaaagttgacacagtttctcaggaaaaagacaaggaagcaaagcattgaaatctgtttctgacttggagtgtctgccagatcctagtttacaaggctggctttctgcctaatccctagcattttcatcagatttgaagactgaataaagtgaactattgggcattagagcatatttctagagcaccgagacctcttctataaatagcataacatcactcttctattttaaccaatgttcagaatccgaggccacaagtttttatatttaaatatgtataaaccagatcattctatgcctgaaagtactagggttttatctgtctgtgtacaggaaattcttctgttaaaagcttagttaacaatatgacattacaaataatgtacctatttttagtggttttattaaattataatgttaaatttaaaaagccaagcattcaccttgagctacatctgagcctgataattcaaaaagtgacatttcagtacaaagccaacatacccttaaattgacaaaactgccctgcttttaaattgttttgtaaaaaagtacttgatatgcaagtttccaacgacttgttttttttctggagaatcttagatactttctgaaccactcttagacaacacagaatgaatattaatgacaggagagagctgactccttcaggcaaaagtggatgagacaagttcttttatgcctttgagaatctgtttcatcatttatatattgaacacatagcaacagttttatttctcttgatttctggacttttagacctgtatgcatcgaagcatattacacctcacagcctgaataggaaagatttgttcagttctctggttataagaatgatataggaattcctttgtgttctcttcctttctgtacattttattcctttctcatgtcttctcttcctactctgcccttcttccttcttttcttcattcttttgtctttcctttctttttttgtatcttaattaaatattttcctatagaatcactaaatgaaggtttagtacttttgacccatagtaatcttcaccagctgaattaatttgtgtcaacaactaagaaatgtaattcttagtttgtatacattttaggttagcttcacaaaatatatgtatagataaataaaggagcagccttttaatttgtttatgtaattggcacacttaaatggaatgtgtcatcatatgaatgtttttaaaattttgcatgtaaagggcttgcggataatttttaaaccgtaactttttgcagagagacagaataatgttttagagtccaaaaaactggcatgtactatttggcatgtttttctttattttctattttgccattgcaatggtaacaagttactgtgttcatgacaggcgtgcagcactgtatttttatttgtttatttattttattgccttgtttgatgttgataatgaagaggttctctctcttaaagatgcaatgaaggagactcaagtgttgttacttgcctgcaattacacatttagaaagcctcttatattttttgtctgttggaacttactgcctcagcacttaataaagcaggaaaaagcatgttttgtaattctcttactatgtaagaactagtttgcttttgcttatctaacatcattattgagtataagatacatagtctttatttatcccactgaaaaaataagaaagatttgatataccattatttcttctgtgactctaattgcaaaataaattgagtttgtgttttaaaattattcaagggacatttttgtaatctacaagaaaagtcactaagcttgagtcactaggctaagttggcctttagtcattgctatatcactgtgatgttagataagtcaccttatttgttttcttatttgtaaactccatagttccaagccaccaagtagggtgcaatgagaagtgattgtaatcataagtgttgtagctttatcactaactctccaaacttatctcttattattctcctcattgatattcatacacaccttcttgctgttccttcacataacattagtggaagttgttgaatctattgatactttttatcttctattccaaggtagaatggttaaacattctgctctaagtgaacatatccaaaccacaattattattcaattcaaatatgaagtctatcagttggcaattctttgtgttaagaaacacatttgcgagcaatagctaatagccataccattgcaatgtggaataatataagtgtgtttgtagctaatctgatttaagaaaacaggaattttagttgggaagggcctatagaaagaatacaaaattatatgaaacataggataggtattaagggagatatttgaatgaatacaggtattcatattgtttcttacaatatgtcaggcacttttctatgtactttccatgcttcatcccatttaatattctcaataactccttgggatttgtgctaatttgtttataatttttaagtgagaaagtagtggaaaaagaataactgagcaacttcccagggtcacattatgtagtaagatgtagaattaaacccaagctacctatttacagagccaatactcaatcataggtagtcacacaatcaataaactcataaatgtcagaagaagagaatagatggtggcaaagaggtagaggtacccaaaagagattaaatagtgataggcaaattgatccactttataggttaggtcaatatgagcatgatggcaataggataaaagtatgaaacttagagagctggattcagatagccaactctggaatggtgaacttcaataagatagttccccaggaatgaaaatgcaataatgtttgcaaattgtctggtgccctgttactatatggtagatttgaccacctttgctcctctttctctttttttattttcagaaattctttcacttgtaaaaatgccacctgactcaaaatgcttaagcaagaaaagggattttggtgctcatgtgaccataaagttcatgaatattctggcttcagtcataggtggaaatgggagctcacaccatgtggtcagaaccaagcctattctccttcctaccactgtaccactagtactcaataatttaacgactggtatgattataccagtgtgaaaagtctacctataagaggatattggctgagttgattgttatttaattctagttatgtccttgccttactctgtttggcttcctcactttttaatgcagaagggtagatagtctttattcatctcattgcaaagataagaagaaagtcctttacaagacttgaagaaattaagcttagtagaaccaagaacagcaaattgcagagccacttgcgtgtaaatgagaatttcaaacttttattagttttgtaaggaaggaggggttatttcaaggagtttataaagttttaacctacatatgctacagattaaacgttatcaatttgtacaaatatattatacatttttatctttgttgtactctgaattgaagaggaaatatttgggaataatatatttcttcggtaagtatgatgatgttcctattatatgccaggcaccatttggatgctggggatacagaaataaaaatagtagacaggtttcctgcatgtaggagcttacattctaaggaagaagagagaccattaaaaacaacaacaaaacattgctatggtacttatataataaatactataaaattgtaaaataggctaataaataaaacagagcaatagtggggaatgtgatcaaccaaaaggaaaaggagccagccctgtaactatcaggggaaagcactggggtcaaatgaagcaaccagtacagaagctctacaatgggaacagtttggtctatttaggtataaagacactggttttatgtgtttcccgtgccttaatattttaattaaaaataatctgcaaacattattaagaagttttcaaaacagtgtaatcatgtataatctcaccatgctttaaatatatgctgtctcatttctgtgtaatatgtttccagtgtgtgttcatatgcttacattttttatggcgacaatcatagaatatacactgtttttactttgacttttaaaatgtattctcagatgtcttgtagacatgtatttttatactccagttttatcttcggaagagtagctgcttttcttttattctgtatattcctcagacactttctacatatcttccgtttcttaaatcttaataattctttccctttcccctcatttctaaagaaattaaatacatggcctaactccagttttattgttcctataaatttaagtcaacaccttaactttttatcacattcatgacacttgtcaatgcaatttccttttgagtatatttttgattatatcctacaaaactctaatttagattttgaaacaaaagtaaataaacacagaaaacataatgaaacaaatcattttgtgtcgattatcacttagacaacacagttcttgtagcattaaccggaaattatttttcctctatctagtctcatatcctggtttcaagaactcaataacctaagtctacctaggttgctatatgatagtaaaccagttgcctacaaaggcatattaacttttgtgagactgcattaccacgcaatctgctacacagtaatgaagtaataattaaagcctcaatcataaatgttcctcttttattttctgctaatgctctctatagacattatattctgataataacatgttttgaaaatggaggtgttttttttttttttttttttgccaaactactctgctccatcaggctcttttgtatcctaaatattttatgttatactatatatatgagtgtgtgtatatatatacacacatatacacacacacgtatacatatacacatgtaaatatatacacatatgtatatacacacgtgtacacatatgtatatacacacgtgtgcacatgtgtacatgtgtgtatatatacacacatgtagtatattatataatatattatataatataattatatattatatattatatattgtatattatatatattatatatttatatattatataatacatataatatattatatgtaatacatatcatatattatatgtattatatataatatatattatatataatatatataatatattatatgtattatatataatatatattatatattatatgtattatatataatatatattatatattatatatagtgtattttgattttttaaatgcacctggctcctctagtaaatgccagtttttcagaattttgcgatgacatttttatcatctctgactcttcagtacctgaaagatattaaggagtgaatattttatagaatatttattgaatgagtgtattagtctgttctcacgctgctaataaagacatacccgagactgggcaacttataaaggaaagaggtttaatggattcacagttccacatgggtggggaggcctcaaaatcatggcagaagatgaaggaacagcaaagggatgtcctatgtggcggtaggcaaagagagagcatgtataggggaactcccctttataaaaccacaggatctcgtgagacttattcactatcatgagaacagcatgggaaaaaccttcccccatgattccgttacctcccactctgtccctcccacaacatgtgggaattttgggagctacaattcaagatgatatctgggtggggacacagctaaaccatatcaatgagtaaatccagtaactctatattttctaacatttttaactggcatccaaatttagtgtatgcatacacacactattagcaaaagttctatgaaatattacttgttatgctttctgatacttttcaattatccttttctatttcattaaataagtactggtcatgatcaactaagtttatattacaatctaacaatgtataacagcctgtattttttttcctttttgagacagattctggctctgtcattcaggttggagagcaagcacatgatcctcccaactcagctacctgagtaactgagactacaggtgcataccaccacgcctggctaatttttgtattttttgtagagacagggtctcactatgttgcccaggctggtcctgaactcctgggttgaagagatctccctgattcagcttctcaaggtactaggattacaggcatgagccaccacacctgtcctcaaaagtataatcttcttgctatattcacatacaggtaattttgtgtgaatttataatccattatttttaagtccacaatgaatctagcaccaatgctgttattggccactcttaagcagattcacgtcagttggctaccttctaagggattcagctaatagctcttaagcttccttttggttgtcatggggttgatatattgcactcttttttgtgtgtgtgtgtgtggataaactttcttgtagatcggaagaggatacacgaaaggaataagggattacctcttttcctttaaaatagtgagtggagaactagtctatggaaaaaatagacaatgaagattgagcataggtatttagagttttgtattcaaattaagaaacaaacaaataacataaaatctgtcaatccttcaccaagtacataatgtgggaattttactaaatgatttctctgacacctttcagtgctaacatgtgaaggtctgtaattgactatggcattttgctgcaagaaaattagacatatgagtaacgcagcacataaagcctttggcttcccttctaacatttgtttactctcatagtggtgaataagtttgaagagtatgtctttcatctttcagtcattcattaatctactcaaaaatagttaaagtacacaaacaaactccaagacaccattagccacccataaaagaattgagtaccatctagttaagagtgaaaccataaggaagtaatgattcattcacatgtgagctgtgaaatagcattgtgtaggatattctgtggtagcaaacagtacaaaagcctcaagggcttcagcacgaaagctttattccttggacataccacatagccattgcggatcagagtgtttggagagtacataggggagagtgtcctctgatttacatagtcattcaaaaatctagactctgagagctccagtgccccagtgtcttataagactgtcatctcaatgtaaagtttaaggattcattgcagtagggcaaagaacatcagaatttcttaccagcaattatctactctcaccctgtaaaagatacataaaatttctgctcacagtccattagccagacccagtcacgtggctcctaattacaaggatataggaagtataacacacccattcccaccccaggcttggaagaagaggatattggcaagtatttgaagagataagctgcatcaggaaaatgcaaagctttctgcaaacacatgagagtgaatgacagctgaaacagcaatggctttatataggaggtgatgcataagatactctgagtgactttggggttatgttaggtgttcagttcattcattaatgaaagcatctctttttaaaaatctaagtctccaacaatgatatgtgtttggttcagaaggccagcactcctggcaaatttggaagctgaacaaaatcattcccgtcttactaggattcctgacacgtagtgcaaccacctacatggcagatctatttagaagcctgaaagacatctcaaactcaccacattcaaactgaactcatcttcatcaacatatgtagtccttccctagtgtcttcaatcttggtgaatgattgcaccattcatctaattttgttatctagaaacctgggagttatacttgtttcatatgtctctcatttttaatctcaaattcagaatatatgtcttaataaaatttttaactcataaatatcttttgaatatgtttacttttctctgtctacattgcagcaccatagttcaaatcaacttgccttctcaaatctattatccttaacttgactttcaagtccatgcattatctggccctacgtattcaccagcctcatttatcatattgttcctttgttctgatactctggccatattggccttttttcaggtttttaatattccagatttttttctgcctcaggatcttaacacatgctggttatgatgttggagtgctttcttttctcttttatctggttaaattctatgcagccttcagatctcaatataggtatcaactattcagggaagatatttttgactcttcagaatcactcagaactttgcattgtacctcctcatagtgacctgtattttccctttacagaatttatcaatttatcattatatatgattatgtatttatttgggtggttatttgattagtaacttcttccccaaccagatttggagtttcaacaaaacaggcatgatttttcctcatccatgtggaccagagcctcacaaatagtaattagtcattacattgcattcctgcctcagatcctttgttcttccccttcccactggatggaatgcacttcctctgtattctcttttgattacttcttcaaaccttttgtgtgtttactcaatttttgtgtggtctttcctgaccagtcttgtagtacatttatatctcctcccacttccctaacatctttcttcttatcacttatcactctttgaatacagtttttaaataaataaatttatttatttattgcctccctttgatcattagactgtaaattccatgataacagagatttttatattttttacttcctgatctccgaatgcctaaaacaacacatatttgttgttccataaatatttgttgagtcaatgaataaatgaactgtgaattgtctctccattaattagaacagctctatgcatctcatccaatgaaaaaaatattaatttaccagtcttaacaatttgcatagagatgacaagcttatacctttaaagtgcatgtaggaaattttctttttttttgtagactaagttataatttacaataagaaggccaaaatgactaatttgtctattataccatacttggaaacttaaactttctagtgaaagggttatatttattataaaaataattttcagcttagctattttctgtcatcatccaatcaccttcatcctactgaattttcctcctaactattgctaatttgtttctctaatctcacactaattattgtaagaaaaaaaacaaacctttttccaactggcttttctaccttacagtcctgctttcttccaactcatcttcctcacagtcacctaagtcactgaacacaaatgtgatcagattattcttctgattgacatacacatgcagcttcctcaaaattagaaaacaaaaggaaatgcctctcattcctatatacccattataattgactttgcttggctcgtcacagtacttgtcacccccaaatacttccctcctgtccctctccatgaacaactgctacccttaactacatcaattttatatcgctcccttcacttctaatttattttttaggtctgtttctcaaagaaatttttcccaacccatctctgtagttcaaagcttatgtaatactctcagcatatttccagcattacatttgtcatgttgttttaggattattgttcatagagccacccccttttggttttgaactcgctgggtttaaagattgtgtcttattctttgtattcccatttactggaggaatgtctggcacataacagacattatcgaaccttgttgaataaaaagagaatgagtatatttagccttgatgggggaaaacttctaaaatatgcacagaaatcaggcattttctaactgtgtttgtaaagctaaacttgattatatcactagccatttatgctttggggagagtaagcttcatgcagtctagggaaaccaagtaaccttcgcttggtaattttcctttcaaaagaagaaaagaggagaggagatgaggagaggacagaggaagggaaaagatagaaaaaaaaagaggagataaaagaagaagagtaccagctctctttgagaagctgattctagggctcatctttgacaagagaaatgttaagatgatttttttggcttgctaaacttgactcatccctcaggcatctgcttaaatcagagaggatacttctgatctctcaatgacaattttgtctcccattatatttcccatagcaccctgtattttttttataacatttgcacaatttgcaattatatatttatttattatactattcattaaatgccaggagaagccactaagaacataaaccataagaggtcgggggccatgtatgctctatggaagcagccacaatgccagttacactcaacacctgacacatagtagatgttcaaaaaacgtttgctgaatgaatggggagatgataagatgcataggcgattgactgaactttaaatagatgctttctttatcccctaatctttaaagaagtatgaagttttctgtattggggaggaaacagaaaataatattgtagtctggtatatttgagggaggatgagcaggcttggttaaaatagaaagctgagctttccacagtgattggatccaatctgaatacaaatttaatcactctatgagtgtatctactatcattagacactaaaattgtaaattcagcaatgtaatatggctgactctttaaaaataaatttttattatttatatctgagagtaaatattcagttttttcatattatagtagtatgaataatttgctttccaaaattcctccagaactgccaagaattggcaaactctgcgtggtagagagatttgaacaaataattgcaacaaaatgaaaatatttcggtaaaccctaagtagacattaagtttgaaaatattgaaaacttaaacgattttaaagaagaaatatatttataaattcatatctcataggtgagggtactgatgagactaaatttagttgacagaaatctgaagtgaatgtagagaagtgctttaaatatatattgctaaaattttaaccttgagtttttatccaattgttttgataatctcttttctctgaatcatggcatcatagatttttttttcttgtttgcttcttttctttgtaatgggaacagtctgtgatcttacatcctctgggtgtgaaaactcattttcagaaactacctaaaaaagtgcagtgaaaaataaatcttctagctaaagataaagtagagattgttactgaaatacaaggtcatatgattttttaaaaaaatatcttattacttgattacccagttgagaataactatgtcaaaaaatctctgagattctatgtgtgtatttctgtaatttcttcgaacagtaatacactaaattataatgttataacagtgaacaattgatgtttattgacacaatgcaaaaaataagattgagttaagtcctctatgattgcaggaaccatttctatattgtttgcaattttttccccagtaccgacctagcaatacatggcacatactaagtagtacttaaaaatctttggtggatatcactgaagtatcatccttcttgattttttcattcgtttctcactcacttatatatttcttttgaataagtgtaatactttaatgtgtggttttggtaataagccttcatgaactgatattagatgtagtcaagtcttctcttccaaggtgaaatatgactttctttcttttctcagtctttgtttccctagattaaatcaccaggtagctcactgttaagtttcaaataaaatatggtaatttaaatgctcattttgtcatggacaattaagagtgaagagatgatgtataataatatattccaatttctctttaatgggaccaactaatgttttggattatttgagccaatgttacctatctctgaaacagataatcattcttgactttctcttttccctttcactttctctccaccttttcttctttctctatttttaaccacttcttcagttatattataaatctctatggcatccaaagtgcgaaggggttctgtcactgaaaaagttattccttctgtaaatatattcaatgtatacttaatactatacacatgaaagtgatatttttaagaaaattatgattcatttctagtaaagagaaatattttaaaggaaatattttagcttgttttttaaataaaaataattttctaaataaaaaattattccataaaattatttaaaatactcaatctaataatatataaatggaaaaattagtcttttttcagacactgttttctttcagtcagccactgttaccaatctcttatattctctaacagaaatatttaaagcccctaacagaaatattgcatttgcaaacatcacatttaaaatcaacattccatgatatacacaacggtctatacattttcagttagattattttatttatgttggattagatattactttatacaatctacagtgatttttaaatgtatagttatatattttatatattaggaatagctatatctactgcttttggttaatgcagcattaagtaattgtgtgaaacatgttaatttgaagtgattttttactctaagctaattcagtttgataatttagtttttttctagtaaaatttgtgatgacagtaacaatgaacataaggtgtactaaaggattttatagattgatcatgtctaaagatttttgtaaatgttccacttctttcatactgcaaagtatccttgtgttaacatattttataacatcttgtttgtttaatattttcattaataattgattctctttatcataatcttagaatattttaatgtttgcatttctatatacattcagacattataaataaaattttataattatatttaatatatctttggtttggggctgcaattgttgagtttaagaatattaaagcttttcaaaatgtaaacttgttaagaatgagcttgcacatgttagctacatgtaaaatctttttaaaacaaaaagaaaaaatatggaatctgtctgaagaaatatgaagttttaaaagtgtttataaaatttggcaaatttaataataatagtttatatgtatagagttttcattacataccaggtgctattttaactgtttttgtatattgcttatttaatacttacttcaaaacctctgtgaactattataatgcttattttggaaataagaaaattgaggcacagagaaatgatactatttgcttttaggtcatagctgttaaatgttcggggatttggatttcaatccactagtatctagatgatttattacttcattaattcaaaaatctctgagcattagttcaaaatgtttcagtattaataagttatttaccctcaaataacttacctttcagtgggggcagaaaaataagtggagaaaggaaggaaggcaggaagggaagagtgagaagaaagggggaaggagggaagggaaggaaggagggaaggaaggagagaagaaaggagagagggagggaagaaggaaggagggaaggaagaaaggaaggaaggaacgaaggaaggaaggaagggagggagggaggaagggaaggaagggagagagaaggaggacaggtgctattaataagctttattttcatgattgctatcaaaaaaataaaaataaaaaacaaggaaagagagtagagagtgccaagttgggaatatgaagacagaatacatttttaaataagattgtcactgaaaatcacatttcaccacagatctggaagaggtgaggaattaagctagggttaaagatcaggccatgcctggtgatttcaaagaaagcaaggcgtccacgtgggccaggtgctgcaggctgagggagcactgaaagctttttttctgagagggaacacagggccagatggtgtaaggccctggggtgactatggtttttatttggaatgagaggtgaaaccagtaaaggattttgagcatatgagtaacacatccaactttgatatttttaaggatcattgagaataaaatattcttgctagaatagactgaatagggccaagggtggaaacaagaagggaatttggactttgttggcctatgatggaagcaaaatacatatctattttatgtatttcctagattttgtgacctctaagtacattaagatagcagtggaaagctcagaaatacattcctatccattttttataagaaatggagtttaacttccctcatacttggtagggcttatcataacactaatttttttaacatgttatatgtacttcctcagccactttgccagctaatttattatcctggggcaagtaaataaaagttgggctaacttcaaggcatctaggaaaatagcagaaaaatatctttttatttttttctatgattgaaagactaatgcattcacaaacgtcagagaatgagaagcattaagggttcatgaatatagagtgagtgcaattggttctaaaagctatcctcctcaaaattcctggattggtattgcttttcaagtaagttattttgagacaaaatggttttgcttttcaatatttacatttaatttcattttaaacaaaaacagattgataccaacattcacagggatacctactgtgctgaaggctgattttgacagttgtaagataatacatgcaattctttgaaattaatcatcacctaaatgttgcttattatagacaaatacatagcaacaaatttagaattaaaagatgtttgtaaccatatgcctgtgatgatctatattttaatcagtacatactcctgatgtttttaatacacagtcagcaagtatttacctattgcctgctctgagatgagcattcagccacatttgaataatgttttgaaaggtttgggttgttttcagggagaatataaagtaaacagccaagaaagacccacaaaatgcttttggagaaaagtgtatgatagtgcgttatttattgctcaaataaagacaatggatatttaaataaaagccatgggaaataagctgatacaagctatatggggttaagtcattcaacacattttcatgatctatatttaggcatgagattaaactggaagccccaccagtcagtgtaggatagagtgccagtttatgtatgaagttttagaaggaatatttttctttgagattaaggaaataatggtatcccatgatacttgcactttctaccttttacagtagtcctccttacccacgatttcactttctgtggtttcagttacccatggccaaccatggtctgaaaatattaaatggaaaaattccagaaataaactatttgtatgttttaaaatgcatgttgttttgagtagcatgatgaaatctcacgccatcctactccatcctgcccaggacatgagtcatctctttgtccagtatctcgatgctgtgttatccacccgttagtcacttagtagtcctggcagttgtcacactgactatcggtattacagtgattgtgttcaagtaacccttattttacttaataatggcccaaatgcacatgagtgtggatgctggcaattcggatatgccaaagagaagccataaagtgcttcttctaagtgacaaggtgaaagttcttgacttagtaaggaaagaagaaagaatcatatgctgagatcattaacagcgatagtaagaataaatctattcatgaaactgtgaagaaggaaagagaaatccatgcatggtacacataattattggtactaggcatagtttcaggaatacagtaggggagctggaacatatcccctacggataagggaggatttctgtaacgtaattgcttttgtatattatcttccctattaggacaagagctcctcataagtaaagaggatatctcaatcatctttatatccaaaattatatatcataaagttactattcagtaaatatttattgattgaagtaggtgatgacatactaaaatataatttcaatatctagccctttctttagaagaaattgattattcatacttgttttaaaaacctgattgtatttctcaagtataatattgttaacttattgaagacaggtttacactgttaagatttaaataattaaaaccaactaactgaattttatttctaaagaggactgctcaaattttgtgcccaaaaaactatgatagacaatttaaagtaagagattttcaagttataattagtagtggaactcattacatgagaaaattaagatgtgtcattggtaatagtaataaggaatataattttgtagaatcacagatattataatatttttaaatcctttcttaagaaattgatagtttttttcaaaatctatgattttggaggatgaggtattgtaggtattggctttgtttgtagaagattacacatataattgtataaagttagtgtaaatggattgctcatatttcaattcttagacctcatcttcatttcctctcctggaaatccttgtgtacaattaccctggtaaatggatggacccatttcaatattttatatttaatttcattttaaataaaaatagattgacatcaacatccccaatgataccactctgctgaaggatgattttgaaagttgtaagacattttatgcaatcatttaaaattaatcatcacctaaatgttccttattatagtcaaatgcatagcaacatatttagaattaaaaagatgtttagcaccgtgctggacacttagaaatgtccaataaatatttctatgatagttattatcatcttttctaatcttgttggagttgttcacttttaggagtgcttcaaagatcacttcttctagtcaccttctgaactcctctttactttttatagttcagcataccactacctgctgattggttaatatctttggtagcttctgagtcatggttcatcaggaaaccaagggtgcgatttgcattcaagcaaatcctcctccttcctcctgctcactgtcacttctatttttactttggagcgcaaggttctttaaggcgtctggtattctgaggcttcctgcatttacagatttactacctgcttctctataagaaatgtgaattggtgacaaatctttaccagaaaaaggcaattgtaattagattaatacctaaggccaaagcttttctttgctccgaaacccgtattctttcccctttttagactactatcaatttttatctcagttccttcagagctcctggttaattttttttttaagaaaaaatcaagacttatttgagaaccttatagttaatgcattgacaaacatgtatagaattcctgctttgtctgggaatgtttgttaagaactagttcaggatttcttatcctggcatccatgtttcttcaagggtttcagagaattttctctgaaattttatacaaaatgtggtgtatacatttgcatatgcatttttctggggaatgagcttatagctccaatcacgttaccaaagggttgagactccaaaaaagttaagattcactcactacactggcagaaatacaaaaaacacatttccttggttgaggaacttgtaatataaatgaagctgacaccataaatgacagtataaaaataaaggtgaaatgctctacaataggtaaaaagagaaaaatcacttaataatcattttggagaggaataactgagactttgtctggatttagaaatgttatttatgaaagttttatgggacttctatcctgtgtgggaaagagtgtgagcaaagccttggaattagtattgattagagtgcatgggaacataacgaagagcccatgtcttgaataatattgatttataaagaaagaaaggttattgaacatgtgagatattaataattctcatggtttaaaatgttgactaatacaatgatacattgtagttgatattttagctaattacccttagatttaaacacttttggattttgaaaaccttaaatattcttcaaggatgttttgtaaaatgcctcagtcacaatgatcatcatgatatataattaataaagacactggtccatttcccaaaggggctaaacacagttttccaataacaaatcacattatagcagtttacactgacacagactgccccaaacttatgtatatttgagttttattaagtacattcagtacagtttgcatctgggcctctgttttatttgattaaaagaaaaaagttcaaattttatggctaaagagagcagacatatccatttgaatattccactgtcacctcaaaaataatatttttttcttttcaagcagtgcttttatttcttacaatctgtacaataaggtgacttgccttgaaagcatttcactttttctatccaaaaaagttataaaaatttgcaaagttaacttttataaattgatagtgttgtctctgactcacatcatcatattagagatgaatttccatagtgggagggaaagaaccttagatccaacatacccacaatagtattttagatcaagaaacaacagggtggggaacatcacacactggggcctgtcgtggggtgacgggagcggggaaggatagcattagtagatatacctaatgtaaatgacgagttaatgggtgcagcacaccaacaaggcacttgtatacatatgtaacaaacctgcacgttgtgcacatgtaccctagaacttgaagtataataaaataataataataataataatgtatcttaaactagactgttcaggatgctctcctcccttctacttttatcatcttcctcctcgctcctttttcttccaagcttcacagtttctgtccattgtaaccagtctttcattctccaactccctcatctttcccaaaatggactcattttccccagaaaattactttcttcatctccttacactgtctttcttattttcactcctcgctataactgcatttctgttacctccaatctacaatccggagtctatcttttcctttcaccattttaaatattgctctaaattcaaggcttggctgaagagtaaccatctgctagaaagtttctgaattacaactatgcaataattatgccatagaactatgctcctaacatgcacctctccagattttaggtacatagctcactattttatttagaattaattctactgattcctcatgtatatgtgtattacctatcttctcacccaaactataatattcttgggtcagatataagtctattttattattggtttattgtttgttttattttgttttgttttcatctatcagatcattaggcacaaaatgagctcttgatatgtagttattaagacactggcaagattttaggaggggaatgacacatagttgctagccgccaacatataatttatggtgtacaaagcacttttacatgctttttctcatttactaatcatagcaacactattatatattatcatccacattttgcagataagaaaacagtacatttagagaaagtcatcgatttggttaggaataggaaactagtaaattgctaaactgagcattaaactcaacatttttactccatacccaggtttccatgttaccatagctgtcttccaaggctgcattttgtacaagagagttaaaaatgaaattgtttctaatatctgtttgattaaaggaaaatatctggaacaaatttgtcaagatagttaacagaatttctaggtgttactgaattttaaagtctccacggtgaaatgatggttaactaacatttatttacatatggaagaaggtatttttggcagctttttaaggtgtaaaacttaagacacctcagaacatgtaggataaaaggaaactttgtcagggatgtcttgagaaacctgtggcaatttgaactgtgctcaggaggaaggacacaaatcatggctgtagtgagatctgtgaagtagtcttccctctacagcttctctttaaaagctaagtaatgggtggcaaaataaaccaaactgaaactgagatgcatgtcatctcattagtgtcttcttagatccacagtgctagcactgataagctcaagtgctgagaattgttcaaataaattctatgtgcaatcaatagaagacctaagaaaactgtgaataagttaatcactataattttatatattaacaatttttcattctctttctcctgatataaatatttttgtcttaattcttatgaattgagggtcaagttatgtctggttttccttccatatcatgtatggtctgcctgaactatagatctggcaagtccttgaactatgctaagtggtttaaatgggataatacttaacatactttgataaaaaccaggtggcttcactcattaacctcttggattcactaatatggaaaacatcatcttatcacgtttttaacatgaaaacaacctacctactacctaccactaatttttaaaataataatcttatcattcaaattatagtacattttaggttctgcacataatactactcagaaattagcttagtcacatacacccaggggatcagtcactgctattataaaaatcaaaaaagttataaaccattcttcagtaatataaaatagagaaaatattttagcaataggaaaaatgaccagtatagacctaaacaatcagttgtttccctttccccacctctctaaacacacattttaaaataggagccgccccgatcaaattttaaattttggcaaataaatagaagacttcaatcttccatagaaaataacattcattttattttactggaggtctgatttagaattcaaaaggaagtcaaaatttaaaaggaagtcaaaaggaagtcaagattaatttggaaataatgggacacaaatatatatggatatttaatttagcaatacattaatcacccaaaataatctcaagggaaaaagtttaatgacaaataacggtaaagaggagaattatttttttcagaattacacaatattgttgaaataactagatatgaatcctaatttgagtaaactcactttcacagagaacttaagagaaacataagtcatattcttgaattgaaaaattaggatgtataagtagcattataatattctcataatggtttggactcactcctaactaaattgcccaaataagttgatctactgctggcctttgccatcaaaaatatttaccaatctccactaggattgtgcagataaatgcaatggctgccatcattacaatcagtatgcatgtacttactgaggaggagtctacaaatgaaaaccaattcctgggaatttgtgggcaatttcaatattaagagcaaccatgactaacagtaaatgacaggctacatttttcaatttgctaataatgattcttgctttaatttttttaaaatttccactgctgatttatcaaaatatatggattagcactgactgtaaagttataatctagatggatcattattaattcttagtactaaaatacatatttttgaattaaacttgtcaaaaattcaattctgtctccaaaatttgaatcaatgttaagcataactttcaaagccaactcacctagcaacattcttctacatctgtattaaagaggaggaaagtcttagtgccaataatcactgaatactaaaaaaataaaatgctcacaaacttagatactcatgaagtctgaactataagagaatatcctggaaaagttgaggcaaagatgtcaagtcttctatttgaataaaatttgttatcctataatttctgcttacactaggccagtagatgacaatatgttatgaaaacaaacttctctgaagagaaactaagactttaactaaaaagataggtttaaggctagaatttatctcatgttttatagataagcaaaaaataaaaaccatggtgcagtgttaataaattagaagtgagtttaatgtttattttatacggatgattctgccataaccaaggcaattataaaaaataataataataataaagttgccctctgcatttctcctgaagacctcaactttcagtctctcatgcgcaaagatgcttccaggggcttggaatgaggaggctagcaatggatatgttttatttttggaaaatctgcaaaaataagctgttttaaccaatattggtgagagcactgtgttctttctacctaactttgtattcatattgcttttataatttttctttttttttccaaaaagattctgataattgtacaagtgtcaagaaacttaacacctggaaccactcctacattctttttctctgcttcaatatctctccccatcagtcctgctcactgaaatccttcctagcagtcaaggactaccctaaatacctcctctctaggcagttgttacagtatgtttatagtacttcgattgtatccattttcagttttaattttactcggtcttaatttatgattgtgttttttaatctgtttttttttttttttttttttttttttttttttttgtgatcaccataatgtagtagcaaatgtctacagcctaaaataaggctggcagagacttgtacccaagccttatgactttctagctgtgtaacatacacaaaaaaaagtcacttattcttttactctgattgagcctcagttcccttacattttgatacgcatcaaaataataggattctcttcataaactcctcacgattaaatgaaacaatgcatattaagtgcttatcagagatcttggacaaggatgacaactcattatgagctagttcttacaattacggctatttaaagccaggcacagaaagccaaatatctgacgatctcaccaatatgtggaatctaaaaaagtcaaactcatagaaacagagagtcaaatgctggttaccagagactgggaggtggggatggggagctgttggttaacggacacaaaatttcagttagacaagaagagtaagtttaagagacctattgtacatcatgatgactgtggttaatagcagtatattgtatacttgaaaattgctaaaaagtagattttaagtgttctcaccacaaaaaaataattcagtgaggtaatgcatatgtttattagcttgatttagccattccacaatatatacatatatcaaaacatattatacaatataaacatacacaatttttatttgttaattaaaaattagataagctaaaattaaaaactaaaaaaaattgtgaccaagccactatttttgatgtattctccgttgaggttttccataccatcctgcaaaatacttagaaaataaatatttattgaaatgagtaactcatgagaatattacttttttgagatataaaattattttgaatacaaaatgagcaaagataaaaaagtgttttttcataaaactaatttgtgacatttaggattataggattaagtaatcagcatattaaataaaacaaccaaaaattcttcaactataatgtttattctgtcaaatgcataatgtaaaataatatttgttttggcaattactgaagactaagcatttgtttgcctcccacataataagcagactaaagaaaaacacatttggtagcttgaaaaatggcatcttcatatgaaaaattaaatatttctatagacacattttcatttatttgtgataaagatttaattttaagtatttttaaaagtattccataacacaattccatttgttgttgttgatctatatacttacccatatgtaaaatattttaaataataacatatttgaagccaccgggcacaaaaatgaatgattgtgaaatgtgcaaagtatttgaatagtgagagctaattctatactattaaggacaataaaaagtgcaaaagtaattgtaactgctaaaatattatttcaagttttagtccatattttgatctatggtctaaattgaagtttattgattctgtaactcattggagtttcaacctagagaaaccagtcactgtattatgctgggggccttataaaaagtataattgtgtagaagaaagaaaaatgggtaagagaaacgtaaggacaggagacaagtcagctatttagttaccatgcaatgcagttatttgggagctttttctcaaatgtaaactgagaataattatacctaatttaaagctgggtggtgcatagagcacttggatcaatttctggcatatagtctgtgacagagctatgtaaataaattaatgaatttatatctagaaatccaactctgtataccaccaaatccctttattattttcttttctctaagcatttaatgtaaagtttgaactgtattattctttcctactaatttaaattgctgcttgccctatttgaataaaaaattgcctatttctatggttttgctaaatagtgaataactagtgcccttacaggaatcacaagaaaaacacactgaaaaatgtacttggaagaaagaatatatggaaatatatgataaagaaataactgggaagatgccttaggataaattatgaaagaaaatattttagctacccttttctgttgaacaaatgagaaaatgtggtcaaaaaacaaggataaatctattgggaaaaaaaatttatctcctattacccaaaattttacctgaaacatgtttttaaggaaagagagaacaaacatattctgaaacatagaagaggtgagtttaacttgaaattaagagcaaccaccctccccaaggggaaaaatatctccaaacctctctcctcatgtaaacagagactttagagtattagcagtcaacaatattttcattaattatttataatgtagaaagccatgcccatttaattccattttcatttaaaacactacaaaatatgatatatcttcattttaaaaattatgtgaaaagaaaatatctgaattatcttcatttctttttgatgaatacaaaaagagaaaaaggaagtagtttttactttacgatttctatatctttaggaagataataaggaatcttaaaatccaacatataaaatatcactttctacagcaaaattactttcaataaatggaaacctataattaaataatttaccttccttaagtctgagaacctcacaatcatgctcttcagttcttttgacttaacaaaatatctatataagtgtatgacaatgtcaatagtcaactgaaggcaatatattcgaggtaaattttattttaaacttttcttctatttcatacatatagactacaaaatagcaaacctggcatttaaatatataattccttcaaattaattaaactaaaacatgtcataagtagcttttatacatgttttattaaaaataacacttagaaaatattcagcctaatttatctttaaaaatgtcaaataccaggatacttttaatgatttttgagcataaaagaaaagcaacttttctttctctgtggttcaaagatacagacatgggaatattacccagtaaactatccttgtaggattaaattttcagtgaccagaagctagattgttttgttttgttttgttttgtttaacaaattaggctcaaatactgtccaaacctaaaagtggatcttcatcattacataaattctgcaagcctaaacaatgacagcccgagactgttgtacagagacatatgtgagactttatcctgatcctttaaaatgaatagtcagatgatggtttcacactgatacaaattagatttcatatgctgatatgctcaataatgctaacaaggatctatatataacttattaagtgctacaggcagagcctatgctagggctttacatctaccatttcaaatgctcatcaaaatcacaattaacctattgataagtttgtactggtaatttaaaatttggaggcattctttttccagtggttttgaaatattatgttcattagagaatatagtgccaagcctctgatgcctttgttggtttttatttcatgaagttagtgtacacagcacctctgcctgagcagagctgaaactcccaagttaggacatgaaccaaatataagggccacccagagcttgggtttaggcagccttcctcacctttagctcctaaagggtgaaacatctcagatgaaaaacctcactaaccaaaactcctaattactaaataaaacttaaggcattcataaacgcttgaatgtctgaaattgcaagtctatacagttgaaaatgcattttctgaattcagatatttgcccttgctacataataactgtagaatgttgagcaaattacttaaactcagtgtctcatttgtcttatctgtaaaattggaataagactagcactgcctcatagacttattttgaggattagagtgacttaataaatatcaatactcttggaacgatgcctggcaaaattattattgttttgccttgttgttatcttagataggttgtccctataccatgccaaaactattctgtcaatttgagggggaaaaattaagagtcaaaatagcaagttggtgcttgaacatttactttccttttggttattttatcattgtgtcaaagaattacaaacaacataatccctattttcaaaacttccttagccctctgatcttcccagagtcacagaaagtagtagttgaatggctttaatctagtttgtcttagtaatagaccaacaatccatcaagaaacaaatgccattctatggccctagttagatagaattcatgattgttttttcccctaggactgcattgcaacctcagacaagaatggcagacagccagcaggttctgccagctggctttgcactgctctctgggttttagagaacaggagcacagatatttttgattctgcaggccaattcaagcataatttacagtgaagaagaaaccctttaatagtgatttcgcatgtagagaaattatatttttaatataaaagaacatcacaattttttaacatgcgtgcatttgaaatggatacttacaaattatcagctaacatgggacatttctttaaaaagcatgttttccaacaattgattgcaaatccagtaaagatataaaatgacctgttggttttgagatattttattcattcatctcttcaatacatctttagtgagtgtctactatttgctcaacactggcatgactctgtattaactttattattgacagctttgatgtggcacattctgctgtaatattgttgcttatactatactaatagtggaaactattgctcactaactataactagtttaaaataaaatctgagattaaaatttagcatttaactttcttaataattgagattattgctgaaatcattatgaatgtttttagtgtagggaactttgccttgtccctcagtgtactagaacagtgcctgacagttaagagtgcaatgtaataactaattcagtaaataagtatgaaaatctaagaaatgcagaatgtcaattagaggaattatgctaatgatgaaaggctacgaaccctggaaaaaattttcatttcaaaaatatacataatattctcgaaatataatttttatttatatttaaaaagatgtgcataatttgtattaaatacatatgaatgtattataaggtaaaaaagatgcatgtctatatttaagtgtgggtggagagaaatacaatctactctatttaaaagtttctaaaatgtacttgtgaaatattaatatttttcacctaaaagagttttttcttttttcttattcaagaaagttttctctttgaaatttaatgtagcgcttaaaaatattcagtgctttgtttaatacgcaaacttagcataattggattttgtgagcctggctcttaaaacactatgtgaaaactttttctctaatacacttagttcaatatgctttatactttttatcaaaactttgtaatgaattttaaaataattttatagctagattattttataggtaacacaaaatattttccaagatgaagttctttgaagcaaagtcattaattttgttatataattgaatttagctcctactttttaatctaagttacttttagaaatataaattagaaagtcatatgaatagatagactccttattgaaagtaaagtagcattatcttgtaattgtacagtaagaccaaacgcaaatgtgacaaaccaggttaatcaaataaatggtcattgaaaattgctattaaatgtgtaagtggtgactaagagaggctgaggtaatgataattatatttccatagttttctgataaagtagatgttttggatggaaaaaatactgaggtgatgtttatttacttattattttattctttcatttaacaaatattgatttaaattgacgctttgccaggcactcttctattactaatactaaatttgtgaacaagccagataacaaaactgctctcagggaacttaaatctgggaggagaaggcagatgttaatacattataactatggtgaaatcaggtggatttaattgtgagaagaaaataagaaagaccagaaaatgatgtggggagacagggccaatttagattgaatagtcaaggaagtctcctttgaactgagatccaatgacaagatgccagccattacaagattgtgagtcctattctctaggcaaaagaaagagccaaatgttccaagggagagagctgatctcggtgtgtctgaaaaatggagagaaggcacattagagtggagcatggagaactggaggaaggaagtggagaagaggctagagcacatgcaaagtacaccacatagggccttgtaggccatggaaagaactggactgaactacaagtatcatgaattgtgaacagcatattggtactatttataattttagaaatttcttttatgtggaacaatagctgttctatactttttatagttacatgaatttggattcctgttggtgaacattcttatttcttaatttgaatactcaataccatcaaaatgcatgtaatttttaattcattgcggtttgtcagaacactagaggcaattaaaatcatttgacatagtattttcctttttatccttttacatgaatgcatttttcagttatttcaaaattcaattgaacaaaatctaaaccatttatttcactatatccttcataaaacatcacactttttaaaacttgtatggatatgtatctctatctgtttgattttatattaatccattgcttctctaaccagaaagaatagtagtgaacaatatcttttcaggttaatgatttaatgtgtcatgaaatttttcatgaagtgtatcatgaaatgtttcatgatgataaaactacttattttctaaaaacattaactttgaattgaatgtggacctcctaaaatatttttttccaaaaagaaagtcttcttccatgaatgatgaagattagtgttggttactgagttcgagattttattttggtgtagtattttttcccttttcttcattttccagacatgaatgtctgccaaacacacactgtatttaaacccctgagaagttcaaaagggattggagacagcaaagggaggtcttttatatttcaatatcctctgtaattaacatttctgtcttagcattaataaaactaagcttttgcctacttttgcttttgattttagtggttgaagccattattatttgtgcaaaaagacaatctagtaacacaagtgtaaattggagggtaatttgaagagataatttgctgttgtgaaaacaagtccaaatatttgttcatgtagttgttggcaaaatggtgatcatagaccaatccaattctcctcagacaccaactggttgttgttgagtgcttggccttcacagtagtcatgtgatcaaactccatcatacatgcttgaaacatctttaaaaatggagagtactcttaatggatgaaatgtggatgctgcctccttacctctacattcctaaaaataatctacattcctaaaaatacacttcaaactggaaaccatcattctcagcaaaccaacacaagaatagaaaaccaaacactgcatattctcactcataagtgggaactgaacaataagaacacatggacacagggaggcgaacatcacacactggagcctgtcatagggtgggggatgggagggagggatagcattaggagaaatacctaatgtagatgattggttgaggggtgcagcaaaccaccatggcacatgtatacctatgtaacaaacctgcacgttctgcacatgtaccccagaacttaaagtataataataaatatgtatatatatatatatactttaatactgattatgctgatcatataatcgcaattacacacatagtgttgatcttatgtgtgtaactatgcccactgattcttgaaaaaatgacaatacatttgtttacataaattgtaaagaatccaattgaaagcaagctcaacatatagagtagtaaaaacatgaagtgtatcttagggacatctctgtaccttccacatagggcaatataataggtcacaatttataaacagccatctaccagtgttagttccttataaacaatgatgcaaactagtgtaggtaatataaactgaaaatatggaaaagaaaaaataatttgtcagtaataacagccctcactttgaactatagcaatactattgatgaatatcagtattattatattttttccaggaggtttctcatttttctagaaagtggtagaccttgagttttttaacaaccaaataaataaatatacaaaatcaaattaaacataagaaatttaagtttatttttttcattgatgtgggtgcacacacattaactgtaaagcagaagtaaattgatagttggttattttactggcaactgtgttttgtttgatcttgacatctgatactcatgaaatttgtagcgtgctgtgaaagactctgacactattaaaaatttgaagctccaaataaacatactggatgcaccattttctgaaagtcatttgtgagattatgtactaaagcaagggtcttaatttcaagtcttaactattcaaactctactaacgtaagttctgaaagaggaattagggtcatagtattaaatcagctggatttggctacaattttacagaatcaattcttaactcagaaaattgtcaaaattcatttatcttatacctcatgtgaaagtagtatggcagttcatagaagtaaaataaaaaatcgtcaaatctgaaatttatctttcaaataaatgtagatacttttttgtgttttatcttaaaaagagttttgtgttttatattaaaaaaagagaaaaatctcaaaatatttatacatatacaaaatatatatacaaatatatattatatgtatatatatttttgagatggagtctcactgtgtcgctcaggctggagcacagtggcacgatcttggctcactgcaacctctgcctcctgggttcaagctatcgtcctgcctcagcctcctgtgtagcctgggattacaggcacgcaccaccatgcccagctaatttttgtaattttagtagagatgggttttcgccatgttggtcaggctggcctcgaactactgacttcgtgatctgcccgcctcggcctcccaaagtgctgggattacaggcgtgacccaccgcacctggataaaatatttgtatattttatatgtaacacttgttttataattatctgtacaattcaataggcttttattctttctgcattctataaaaaggttttctttattggttaaagagatacacatatattaatttcaaaaattgctgaatgaacatgatttacaatattctgaatatttaataggtatgtatatttatcataatcttgaatgacaaattataagatagttatacataaattaatttataaatgtgccaagaattttcttatagtttttgaccatattttataaaaagaaatttttgtaccttttaagctagaggacaattctcttaccccattattttttttctattaaaaaatcacatattattaaagaatcacagttgaatctgtattacagaaaacttgatctgtctcattaatggaaccaagtaactactgtattcagtaagaaaaataataatttaaacagctatatatcataacagttattagaatccccggtaaccaaaatttagtcataaaccaaatttactaatttttgtttttatagtgaaatgttacaatttaaaaaacaaactggaaacactagtgtgtattgaatttgaatttatatttttatagacaatgttttcctataaatatttgtgagattttaaattggtcatgatctgcatatgacttagccttatgatacttctatattaagttacatgtgatttatccattggaaagctaatggaaagcttagatacattgaagagagacactattaacgtgtaaaaatataaaatttgaattttttagtaagtattcaatgagcacctactctggaaaaaaataatgtactggatctttggagaacatggatgtataaaacatcataacctctattcaccagttttcgagtatctcgacctaactctgcccaaggatgaaactcattaattctagagtagctcatgatacgtaagtcaacctgaaacacagaaaaactatctttatatggaaaacttttaaaaagaaaagtgctgcaagataatgttatttgacatttgaagggaagagatacatattccattgttcaaaaatgatgcaaaatctgctccattacatgagtaatattatatgagccatagtctatacaacataaaaatacacaagtggacattcttagtgttctaataacatacatacaattttaacctgaaagatcaaattatatatataattgtcattggcaattaggcataatagaactaaatgttttagaagagattttatttttttggtaaaagatttcaaagtttaaatagaatcaactttcacttaaatccatttaatagtttgtaatattgtcctatcttgagtctcaattatcattgtatttaatcatcttataataagaaggccaaatatgaattaagcaatctcctaagatatctcataaaactgtagcttttttgttgttattgttcttacctgaatacatccaatagtaggcactgattacttggtaaggcaattttttgttccaggaccattctaatcttgagaaatgtcttcctgttttctgtgggccagaaaagtttatcatctttctttagtaacatgttgccatgattttaaagagattaattatctggggccagcccatagttccttcttagtagaagtacagaaatcccgcggggggcgggaactgacttacctacacacttccacataacatacaatgggttttgccattaagatcagctttaggagtaagaatccaccaatttcatggagaattggaaactctccctatccaaattatctaacttgtatgttgacagtggtgtcccggtggtaattgaaggaaaacagttgtaatagtaatagctaaattgtcttgaacactcactaatatcagctttacattcaatgtttccttcaaagtcatacaatttatgtttactaaaattccttaagcaggaatggttgggagaaaggtaaaccatctattcttctcccctaaccttttattacatggcatctacaatatattggattttgattttcttactgttgtttattttcattttatttcagtttcaataaaataaacctaaatacctgaacattggactattattccttttaagggaaatgacctaggaaaagtaaagatagagttttttgacctttttaatttttttttaaattacagcacattacaaggctattaaaagtgttgtaaataatgtaaaatctatttaaaactctaatatggagaaaaattactctaattatatgtgctgcagcatcaaggaagttttttcccccaaagggcttctcatatttcataaacactgatgagttttcccttcaccgaagtaacatcaaaattatatttgtaatttagaagtaagtctccttgtcagtatatttcaaggaatctgaagaaataaaagcactatttttagcatactccaatcaagccagtaaataaagatatggaatatataaatataaagaaatttgtgtatttagaaagtacaattataaaagaggttcctttcaatagaagatgatttattgaattattttctataacattaagaaagtcttgaaatagaaaaaaaaacaaaatgaaatcaaatattaagttctggtgattgattttattgtaggcttttgtgtatgtattcaaaaagtaggaagatgttctgagggaaaaatgtatttcctcatgacaagtggaagttcattcaagtatttaacaaatactggtgagtacctgccaagtacctgattctaagggctgaagatatagcagtgcccagaacagaaaaagataccaaccttcatttagtttatgggataatagagagaagcagatagatgtactaagttgtaaaatatttagtatgtcagactctaaaattctatagagaaaagaaagggaaaaaggccgtaacagcagtaaatacatgagttgtctgtgggccacaaattcatgcgacagcattcaagttgtgagggatacactggaagtcctggcctcttgtggaaattagagtaaacagaggattcattctgcctgtcttgatgcaggtcgtggacagactgggggtgtctgtcctggtgtaagaaatgaccagagtcctgccaggaagaagcagtgttctgggctctatctttactctgctagagcaccacggtatccctaggccgtattgatcattctgtcattttcaggttaacatctcatcaccaaaacatttattttagtgcctactgtgtcaaacgttatgctatatcttgtgcatacaaagaaaattaagacttcataaccgcacatgaaaagcttaattctggcactttaataatacctactgctataacttttgatgtaaattatttaaagataagattttcatgttgtatttattaaagtgtacatttatggcaaagtgtgtttagacagggaatttaacatttattgaggtcctcctcttgtttgggtttgtggtaggtgcttcaggtacattaccttataaaatcaccttaaaacattatcttcagttgggtgtcatgtttcccattttaaaagaagaaaaaaaaagatatgcaagttcataaagcaagcaagtggcaaagcagacaattgaatcttaagtattcatttattctttctgtcaaaataggatgcctgcaaaaaccaccccataaaatagattcattctgtagcttgataatattatcataattacctatacaatatggaaaaatcaattagtttatatgaaaatacattaaatcagaatatattacataatacataaatagatttatgtataaatcagaatatattacataatatattatatattagctctctgggatatcacttgtctagttaaggaccaagagattgagtttctctagcaaagcaaaatgattacgtttcggtaatgattcttagagatttacatcgtcaaagcagttctttccagaagttgcatacttattagagcattcaacactaaattcttctcttatgtactgatgaaagtatccgaagatgagctgtctgaaaccaaaatataaaatgccaagtgccgttaggtcaaacactctgatctgcctcccagttattactgtcatgaagctaccttttattttgtcaaatgaaataaaaatgtgagtttgcctatgctttacaaccaaaaaagcatcatcaaaaccacaagttcttaggacttaatagaagcaaaatgatcaagatgactgtttgtacaaagcattgatctgtttctctgctttatactttgaaggtaatgagtaatttaattacctctcaggtatatagagaaaagtttttctccaaacattttctagggtctgaagtatctgaaattgatcagccagcagccgtgtgatcacactgaaagtatgcaaattttggttttgcctaaaggtcaaaataatagaaaatcacaccaagctattaaaatcttactttatttttttgtgtgtttttctcatcttgccagttttcagaaactcaaggaaaataatctgtcaaggattcttcactatctgatcagcctgaggcaaataacttcatctccctctgcctcagtttcctcatatccacaatctccacaattccatgaaaatcctactcattcaactaatattcatggaatttcccatttctaagcacagagggtctttcttaatccattattttagttgaaatactgaatttaaaattacaaattttgaagacggatcagtttttctttttttttttaagtactggttatgttatttctaaatataatgttaccttaagggcacatggtacaacttcaaagaaaccagaagctcaggctacagtctctgtcagttttcataagaacatatctcaacaatataaaactgaacagaactcaacagttcactcttagagcagaatctgtgtcaatcattctgctctaatgatcagtacttaaagccaagatattttccccaaacactaaaatatggttttcccatgttccagtggttatttggtaatatttccactttaccctgtattacaacttctaatatttctataaataaaatagacttaatagaatattgcagtggaaatgaataaaaagaattcatggaaagagtcggcagagtccactattttggcccttagtaaagtcatgacatgtccaggtttaacctcttatctggaatatgcagaaaatcaaatattttttttacttcatttgggattgatcaggttctgggacactgatctctattatatgtttcataaagaaatgatttaacaatcagatcatgttttattaatatataattaaggcatttcaatcaaccaaaagattcctaatccctgcaggacaaagagggcatggaagttgccttttatgacagactctgtattgctcctccctgtggatatggaatgatttctgcccagaaatggctatcttaattggcattgcactgagtaaatatattacagttactgttttttctagcctccatgcattttttgtgctcccattcacaattttattaacttattgtaaatatttccaaggtgaatggttatctaatataagtgtatgattagtttaattactttatgaaattaaagtatgctatgatttatcatccatttatttacaaaacatctcagggtgagttatttctaaattgctttgcttcgtctgtttccttattttctaggtagaaaaataatttattttttttcttattacatcttcaaattgttttcggtatttataattcctttttgctcttaagattctgattaaattctaactgcaacacaaacaataaatataagcttatgctttatccatagggaaaaaaatccagggacatgtatacccccttctatccagagagaattgttatagaaaccattctaaccagacttatttgctgacatatttttcttatggttaaattttggtcctcttataatctaagcctagatagacagagacatagatatagataaagattttgtcctcattgtcctccatgaaggaaaattacagataatgactaatcaatataatatctacttgttttcttgaacattgccatcaccaaactagtactttaataactaacacctatctcaatataatccatttcacttttggttgttgtaattcattttactgcaatcgaataccatgttattctaacttagtcttcaaagtgtcaagtaccacccacaacaggttgttctttcaatttttaaaaaatgtactctctctttaaataatagtcattcataaagttatcagatattactgatgccctagtaccatctccaatattgtttgaccccttcttcctcctctgttcacatatatccagcttggcattatcagcccccaaccctgttgtttcctgctttattcatgtacatccaagaatcactacatttcatatctagaaataaattagaaattgcttcctcaccattgagtgggccccagaactatttacctactaggttgtaagcttcctaaggaagggcagttgtcatcttacatttgtagcccaaatgcctagcatagtccatgtggcatagtaggtgtttaacagatatttgctaagtaaatggatgagtgaataattggataaacaaaagcatgaacttaaaccctgacctccttgcctagttcttatagttcctttattgcatatccagtgtgtcagttcctaaacattcaatttctgcctactgccttgtactaaacctgggttaacttttttagactctaggactcaaataataaaaaggcttagggatttttctgcccttttaattgatttctcagctcatcttaaatccctagatatttacatccatctggttcagactgcaaacatttatttgttgattcattcaattggtgtatattgattttttaatgtaagttgttgaattttgcatgcaacagggagtaaacacgcaacaagcaaagcccttgccttcatgaaaattgcagtctagacaaatagagtaattagataattattgcaaaaacacgcaaagttacaactctgaaaaattctacagaagagggtaaaatataccgtgttctgagagctcatagtaaggaaacttgaccttatcgaagaatctaggctttcaccagtagtgtacatgtgagctgacaccagaaggacaaactggaaataacctagataatgtgcatgggaaagagaatccaggcaaattattgagagggcagacaagagaatgaaaagtcccctgtatgtggaagttcaggcaatgcagaaaggcatgtgtaagaaaagatcaaagtagacatagccagatcatgcagggccttttagattatggtgagattttgtttaagagtaatggaaggccactgaaaggtgttgaacaagagaggaaaatgatcagatttgatttttaaattatcatccaagcttcagtgttgtaaataggtgaaagtagcactaaggtggatgtagacagattagtttgttgtcaagatgagttttctggcttgtacaactagacggatgtgggtgttattcattgagatagaaaacacactgagtgtgtgggaaggctgtgaatttgattttggacatgaatatgtgtttggaaataaatcctaggagagatgtcttatagaaaattgaatatattggttgagagctcagagaaaataatttgtgtttaggtagtaattcaagctgtggatgtggaagaaagtatacaataaaaaaatggagagcctaagactgaaccttggggtgcgccaacatttcatgtctatgtacacgagaataagcctgcaagctgatagaggaaagactaaaataaggcaaatatgtgagagaagacctggaaagacatggtttaagagtgagagaagatgctgtatcaaaaaaaaaacagtctcctttgagatcacctaaaaactgaaaaatgtctgttagatttagtaatatggaagtctttcgggatcccagcaagggctgtttcaatgcagtcatgggaccagtcaacacaatggtgtggggtgaggagataagtaaagacaactccagcctctctgagactttttggtcatgatgttggtgacaccttgggaaagtgaggagacttaaatgctggggaaacatttgcgattgcctcatttctttcactttattctaaacatggtagtgatggagtcctagaggctccccattgggactacctactttgttaaattactaaatgtgatgaatatttgttgacaatagtacctaaaaatttgtattaatagaatcataaagtcttctacaaggctcaaagtccaacataattgatgacatcgtgtctgacttccaatattcatgacttcccaggtgagtttccatatttctgaaagttttctctgtaacacttggaaaatacaatttagaattgggatatataagaaagataatatcagggatggaatgttaggtgtatctgtcatttgtgatattttacaaagtgaaaatagatttattcatatatttttaccccatcttcttcctttcgtattctttttttcttcttgttctctttaagaaatgaatacctaatgtttattccgtactgtacaaggcactagatgataaatagaaaaaggaaattatgagataatgataaatacactgaaattgctgaaaaagaaaggctatgtcagaatgaataaagataaggttaaagagaatagcattgagaggacaggtatgatagatacttttgaatgcaaggctgagacgtggtggagaataaagcagcattgaaaaaaataacatttaacagagatttcctagcagctctgtgaaggtctaaaaataaagagagtttggttattgtaataatctggatatcaattttaggaagtgtatataaatgaaaatcattatgtaatggaagtagtctgaagactcagtaatcaacaggggcatgcaaaggtaaaggcagtgaatttggaaataacaggaactttttaaaaaagatgctttaaaagggagatgttttaaataagtaaaattataattattggcttattgggcatcatgtgttggtaggacatctaagtgttcatataataagcaggagaaaatgctcacacacttggggttgccctgtaactcacctcaaattatcactgggaatacccacttagtaactagcattttctaagagatgctctacattgataaatacaagtgaaaatgtccattgattgaaaatatgttacacatctattagatttatttacataagactggaaagttatattttacttctaattataagtaaagttatttttaatatattcacttctactggatgttattgagtctattcttagattacctaaatagaacatttcaactttgtcacagaaaatgtacacaataatcttgattttccatttaaaattcttatgaagaaggcttatttttaagaactaaattctaaattttatttctctgttcttcatagatatgttttatttaattattgaatttattttgttttctttcaaaataatttttaagcatattcattttgcatcaatctacactcattgtaaaatctaacattgacttatagctattagttaattttaaactaagcaaaatacactctttttgtcttattaattgtgtatttgagaagatccataaactttgaaaaaattctatttcttcaagaaacaatttttaaacttctatataatgaaatattaaatactttattatagttaaggaactttatatattttttctctagatctcataatgatttaaaatccatacatgcttcaaaaatgctttagtatgctcatttctccaattgtttaactgaaaaatatcctgtaatgaggtcagtgattattttttataaaatgcagaattcctcattcattctttactctgaataagtatttaagtagctttttccagtatgagttgtttgtttatgctttgcttgattgataatcagattctttacaacttttatttgatcttgtaaaatatgtgatttatttaacacaatggtgggtacatgaaatgattaaactaatagtaattacagtctaaccattaaccagtgatatagatggtgaacaaatcaaccttatgtatcactagtcacatacatggggatattggaagggtatcttgctatccaaaatatttattgtgtctctaggagtctcataaaaatttaagtatcttgggaaaaatgggtatgttgtaaagggcattgaattgggtttgccttgagaaaatcagttaatttctttaagtttcagtttcttcatttgtgacatacagataataatttttacctatttcacaatgttattctgactataaattagataatataggtaaatttatcaaaataaaaagatgatattaatgttcaattaattattcttttgatcacctatcaaattaatcactaatcaaaattctgaggatatacatatatatatataaaagtaaattttcaaaggggcattgggaaatgattgtggatcttttacattggagaaatgggtattgcagtgaagataccctggaaactatttctgtgagtgggaaaaagatggcttgtggtgctgataatgaagagtgaggtgcataactgggactagaaacacaatggaaaaattctatttcctggtttgtcctggaatctattctgataacagtctatggcctctgcacagatgttttcatatggattagccaccaagcagtttaatgcattaagcctactataacagcaacaaattataatttgtttgtattgatgcacatgttagatagatagatgatagatatgtgagtatagatagatagagcgatagatgatagataggtagataggtagatcgatagagagacagatgtttccacttaaatgccctcatttacataagtttaaatagacatatgaattacagctcaggctgatttgacttcatttatggttcctataccttttgatgtttgcctaaagatatattcagcttaagtgctatattaggaatatttatttttcttcttataaaatctctgaattcaagaatattattttgttttctatgtatttttatgtattaattcatgtaattaaatatgtacacttgtgagatatgtacacagaatacagagtttgtacatatgcagacaattataatacaaaagtgaagattacaaatgccacattagtcatacagaatgtttggggattccaaagagggtgtgatgacttctcacaggtggtgaaagtgggcatcttagaggaagtgtcttctgagctgtgccttgaaagataactagtaatctctttaaaaagatagactggaactcaactatgagctattgaacgttttaaaatagaaaggtgatgtcatcagagagatgctttaggaagattgaagtagtggcttgaaccaggtggactggaaggcagggaatgactctgcaggtaaaaatgcagtcagatcactattttaataatagatcaaaggttcccaagcactgaaccccctgctacagaagcatctgcagagacttttgaactgcaaatttccaggcccctcctcagggcctaattcagtgggtctaagatatagccccagaagtaatattaaaaacctgcagagtgattttgatgcatagccaaggttaagaaccacaggctgcaatgaaaaagctctggcctcgctgatagactcgaaggagggtgagaagacaagacaatggggtcaaaaaagaaaaaaaatgtagaaatgacacagaagatattttctttcctgttgtccaaatttcaaaatgataatttccactatttgaatttaataaaatacacttgccaaaaagtttgtcttatatatgtatttgtctgtattttatctatagatgtattgaatggttcttttcctgccatttttctcttatttaaaaaacaacaaaatttgtctgaataagcttacaatatttcttttttttctatttattctggctagaattttgaaaatgttttaaaattttatgtccttttacaattacattgatatttaaaatgactctgcttcttaccatggatatttttaagaagaaaaatatcagttgatgagaaagaaaaccactatgcttgagaccattttcagggctttgttatctacttttcatcccaaattctatatatttttattaagattccctaatgcataaggatagaaattgtatttgtaaatgctaacttaaaataccagtatttaattatgttgtgttgatagggatgatttattctagactttaatcggatgtttttgtacctaaatgaaatttagtcttattttaattaaatggtagaacatgccaaaaatgatgggtaaaactagaagaaatgaaccccaacggaagactccggtttcagttatcagttttgtagctgtaaagtagttaagctctgtggttgaacctgccagacaggcattaacattatggtataggattcatctgctgagataagattttctcttatttaactttattgaaatgtctgaataaatcactaagccaaacgtatggtttcttgtttaaaatatattaaaatcatggcataaaacaaaattctcatgtgaagtaaataataaaaataattgtgaatgtatcattcaaaacattttttcaataaaaaatgtttgaggagagctcagatttggttactgaaaccaatattcctttgataacttatttctcttttttgtttcaaagttcagactagttaaattgacttatttctctcttatcctacttttttgtagtcttgcaactaaataaatttagttattacttattgatctgttcgcttgaaccatctgacattttttcctattgtgtacatataaaataagcaaagtatcctttatttataaaggacttggttaattgtacccaatgaaactatcaaaaccttttttaattacttctaaaactctattctctgttcaagtctccgtgtttaatatttaatattgaaaccatagtgtttactgttttgctacctaatttctttttaaagactttattttttagagcacttttagtttcacagacaaaattgagaggcaggtacagagatttcctatgtacccccattctcacagattcatttcttttttaaaaatataaacttgaaaacttttctttttacaatcttaatataaattctcaaagcatttacaattgtccctgtcctttattagaaaattctcgcccaggctggagtgcagtggcatgatgatgactcattgaagccctgacctcaaaagcaatcctaccacttcagccacccaagtacctgggaccacaggcatgcaccaccatgcagagctattttttttatattttgtaggaaataaaagaaagaaagttctttcctatattgagttgaaatgttttcttatatttccaccaatagctcaatcccttgtggctacacagaacaaatcttaccctacacggcagcctttcaagaatttgaagacagttgtatttatcctcctacatcgtctctgctcttggcagtttttcatgagtcatggctttgaattctttatcatcctgtcttctgaatgtatcccaattagtttccatacccaaagttgactgtaggacccagttttagtctgaacatcacagcaaaaggaacaatgagagcacttggacacaagaaggggaacatcacacactggggcctgtggtggggtgaggggagtggagagggatagcattaggaggtgtacctaatgtaaatgacgagttaatgggtgcagcacaccaacatggcacaagtatacatatgtaacaaacctgcacgttgtgcacatgtaccctagaacttaaagtataataaaaaaatttcaaaaaaaaaaaaaggaaaaccaattttgttcttgagaataaatttccgttaacaccccttgctgcccacccacacatccccacaaacctgcctaatgagattagctttgaagatggttgttttgtaatcttgactcatattgaatttaaggttgacgagaattgggccttggacagaactaaagcctacgttgttggatagcctaaaacacaaaatttgttaactcttaagaattaatgttttatatggaacaaagtctttcaggaattctaaaagtcatacatcaataaagagatttttatgtctttggtaaggcttttaagtactgtcatattaaatcctccctaaaataatttagctcagaaatgtacaagcaatattaacacaggtttttttgcttaaatagttcattagcctctgtaacttcttgaatataaaaaataatgccaggatttttttaaggtgtctttaaatctgctagcaagttaaagaaaaggttaaactttttcagacgctatgctttaatgaaaacaacagaagacacatgttttattgtaaataagtagataacttttctattaagatttggagcaaggctatgcaccatacatgctctgagtgggcttgattcctccagggaagaggccaggaaagcattgatgtgaaaacagcctttcccttgccattctctccattccaggcaggttatctgccaagaagctcatccctatctgtaaaactgccagcatcagttcatgcagcattcatgtgtaatttgctttttctggagagccataccagggcagagttgactgattgagggaattaaaagctacagactctgggacaggagggctgccctgtgggtatatgagctggttacattttggccccttttcaaaccagggatatgcaactcttgatatgtatgggaaaggcagaactgccaatactgacagcgctcctgagcagcgcaaatgctccacatggcaaatgcatcattcacagaggactcatcagagcagcacccagaaaaaaaccaaacagagcaatacacagagagaccaactggggccagattttgtatataaaacattcctcgtagagtgacttataatgggtagaaaaaggatacgtcctgaatggcaaactattatagtactgattatagtacatccatacaaagaaatatcatgcatttatgtatgatgatggtaaagaaaaacctttaagatcttcaggagaaatgtttatgacatactaaattaaatattaaatttcagtgcagtatgtatattgttacctcatttttaaattcttaactaatttatttggaaagaaaaatggtaattaagatcaagatgtggagacaggacaaatgaaagattataacgaaaattttaaaagaggccaggaaagcattgatgtgaaaacaacctttgagatgacagagttattgatgacttttcatgattattaattcctgtctttgtgctcctatgtgttatgcaaatattccacagacaataaagttactccttttgtaatgaaagtctgtgtaattaaattttttttaaaaaaagttgtgacaggtataaaagtttctggtttatgaacaataaaaactacctctggggaccttgagcaaaataatgatgggttagaaggctattaaagaactcctagaatctgctgggtggctagatccaagcttctgaaggatgtcaagggaagctccataccaggtgagaccagggagctgaacacaaagctggatcaggcagaccaagagaatagtctggctacaactcttccacttgacaatcgatctgtgccacagcctttgacccctgggctgtcctgccatgaataatcgttagttccccttacatttttgctttgctttgccaagaaacaaaaacttaaggtggtgtagtatatatgcagtatatattaccaccccatttcccatggcatatgccgatgtctgagcttccagggacttgcatgtatatttactgcttcctttggcttctagtgaaggcatttctcatattttgagatttctgtaactccctgcctccaatagaaaggtgttggatgctaagtagtggcaaatgtcctgcacatgaaatgttggaatagaagataaagtattgtgttagtacgtctctggatatttttaaaatccttaaaataaatttttacctgtccaagaaagtctaattgtgtgtgccacaattcctaagactctagaacatttccataatttgtattatatatgtcaagcataatacaaatacattgtcctagtgatcaatgtgtgatctgatttatgtatgcattgccagcctcagacaccatatattagtagcaatatattgtagagtatcattgggctatttttttttcaaagagctatggaatttagtctttttgaaatactaaggcagaaaaatgtgaagctaactaccgaaatttaaataaaataaattttcagttatgagtgatatatagtaatgtgtctttattaatggacttgaatgaaatgtgcaaactaaattaaaatcttggaaatctataattaggttaataatgtagtgatgacttcttaccagagaaataataacatttgataggatatgcttttttctttcataagatgttttacaagataagaaataaagttatagatataatacctgtgactgggttgtcttatgagctaatagatcgcattcaacaaatgaaaatgaaaagacaaaatatgcatcatagacaaacagatgatgccatcatctatgaatgcacagtatgggttattggaatggctttaacacattgaagttggtctagtaaaaattcaagaagcaatttagtttttaattcacatgttttaatttcttcttttacccacttaggtgcatgcatttttataaacttttataaccaagttctctaaataagcattttttattaaaatgcttacataaccacattgagaatagaaatagctctttaaatattgctattaccttggggtatataaagtaagtctcaaccggcaattcaaaaccttctatgatctattcagttgaaattaatcccctttctttcccttcatgtttccactaaactttgctttaacctttattatctgattcaagtttgtattatatgatgctgctaataatgatgataatgatgaacttttagtgatttgcaaatcaaagattagacagattagcaggtttgttcaaggccatgcagctgacaaataaggtattaatactaagatccagtcctcagcagtcagacttgagtccatagttttcatttctacacgattgatagattatctattttcttctctgcatcatcagttttttgaaggtgaggcattgatttttatttagtattacaactttgaagatacttaggaccaccatgaccaccaaataactaaaattaaaagaaaatacaccaaaaattttagtacagttgtatagtgtgattataagttctctatctcatgtttttaccactttaatttttttaatattctataatgaacagaagttagcataggggaatactttagagtagaaattttggtcaaatacaacggattttaaattacttcttcctcactttacgactataacaggttatctattgcttcatctaatccatgaattgggagctgttggtgaaaccgatactcaagtttgttgtaacaactatatatacacttagagtctctggcagaaagcagtcagtagatgctagttattatttttaaatcaaacaaaatatttaaggagagactttaatattcttaaacataacccttcaaatccttaaaccagattttttttctgtacaagaaagtctggttgtatatgctacaattcctaaaactggaacatttcaataatgttattacacagctcaggtcttgattctaatgctcagggtggatagaacaggcaaaaagtgctaggtaatgaagacatgccccaccaggcttcttcccattggtatgctgccttgacacagtcatatttaacagtgaactctgtttggaagcaatttatatgcatatatagatatgttcacatggcgctgctgagataattacaatgttatttactagttttgtctggtatttctgctatgtctttaatgacaaaatgctgcagagacacgggtgagagagacaaaagatgatgaggatgaggtgattttgtaaataagcaaaaagaggaatatttttgcatacttttgtgctggatgaaaccagtagaagagcaaatttaggtctaagagaaggtaataaattatatgcttaaatcaaatacctttaaagaataaaaaaaaaaacttttgatcatcacaggaaaaatttcaaaatattttatcttgcatcaaaaagttacatctaaatattacttcataaaaattatcctagggtttacttgacttttctccatgcaattccaaataaaataaggttttatgaactctgagattctttgaacagtttgaagaacttgaactggaatatctcttacactaagcacaggagactgttctccatatttaacactattttcacagtgtatactaccatatccagtacatactatgtgctcaataaatatacaatgaatgtgtaactaatagagtcaagaggcataaaggacttggagttgcaagacctcgcttcaaccctaggctttgccagttgttgattattcaactttgggctaataatttatcatataaaatgttgtttattatattaaattttaaatatataatttcttaagaaaacatattataaagtaaatttatttatttggaaaattaaaaaaattctcagactgtattaaggaaatatatgtaaatgatccttgcaaattataaatgctaattgttttaaagtcacttccagggcagaatggcaatgctcttaatattatgaaatcatagagcctctgttgaaagagaccttaaaaggcatcaagttcaaccacatctctggtttttaattatctttctacatagggaccagatggacacatgctgtatatttaactttatctttaaggaaattgttaactgtatccctggtatgcctcagaatgttctctttgaattataaaggagtgttcttttcagtactttatttcattcatttagttctcacacaaccccatgaagtactattactgttcccattaaacagatgagaaacctaaataaaaaatgtggttacttgcccagcaactcaaaactagtaagttgtatagtcaggacgagaacccaggtaatctccagagcccattcccataaccagtacagagtaccctttccatgtgaagtggaatgtgaaaatctcctctgcttcttgcacacgattgtggttgaatgtaaggagcaccccttttaattgcattacagtatatcatccaaaccagcagagtccaatttctatacaaatttcagatgtgaaagaaatattctatatttatgctgtccaatatggtggttagtagccacatttgccttttgagcacttggtatgtggctagtgtgactgaggatccaactttattattttgataattttaatttaaataagcacacatggctgttgcacatgccagcacttattgggcaatgcagtttaagttctatatcaaagctcttcagtgttttctttattggcatgtgttacagctcctatttatatgtgagacactctcccatagctgtaggctgacaagacagagaaagtagtgactaaaagtttagatgctgaagagacaagtttacatcttggctgtggagcttagtatgttactctgagtttagagctgacttacccttaaattgggatgattattgaactacattatagaactatttaaaaaaaatttattttgacataatttcagatttcagacgttcagaatagagacaagaattgtacaaagaataactgcatgaacttcactgagaatctccaaaggtttctgaactctctctccaccccccctttctttctctctctctctctctctgtgtgtgtgtatatgtgtgtgtgtacactttattgttttcatgaacaatgtgagagagtaagttgctggcttactccttttcttttaggtgcatattttctaaaaataaaggcatgatctctcatcaggaaattaacattcactagtcttaatactattatctaatctacagacttaattcagatttcataggtttcccaataatgtcttttatagctaaagaaaatatcatcttatgccttgcattccattttcatgtctttaaacttctttattctgaaacaattcctcaatcttaatttgcgtttcatgacatagacattttctaaataatataagccagttattttgtaaatagtctctcaatttaagtttgtcaaatgtttcctcatgatgaaatttattctatgcacttttggtggcaataccacagaagtgatgatgtgtcttttgcaatgcatcatatcagaaggcccatggtattcactgccccattatggtgatgttaacttcaatcactttattatcgggttaaggtgctgtctatcagaatggtgtttgctagtataggcaatgtctgccaataatttcaatgtagttattactttttccctctgtaatgaaaaatatattggggaaagttacattgagaataactaaatatcctgttgctgcctcgaatttttacacacttctttttgcacttattcatgattcttatgtgaattcttatgatgattgctaaatagagattttctagttccatattttctttacatttattagtcgagtttccacctgaaaaacagcttttttccacctaattatttatttatatcctggtagacatatattattcaatgggttgtcatcctttatgtcattacatataatacatgtgaatatacatatatatgtatatatattctttatatatataaatatatatatttgtatatatttctttatatctttgatgctcaaattgtcctggatttgagttaagggagctccttcaagctagcttctacgtccttttgatgtgtctccataattctttgaatacatccctaatttctggcacaagatgaggtttcataatgattttctactttccctcactagccctggaatcagtaattttcctaaaattcctttattcctttgagtgaaaagtatttagaagcctagatcatgggctaggtcttcttcttgttgctactgggtgtcattgcttctaggccttctcagcagatagcctggaagtaggacttgaaatattcatgaatgtataattatctatatgaataaatacatataaaggcatatatatttatacatgtttatgagtatatgtgtcactacatatctatttctatttttatgcctatctatgtatctagctatccatcttaaaactcttaaattcaaactgacgcctccaaaatcaacaccttggagttcattctatcttctcccttttccatatttgtaattcccttctctaatttagcaaaacttagttaccattggccacaatttattttatttctttgctcaccttagaatatatagaaactagtttccaaactgttaatctaggaatctgagcaaaagctactcactagaattgaatatttgttcagagttgtcttcagactcagagtacatagttctaatagtcaaggttcatatagttcaaaagttaactgaggttccccctaagctgtgtggccatgttattcatttgaaatatgactctgttcatgtttttgttttaggtttttagttctaggagttttttcctcccatgcttgttagttttctattctttttaaagtatgtatgtgaaacattaaaaattcccaaaagtcagaaccataaaatattatactcaagaaggtgtaagtccatcctccctttcttcatagagcagttttgaagagtaaataatattataaatgtttagattttgcattacctggcacatatttaggtctcaaaaaatctaatatagctattcatctaataatcgcgctttttctatgttcaattacacactcactaagtacttcatacctttttctcaatgtatgaaaccaaataagaatgcacatatgtgaacaaaactcttctaaaattttggtattttaactcttactagcaaaatattatttgcaatctttctcacaattaatcacgaaacaaactattgtgtttgatttcctagctaagaaataatggcttatttcattccttaaaaagtagaacatgaatgctgcatgtggcataagcacagtgttattgcaggagtaatatagaaaacatatcagggtcagaactcatttagtggtgccttaaatgtgaagaaaatagctgtaattctgcataaatgttataattgttagattgcagagaaacaaagagtcctgaggcatgtctgaagaaatgagcagattacatgcttaactaattctggaagataaggtttctagattaagtcatgctctgcaagggaaacaaataaagcaagcactacatcattagaatctattttattttaatgtatttctttaaagagaaagctttgattctggaaatgtctgacattgctgcatttttctcatgaagtcttctgtgcatacttaactagtgattctaatacgtatattttactagtgatattcagtaaatatgtcagagaacagatttcttctcttggctaaatgtttgcaataaaatttctggataaaatttgaattattttcctattttgtgaatcatatatccttactaaagcatctttttacttcttttttgatcatgtataaaagttattgagtatcataagaaattttaaaacattttatttttatcacataacaggaatggaataaaccaaaaaaaaagtatacttagaaaactcttaaatgacaatacaactatgaatcttaaacatttttgggaagcaaatagagatgacatatcaagatcaaattgtaaaatccatgtaagtatcaccagcatgacaatctttctaagagatgtttacttttagatatactccctatattctttatagtatatagaaactttctttgtccatatcttaatagcagggtgaacttagaggtaagttacaagttgcatacatttaaatgttaattttaatgcacctttggtacactttatattttgaattgaagggaaattttaattctgtaacataagtatcttaatagatacttaatcatatatccagagatattaatagatatccagttttacccagaattttcttaaagtaatacacagatgcttactgattggttagtacccttctttcacatttctgaggtctcatcttccaaatgaggtagattcaacaacgtttccaagttgtagctcctcaggacccaagtcctctccatgctgtggctagggcttccaaagtccctcatttccccacatcaccactcctctttaagatctccttctttcctgatttctcatacaacttttttatgcccatctctgtccttgatgctggagggggaagtgaaactgccaaacatcatcaccaggatgtgcatgaaatccaaccacacattgaaccccagatttccttgggctcttttgaacacccaatctttgggtaagattatttctatgaaaattttgtttcaactttctaaacaattgaactgtaaattttactgtaagattagtgtgcgtcatttaaaaaattttgtgtcttccgtgcgttatgagatatgtcccattctgtaatctctgaccatggaatcaagcttaaatttcatgaccctttctgaaattacataagtgtcttgagtttgtttttaactgatattcacccgccccgcttgttggtctaaatgaagaggaaattatcctaatgactttattttccttctttagatgaaattgttagcatggcaaggaaaaaatatattagcttttccatgtttattgcaataagatttccagtagatatcaggataatttaaggcttccgttgctacagttgcttgcctttctctcttctggttttgaaattatcattaggaataaagaactcattgctttctcctagctaaccgtctatagcataatactaaataccctttcaaaatgatgcttctatttgcatttatgttacttcattctactaattttccctatgctttcactcaaaaagctatggatacctccacactgtgtttttcggtatttctccccgtgttcttctgctgggatttgaaagtatacacttgaacttgaaataaataatagtaattcatgcaatgtaagaaatatgctgctattataggatagggagagagataacttagaaagacataatttgtaacaataaaagttttgagtatttttccttcttggctgacttcgttagtaactatcatagaagcatttgacacttcattttaaagtacagtagtcccccattattctccagggatatattagaagaccccctagtgatgcctggaactgcagatagtactgaacccaattgctgtcaatcttcctgttcatcttccacctacaaatttaatacttattccaccttaactaagcccttatcatacactctagccataacttttatagtgaagtatgacagcaaagcttgcataatttgttttccttcttcccgatttcatgaatagaagactcattcttaccatagacattagcaacctcaacctcagcatactttttttttctttccttaagtggagaactttcactttttcccttaaaggaagcacttcccagcttctgtttggcatatccaaattctcaccaacattactattgtgctttggggttattctgaagtcaattaagggttccttgaacacatgcactgtgatatcacagacagtcaatccatcacagagacggatactaagtgactcatgagcaaatagcgtggacagcttggatacactggacaaagaaataattcacatcctgggcctgtaggagcaggatggcatgagatttcatcagctactcagaatgatgtgcaactgaaaacttatgagctgtttatttccaaaattttttatttaatattttcaaactgcacggtaactaaagccatgaaaaccaaaccttgaacaagaggggaatgctgtatatatgtctgaatcatattccattgggaataatttacataagatatacagcatagctatatctgtataaacaacacaggtttgaactgtgcgaatcttcttacagatgaaacttaagattgttaactaaaaaaaagatggtagaaaattacatatagttttattttatgtcttaaataataataatcaggaaatttggataaatatataaaaagttattagcagccaggcatggtgactcactcctgtaatctcaacactttgggaggctgagacgggcagatcacctgagggcaggagttcaagaccagtctagccaacgtggtgaaactccgcctctactagaaatacaaaaattagctggacgtggcagcacatgcctgtagtcccagctactcatgaggctgaggcaggagaattgcttgaacccgggaggcagaggtttcaatgagtggagattgcgccagtgtactccagctcatcagcctgggtgacagagagagactccgtcccaaaaaaaaaaaaaaaaaaaaaaaaaaaaaaaaaaaaaggttattagcagcaattagttttataaaggtaggaagaatctttactcaataattttactttctaacttcacaatttatgtagtgtttgaatgatttacagttagcagttattacctgtctgagtaggaaaagatagagattttcaaaagacaaattttattttaaaaagccaaatgatgtaatggaaagttgtggagtttacagtcagaaaatgtagcagccatctaatcatatgacttactagacttaatttattccttctgagcctcagtattcttacctgtaaaatatgataataattaccaacctaaaagattgttctgcaagcaacatgtgagaaatgtaagctgcaaatagcaagatacgtcttctggttttgtatgtatgattttatactgacttacagatacttataattgagaaagaatgtggtggggggaagggtggtagtgagtaggaccatttgtaaaatgatgagaacaaaattcaataaagaaagctcatgtttctgtgaagtgggcttttttagattacactaataagtgagatctaagaggacagaggggaggaagagttatggagaaagaggagctgttgatccagggataaaatttcagttaaactggaggaataagttttagtaatctattgcactgcatagtgactacagataataataatgtactatatatttcaaaattgcttataatagattttaatgtcttcaccacaaaaaatcagttgctgaggtgatgaatacattaattagactggttaaaactttctgcaatgtatagatggatgaaaacatcacattgtaccctataaatacacacaattattaattgtcatttaaaaataaaccaatagaaaaagaaagctcatgttgaaaattgaaggcagaaagggaaggaaaatacaatgcaaatatactgtaatacattttcaatcaaagtaaaatagctattcagtgctgaaagtaaggagaaagggaattgaagaaaaagtaacaaagaaaacaaaaagtcaaaagttgggaaaaaaaaatagatggagttaatgactcagagatttttagaaatagcaccaagctgtgaagcccaagaatggtcattcaatttggaaaggatgatcgaagcctcaatcacttttgtagattgataatgacaggattaaaatatttttaaagattttcaccacttcccaacctcctccattgggaggttgggaagtggtgaaaacttaaacataaccaagtgttgcaagcaaaatttgatctactgaatgtaatgcagctcttcatggcttcaggttacgtgagcaacaggtataagctaagctttagagtaatatacagatttgtaatcttgtgccaattgcttttcttccttaagtctcattttcctcatctgttaaatgaggttaaaaataatagctattccataaggctgtcaggaggaaataatgtgttgctatacctaagactgaataaatggtaaatattgttgtagttgttggaaaattctccaggcattgtgcatcgatgatttaagaagttagatattcaagtcaggcgctgtggctcacgcgtgaaatcccagctacttgggaggctgaggcaggagaatcacttgaacccaggaggcggaggatgcagtgagctgagatcgcaccactgcactccagtctgggcagcaagagtgaaagtctgtggaaagaaagaaagaaagaaaaagaaagaaagaaagaaagaaagaaagaaagaaagaaagaaagaaagaaagaaagaaagaaggaaggaaggaaggaaggaaggaaggaaggaaggaaggaaggaaggaaggaaggaaggaaggaaggagagggagggagggagggagggagggagggaaggaaggaaggaaggaaggaaggaaggaaggaaggaaggaaggaaggaaggaaggaagggaggagagaggaaggaaggaaggaaggaaggaaggaaaagaaagaaatagagagagagaaagaaagaaaaagaaagaaagaaagaaagagaaagagttaggtaaatattcagagagcttccatctgcccatagaatgcaggacttcaattcgcatcttgagaactgaaattggttacttagaactgagtgaacaagtgtgtaggcatgatgtagatttatttatttttctctcaggagttattttaacaattttgttttgagacttctaacagactttctggagctctcctaccagctgctattgttctgtgtcccttgctggcaagtactgtctttcaatagagatgagccaatttatttgatgctgcctctggagaagagagaagccctttgggtacaaagtgtgcctgtcatgcagatggcttctctaatctaatgaggtagagagctgagcagtcaggagaggaaggagtgttggtaaaagcagagtctgttctctgcacccacttctcccatctatatatgaatagttagtacaagagccactttctacaagaatctttaaactttgacatgactatcctaaagatgagcacatctgagtctgtgcatggctggtgtatcagtgcagtctgtttggacagccactttcctctgccacaaggtgtgtttcctttttattcttcgtgacagtttggcttataaagtcttcccttattgatgcaattgtgagagaataaatttcattcttcccctgaatctgtaacatctttagaatataatctgaatatcaaaatttaggtttttggtttggttttgtttaattaattcatttaaccataaatacttctgtaatgagaaaccaattgtagcttatagaataacctgatagtggtgatgagggagacataagcctgctgccttaatgctttctgtgcctcagtttcctcatgcatataagtgggaaatatgtcactatcttttactggtttcataggattatattcagtgccagttatatttgttctaaaacacttggatagttatttgtgccttcaaaattatctaatgtcatatgaaaatacaaattttgaaaggatactattgcaatgagctgtcagttttaaatattttgatttgaattttattgaaaaaccaaattccaccttaggttttctatctgaaatgtttaaaatttgtgtaaatattaacatcacatggaaatcatattctatttaaattttttgccatcatttattttttatctgactctccttgtaattttattttcaattgccttcagggaacaatatgcaaactcttcgagaactcatttaactcttgtcaatttgtaccaataaaaatcaaagcttatatagtattatgcaaatattttattcacttggataagagggagtccattctactaagtcagttcttgtattaaaataattattcattttgtttcatcatttcaattataggcgcataaattcttatatcttgtctcaaacacaaaatctcagaacgtcttactttcatgcaaaaaaactaagttctaaaaaagcaaatttatatcaccttaagacgtccaaaagtataaaggttattggacatcactcctggtatccttggaaatatttgtttgattttgaagaaagcctctaagcagtcaagttgagtaatatttttaacttactcttctcgactttgaaagagtgcacctgtgaagaaatatctagggcatagatatttcctcatctctctttatcatcttgctttctaccatgttggtctgcatatggttagatgaatctgtgtgactaataccagggcaatcttgacctcagtgtatcaacttctgtgagcctgtcttgtctaaaatgaatttggctgagttatagagcctctaagaaactcttaccagaggaaggaagacaaaagtttgcggtgggaaagtgaagaggtcaaaaaaggagctagaacttactaaataaacattttagcatatattatcaatataagagtaacccaggaaaatcattgttatggcttctatattcttgaatttagtagtaaaaataatttgattttggcttaaatgtaatgttctatttcttaaggtcctgtttctcaaggtcccatttcttttcactctacttgtcaagttcaagaccatttaaaaaattagtattttgctagtacagtttattaataaccatctcatttaaaagatagagatatatgtcaggtgcactcaactttatgtttcagatcaccttggatactgttttagcattagtttaataatttttgataattcatcataaacttccatcacagatattagcataaattctacaggccaatttttttaataaatccttgttttacctcatcaagagagaaataaagagtgagagaaaagtgaaagagagattgagatggggtagaatccgataacattaaaatttaagggaacatgcctgctttgtgtgtttgtctgtttggttatttccagaaacataggaatctcagtaggagaaattgagtataatgttctgtatttaagggatgcagtttatatgtctttttggtcaatacagttattccctttattcagggggatatgttccaagacccccaatggatgcctgaaccacagatagtagtaaaccctatatacactgtttttacatatatatatgtgtgtatatacatatgtgtgtgtatatatgtgtgtgtgtgtatgtgcgtgtgtacacacacacacatacacacacacacacacaccatacctgttgatatggtctggctgtgtccccatccaaatctcaccttgaataaccgtcatgtgtcaaggacagggccaggtggagataattgaatcacagggtgaatcacttgagtcaaggagttcaagaccagcctgggcaacagggcaaaaacctatctctacaaaaacaaacaaacaaacaaaacaaaacaattagccaggtgtggtggtgcacatctgtagtctcagctacccaggaagctgagatgggaggatcacctgagcctgtggggttgaggctgcagtgagccatgattgtgccattgcactttagcctggataatagagcaagactctgtctcaaaaaacaaacaaataaaacgaaataacaacaacagaaaaaacacttgtcttacatcatgtccggaattgaaaacacctgtcacgcagtcaaaaactagattaattttctatgtggaatatagaaaaagaaagaagttgaagtggaaaatctggagcaaaatatttatattgaaataaaatctgaacatttttttgaaaagatacactgaaatttactacacaaataagtcaaggctctctctaaagaatgtggcatataatttttgtctttagaaagtattagaagcatggtgatggctgcacggcctccacattctctgcgggtagatgaaatcttgaatttaggaattcaagcagatcgtgctttctgcccttagagaaaaggtattacatgttggtaactgaggtataaaataaccaaagcccagatctcgtctcgtgctccacggaaatcatgcctcgcccgagtctataattggctgaattcatttccaatgaatgaaatgcaaaaacatggaaaagactaaaattgaaattttataatttaaaagatttaaactgtgaggatggtacatccttgacctagagaattttgaatctgtctttggacaggtgggcaaccataggaagcaagtaggtgtctggagatggctgcagagacatcccgtcccctcggtagcactgattgcattttccatgaaggttgctcttaacttcaaagcagacactctgctgtgaaggttctgagaggttagttctgggtctcgttgtttcaattaatcatttattcaattaataaattttgagctcctgctgtgaatcaggcagtatgctaggccctgtggctacaatataggcatggttcatgttttcagcaaacgacattttactgctttggtaaaaataacaattcatcagaagaaaggctatatactaagttatagaacagaacagaagtaagaccctccaaaaaggaatgtgaatatacaagaatggatatgaataattttccaaattataggttcagcttgggtaaagaaaactgtgggattagttacccttgctttatgctgagaactaagaaaaaataaaataaataaaataaaataaaaccgttcatgttaatcctttctaagacaaacatgcttttatattctgattttaattttccatttgccaatgaaaggctcttagatagcagttaaaagaagtatataaaaattaaaacaaaaaagaaattattcctaggttactaagtatttaagagctacaaacatatataaaaactaaaaaatttgttgtaaagtcatttgaaaaggagtatacttatctgtagccacctaagctatatcttagggcagagtaagcacagcttgatcatataatctggaaaccagaattatgttagcctcataaagtatttccaagtacaaagagttcattttctttgataaaacaaaggagagatacagtaatcttatagccaaggcaagcctttggatataagatttttaaaagcttggagaaaattattttattataataaaatcaattattgagatccactgtatttatgtcacttcttttagagttacatagaaattttaatctttgtctacaaagaattacactttaaaggaacaatttcagtgtaggaaaggttaaccgatgaaaatatcatatatttgggaatgtttgcttagataaggacatagtattcattgtttcctcatttgtaacatatggtggtttaatcagtattatctctaagtttcctggtaacttgaacactaggattctttaaaccctaaggaattagaattcaaattatgacttgtgtgcttcctactatataattgaaaagttaaaccttgcttatttactgtttcttaaatcattacatatgtgttacgtcttttaagcggcttttagtataattcttgtagattggccttgtaggtatgcctgtttattttctttattctttaaattgggtatttatagataattaggaggtaagattaattacaatttttcctttaaaaacctacttttatgttcactaattaaaaaatgcatattctttatttcttagtatatgtagactatatttttctgactttaaccgagtttggcaattttgcatgaacaagcaagggacactttattcaagactattgcagtaggaaaggaaggccagaattcagtctgagctcaactccactgaaataaaaggcagaaatgttcttaaaagcagtggtgggggaatgttaagccataggtgtttgttaattgtctttaccaaatggaaaggaaaactttctcatatcttccaggcaagggatggctttgcaacttggagcaaggtacccctgaaacttaggcttctaccctccaaaagacaggggaataggagctctatcttccttaatgatgacatttcaaaaggatggctcccaggtccttgagaaagacatttctggttataaaactgacaagaagcttttttaaagatttacatttcaaaggaggaaatattttgcaattacaagttttctaaagcaaatgctctaagaaaaaagagatcaagggcctagaatcaggaagcagcctgtctaaaatttagtcaagctgaggggaatgtttagtccaccttggccaatatattagcctgtaatttaacttttttttcgaggtcctgtgattgtgggccttctgggtatgactcatttggactcttggagataggaggaacagtagggatgatgctttgggtactctcctttactctgctatccactatttatttcttgagaagactttgtggcctttaaattctataagttgagtagaaattaaatatttattctggtaacaaacaatgaaaatgtatcttaaatcagtgagattgcatagaagaggattatcattgaaacacaattattaataatatttttagtactttttttagaccgtaaacatgatggggaataaaaaagagaggttgttatattacaaagataaataaattcaaatgtaagtcaagataagcaactacttaaatagaatagccatattcttctattagctgcttcttaccttccaactgaagttaaaagagaaacggtgtttatgtgtcattttagtaagaagactgtaataattacaaattacttttttccttcagaatcttctcaacaaaaagccacaatttctggaaaattctatagtgtgctataatgctgaaaataattcagaataaatttgctcataaaaatgtcagtaagaaaagctaactggataatttttatttctctgaaagccagagctctctaatatctgcttttgggatgctgcttagggtaattaggtatgattttccagttacttggggacgagcagatgtgactggtattgctgagatcctaattttatactgctaatgcaatgcttaccatacaaaggcatgtgaaggtgagacagttaaaagtcgatgtaaagactggaaactgggagtctttgtactatatttaaaataattacaactagggctaaaaataattttatctttgcatttctcttttttctttgttttcatccaccattcccatagcacctgaattctcagggtccctcctctccctttccacccttttccttctatttctttctcttttaacacagcttttctccaggaaaataggacacagaaagaacatctacctgcaaacagccatcagcgagtaagtccagatcatgccagtattcagtaagccatgtctgacaactcaccctttcctctgagtttaataggataaagctagtagtggaatagaaattgagaaatgtggctctactgataaggaaaccttgtcataaagtatgaattagcagcggttgagcagatttacttcaggagtgtttcactgctattatattgcctgttttatcctttggcttctatggacatatcatctgagataatgaccctccatctatttgcacaggtgcaagtaaaaaggtcctaaaatggacacacaaactcacacacatgcacaagtaagcatgccaagcatactaaattacagaaacgaataactcatcaataaagcaaatgttataaagtcctgtgactcatcattcatgatttactcataacacaaattaaaaaataattttgaaataagttgacagattggaccagaggataaatgtaggctatccaggaagtataactctgtacagtaacactaaaggaacagctgccgtctttgtgtagctcacacacagtctgcttttatagaccctaatgaggacaaaaccgattagcagattagaaattgacagaaatcagagacactctgcttaagaatcactaaagttggatagtatttcaactaatgctattctttgttcatctaaagatttatggaatgagtgtcttatgtataaacatctgcctcttcagggaagcatctgtcatgcagccaccaaataacatgacagaggggtactgtgtgcatctgaagagccttaagatctgtggtattgcccaagttcctactgcagattaaaacttttaatcaggtagtttttaaaaaaaataaaataaacctagctcataaaatgaactgttgaatagtttaatgtaaaagaaagcatttcaaaggatatttcatttaaatgcaaatgtggactatgagttattaaagagaatcgagttttcatattcttgtttttctagactcctgggatcaaagtcaccttttgaacttgcaaagtaagcttcaaaacttctgtcttactgttaggatttaagtttattgttttcgctattaaaagacaaatgctatctgaagctttatctgcagcattaattgtcccttaaagacaagggaactgaattaacaggagaaagggtaggactctagaacatttaggtcatggctttggaatcagagctctcagcagtttcatgctttgtggataattaaaatcaatacaaaataattacagaactagaaggatctccagatacctaatccagtcccttgtctccaggagaaactagatctagtttaaactaacttccacacagatacttgagttgtatgagagaaactgggactctagattcactttctgcacttaccaagaatattgcaaatgtggcttggtaaccagtgttcaaaaagagattatggtttttataagcatgacattggcatcatgaaactatcttctacagtctcagatcagcaatggaaggcaatgatggccaaaataatattcatctttcacactacatttatagagaaattagggtttctgacaatgccctatctgctagcttgtcttctcatttttagtgtatcctgtcttatcttaaaagtttagattgggtgctacatcctccatgaagcttaccaatctcaattcttattggttattttctttttgattcctttatttaataagactttaggatatatacataactctatagtaaaaatatagatgaccatataaagcagcatttgccatctctctacttaaatgaaatgtgcttaaatgctagtccctggagcctaacagaatactctttacttagtcactactcaaaaaatgctggttgatgattttttttttctaaatctggttgaaattaattctctttattattctgttctcatggaagatgaggacaagaatgagatgtattgagtctcctgatttcaattccctattccaacattatatttctctttataccattcttaatgctcctttttgttatgagctcaaacatcagaacagagtgaaacaaatatatccaagctccattaactcatttctttaagtaattttaaagagacagtgacttgcctattgcccagtctacagtgcagtggcccaatcatggcttgctgcagcctcaaactcctgagctcaagtgatcctcctgcctcagcctcctgagtagctgggacaacaggagactgccaccatgcacagctgattttttttttaattttttgtagagatggggctatgttgctcaggctggtcttgaactcttggcctcaagcatcctcctgcctcagcctcccaaagtgctggggttaccagcatgaaacactgcacctagtcactttaagtaaaatttaatgtgacaaaattactttgcaacataaatttctggatgactccttggagtttagttttatttttagatacattttcttcctaaagaaaaggggcatggttatcaaagcattttgtaaatcagtagaattcaacatgcctaaggtaaggtgtcgagttagattagtggactagtacaacaatactttctgtttcagaaaggtcaacattgaaaacgtatgtgtgtctgcattactgaattgaattggcgaagttgaatatttaattgtgtgctctgtgagaataactgcagtgagatacatgtcctttagagcatttctttttttctttttcttttctttactttttttttctttttttttcttttttttttttttttttgagatggagtctcgctctgtcgcccaggtggagtgcagtggcacagtggcgccatctcctctcactgcaagctctgcctccccagttcacgccattcttctgcctcagcctccccagtagctgggattacaggcgcctgccaccacgcctggctaagtttttatatttttagtagagatggggtttcactgtgttagccaggatggtctcgatctcctgacctcgtgatccgcctgcctcagcctcccaaagtgctgggattacaggcgtgagtcaccgcacccagcctagaacatttcttaatagaatctacacacacacacacacacacacacacacacacacacacacattatgtaatactttagaagaaaaagatggatcattttcattgttagagaaagtcttaggaaaattttatattttacatctactgcatgctttgcaaaaatagaagagagcttttaatcaatagtaacattaggcagctatatggaattgcatcctatttcactgaatcttgtcattcttgactactggtcaaaatgaaagactgctattacactattacaggaaatgtttcccattgattgttatttctacaaccaacagtctccaccatacttttctatattctctgatccacatcttacatttctttataaatgcttcttcttcctccttgagctaatagacacctggtcagttcacctgccaaaaacacaaggcatcccaagtgaggctattcatttcattacaccagttgggggtgaaaagagagggaagggctgaaaatagggatgacattctcctcagtttccattgccattcaaggaccatcactttcctcttatgtaaaacctttcctctgcacacacatcccagcactgtcttctaatcattgaggacactggcatctggcttactattttccttttggcctcttttgtacaacttcattgtctttgtggagaacccttcaatatgccaacctcctctactgacattccattcagcaaacatcgtcaaacctgaggtccaaagaaaagaattaaccttcatttgattccttattaaaatctctctctccattcaagctttatgtcctttaactctttatgtcctttaaaattattcattgaatcctccaaaacaacacattactgcagacaatgactgcttcccatgatcacatgttcaatcttcttatccaggcattcaatgaccttcaagattggttcttaacctttgtctctagacattttttaattacttgcacataattataactaatccaacgattctccaaatatgcctaacttttcagactccaaatctttctcatggcctctctccatctttccaattctcttcctccccaacaaccccaaataatcatcccctttaaagcccaaatttccaggcattccatgacctttccatgtcaaagcgtccatgtccttctctgaacttctgcagaattgtgtcccactgtctgaaagcatttactttcttgctctgtggttacctatatatttatctaagtctccttaactacttggaaggtagtaccagcttactgtattagtaaaatagggtattagttcagtctctggttctaattagttcttctgacttatctcgccatccgtatgaacaacagttgtaaaatatattgcctggaaccagcttccacttttcctgtacttccaggctgagccgagggtcgacagaaaggaaagccattcagctctggggtcccgacaagttggttgaccctgcagccatgagcggaactctcaaagtcatgtcacccaagtgagaccatgcaaagataactggttacagtgctttgagttctgtatgtgttctatgaaatcatcagtaaaactgaccagggctttcctatgtttatattttccacatcactctctgtatagtagtctaataatagtaaatattcaatgagtattcattgactaagaagaagatatttactacattcttttgtatagagcacaataatttataaggggtttctaatccattcaagtggctagttcttcggtcatctattacttcttttatcccatctgtggttggaatttctcatggagtctcattgtgttaggctgttcttgcattgctataaagaagaacctgatagtgggtaatttataaagaaaagaatttaataggttcatgggcccgcaggctttataagaagcatggtcttggcatctgcacagcttctggggaggcctcaggaagcttacaatcatggcagattacaaaaggggagcaggcacctcacatggtcagagcaggagcaagaggtgaggggcaagggaggtgccacaagcttctaaacaaatagatttcttatgaactcattcactagcttgaggacaataccaaggacatggtgctaaaccattcataagaaatctgcccccatgatctagtcatctcccaccaggccccctctttaacactggggattataattcaacatgagatttggcagggacatatattcaaactatatcacccatctcacaggccacagctttagcctatgtcgaatactaaaactagtagaaaaagcatggcatgtcagatttggcaaaacagatttttaagtaatagtgacaagtcataccatgttacaatgccatgattgctttgaaaatactttgcaaaacttctcaactacaattcatcatatggttcttgtaccttgacaatatttccctgataaaatgacataaaattggcattgttactcaccattgacaagactgcatcacatgatccatctggcttgaacctcatactaagtcagaagttacaacttcttcctgttgaattagttgcatattatcactaattttgcataattatatgtgtttctttgaatgatgatatctcataaacattgcaatttatatctttcagaaacttataccttttggttgtatatattgataaataatatttaaaattagtttattcttataaagatttcagaattttaaaaatctctgggaaggaatatacgctaaaagatgcttaatgttcagtgtagctgaaacatatacttagaggaaggtttttctttttaaacagttaaataatggtaaattggcaagtaccatgccaatcccccttcttgccatgtgtagtacagcagtggtgataatgttagcgattagagatattaattttatttatcttttttcctggagataaaggcttagtaaaagatgaaaatatttcttataagtaagttactacaaacaacttagtttctatttaaaaagtggaaaaagcttctaactcagcctcaggacattaattttatttgtgtaccatctaatatttgtaagtggacttcattttatcttgggagttcagaatgcaaatacaaaaaaaaactcctggggggaaatgcagttattaaaaactcccttagagaattattcaaaagacaggttactttatttacttcaataaataaagtaaaagaatattgtgatcacaacatgaaagaatgaaattaatctgtatttgttacagaacagaaataaaattaagttgtaattaattcaaaacagaaatatgccttatttgtaattaccttatttgtgacagcatttaattattcctttaaatacaattttggagaaactaaaatttttgactaaattttgattttaatcaacacacacacacacagtgtagtcttatgtcataataactgagattaatatccagtatgcaaaatacttgagattaatgtagaataattttgaagcaaaaatgtttttccctcagatgtgggacatgattcagcatttgatacttaaatttcctttgaaatgttgcagagacaaactgtactcaaactcaaataagagcaatttccattattacataccaatcctggaaatgtgtgtgagaatgacaacttcaatcaccaccacatcagtttgccttccttgtcgatttcttagtaaaaccagtttaaaagaatgtgtagccacaggtgtgtatagacaaaactgaacttataaataacacagcaattcagctgtttttttgtttcagaataaataagtaattatttcatttttacaaattatttctaaactttaaaaatataaatgcaccttaacttgattttttttcttacctgagcatctgtgaatgattaattggatttttagcctaagatattctttcatgtatgattttctttgtaggaacttataaagctatgcacacatatatataatattacacatatgatatgcatatgttatacatatgcatatatgtacataatatattcatacatattttacatttatattatgtgtgtctatatatatatatatatatacacatttctttctttctttctttataaaattacacaattttaggttaaccaatgatgtgattaggcaaatgttttcaagccaaacctccctcctctgttcagaaaatgagattagcagtgcttatatgacacactccttgaatcatcagtctttggtgctaatttagtcaaattagggttatgcttctttactaatgtagattttgacaatgtaatccaaagacatgaatctcgtaatattaatgggaagtcacttccatttgtagagagagtaaagaatggacaattgtgcccggtccacccttattcagtccctgatcctcaaccccatagccaacatgcctcacacatatcctacctataatcgaaggcagcccttcttggttttaccactttttctaagattctttagccttgtagaagaaggtttaagggggaaataaaagaagtctagttcaaaatatccagtttcctcttcaatggcaccactcaacctaatactgttcaaagaaaaattcaggaccttttctttcaagcagtaacatccatgagaaaattttaggctataacacagtgataatattgcagctgattaataacacacaaatagttatatattagagaattcttaaataaaactcctttgtttttatttcaataaaatgtctttttaaaaacatttaaaatctgaagtaaacatttccaaaagatcatctcttccaatgagggaacaggtttattcaggcctcaagaatttgaggggcatctggtgaatgccaggtgtcttctaactgaagatacagcaggaaacaagaaagacaaatgtcttgtctttgagaagcttatgttctagtcatacgtaatggataaaagcttgtatttatggctgggcacagtggctcacacctctaatcccagcactttgggatgcctaggcgggtggatcacttgaggtcaggagttcaagaccagcctggccaacaaggcaaaactgcatctttactaaaaatacagaaattagccaggtgtggtggcacacacctgcaatcccagctactcaggaggctgaggcaggataatcatttgaacccgggaggcagaggcaggagaatcgcttgaacctgggaggcagaggttgctgtgaaccaagatcgtgccactgcacttcagcctaacagcctaagtgacagagtaagactctgtcaaaaaaaagaaaaaaaaagaaaaagaaaagaaaaagcatgtatttataaaacctggagcaattcttaaacccactaaactcagtaaatctatagtgcctataacattatactaaataagtaataaatacttttctgatgatacacgtactcaccaaatgtaatgaccagagaagatatgtttttagctaaaatatcctagctttgggatgaacagtaggagcactggattggatcagaatgcagtatacacatatttatttcttatgagtctgcctcttagtaaaaagtgtattttatacctctctgttttcaaaaacacaccaaaacccaagttttgtttcctcaaatgtttaatgacatttatttattgtatctgaatgatttattatgatattgtgatacagcatcacttaaggttgtttggatttttaaaagctattcccaaaagatttgcaactactttcccctgctatcttggttgcttcctgttctcacagaaatgtgaatgatgtccctcatgtattgcttatttcttgagcttttaggtacaacttggcaaatataccaaatgatagagaggaaaaatgaaggtatttttacattgaaaatttttcactggcaaagctcttttcctgaaggaaacatcactcatgtttaggctagattatgtgcgcatcgtgacctagaattggaaacccagtggctactgaactgggggctcctctaaagccaaaccaaaccatttgagcaagaactatggactattcatacagtttatcaaatttagccagatgacagagacagtgtctgacaaaaggttgaatctagtaaaaaaaaaaaaaaaattcacttaggataaaatgtctaatggagattaaaactttaaaatatgtactaaattggtgttccccaggctgttcatattctcagtgcctacagaatacagaaaagctagaaatagctaatgtagctttggaggataacagaaattttgtttggttttgttcctatgttttcttcaaaatgttgttattctttatataactatttaggttattttaattggtttaaaaaagctcgagtctattccaggagggattgtttaaaaaaaaaagatagaatttaaaaaggttgagtctctacatggatgagaaaaaaaaagccaatataagtcttttatataaaccaatctcttaaaacattttaataaatattttattttaatctattaaaatcccttcatagcccactaacattctaaaataccagctatagatttcaagttcattttttagaactttgaaagaaaaatagatatattgcataagaaaggtgatgaacttaataatagttatggaaaaagatacaaatataacaatgaaaggtcctgcagattaatttaaccatttaattaagaaaaagagagcactattacttaggtaattttttaaagtcaatattactataactcagtatattaaaggctttcaaaatgaaggaattagtcatggaatagtgttttgtataattaatgacatatttaactttttcatttagtcatattgctatctttactcctaatcaaaatgcaatttacagaatgtattatttcatcgagaaattaacagctggcttgtaagaaacatttaagttaggttaattactgccttttaaatttgtataatatactgtgacagaaaattaatgatgctcacactatttagcatagttcataacccatattttaatgaaaatatactattattagtgatatacatgatacagatataatacactctaattgctggtcattttatgtctgttctatataattctataaaatgaagccatattcattctgcttattaatttagacttcacagataaaaatttgcatttaatatattcatgtgtatattggattatgtgaattttattaacctaaggcatgacaagtggggtttgactgacagtttctcaagattctaatctggtcaagaattcattttcctttcatcttatcacagacatatgaaaatcttaaactgaacacgttagcattttaagtagtatccattttcttcctgtgcactgtgccaaaagtgagataactacttgcatagtgtccatggagaggtgtttccataacatgccctgataataaatttgtgacaactccagttctgctgtctcaaatgtaagtttcttacagaagcctaagttaaaatctctttctttttctgtagcaaaaatcaaggcctattatattatattatattatattatattatattatattatattacattatcaactaccaaatttaggtttcttgaattgggtcactgctttctttagtcatactaagttcagtgatcgtctttatgccagttgctagtgattggctataggacttctccaaacaaggactacaattataggaaagaaatggtatacctctgagctaatatgagaacacatattttttgaaccataggcaaaaaatactagaaaaagtgccattgtagttgtaccatagaacataattttagaaatataggactcccgtgaaatacttgaagaaaatttgataaatatattgcatgaatagtcaagatggctatattaaaatgggtgtgaaataaagttttattacttttttaaagtaataccaactaacttctgtgcaggtcaatgataacgagtaaaatatgtctactggtttcaagatatttccaagaaagtttagaagatgtgagttctcacaagacaatatagctcattaaaaaaaaaaaaaccttaaataatatccagtttaagagatttcaaataccattgcatttataattcactttgaagtatctatattccagaaaatcactgacaatggcaaatgtttctgagtcattgctatagaaaatatccaagatgggttattgcagacataaaacttcccctaaaagaagagaattcaaaggaggcaagtaacaaaatttatttttgagtgagaaaatatgacagattttcaaatctctcattttggcttattcagcatattgagaaagaagcatatcagagaaacagagaagccacagaggatagtagggcagttccatcccattagggtgaaaggacaaacaggaaaaatgtgaaactgggcaacctaaattctattggattatctgaactatgaaaacctttaagatatgcatttctaactgaacaggaagagtaaataaataatataataaatgtttgtacatagcagcagaataactttttttcacaagttacaaatattttagcatttttctgttaacccacaattctccaattattttttcaaaaacacaaagaaagtaaaagcctccctggaattattactatatactctaaaagtaactgcaataatcagtttggtgtaaatcccttcagacttttggtagtgcatgaatatgtatttttgcattaatgacattttcctataacattttgctatagactagattttcattcagtcatgaggcataagcattttatatcattacatatgaacctaccttataattttgtcactacagtgtttaattaaataactgcatcataattcaattgaataatcctttttgaagtatctttttaatacagtaatataagccatcatgcaacatatgtaaatgaacaatcatgcaacacacacacttctagtggaatttacatttttacacagtttctaataagcctctgtgatatgaggggaccagtttctgtggaatatataggaactgccagggactttttcatatataatttcataaaatcaaaacatttgtttgtagaaattgtgagcattgttttacagtagaagacaatatgtttcaaagaagttgaaaagtttgttgaaagacacatacataatatacggcaaaacaaatcttcaaaatcagttgtgtttggatgattccttggtcattccaggtcaacaaactgcaggaaaggcactttaaatgtatgtatatttatttgattagatcatgcttttttaatcagatggtttgagtctcaaactgttttccttaaccacaaatctctgatttgcttttctaaacagcacaaaaattgtgctgttctgattttcacctaacatccttaacaggaaacctggctgttcagacaaaaatggagttgccatagtgctctagccaaaagtatcagctcaaaaattgtctcagcaggaatgatgggtttctatatttctacattttaaatacaaattgacatcacccatggacatcaaaaataaaattttcccatctggtgcatattatagtatattggaactaattggtttggttggaaaatgaggcaatcctctacataaatgaacgtatgtattctctccagagtgatagtcaagtccaaactctcagtatatggactaaatcttttttcctaattcagtaatcccattgctttcataataaatccttacttgtaactttttaaacaactattttcttttcttttgagtaaaaagcgttctttacctcctaatacgtcagtctattatgggatcaggaagtcatctatttatttattaaacaaaacttatgaaacaattattatttcctagatttatgctagactctagggatataaaaacaaattacacatagaatcaatatcttcacgtagtagttaccaatatagtaggtaggaaagttatatgggcaaggaattgttataatgtcgactataaggtgaaaatatagtccaaagttcattttgagttataatacagaagacatatgaacaccagtgtaattttggtttccaggacaacattaatatggtatctaataacataaaaatgttaaagtaattggaatactccaaggtgggagaaatgtaccatttaatatgtgatgtcaatgtgtaattatgcaaagaaatacaatgcctggttaacagtaatttaaaactctcctagtctgtattttgagtcagtacagtgaacaagttagtcaacctaccagtgagcatgttaaaagccagatgaatgaccagatttttttgttcacctgagtgggtattttgccattgtctaatcgcaacctccgtgcagctcccagtgatttggctacgtgagtgctttctggagcttatgtgtcattcagggcatctctggcgtctgcacttctgtctgttctaatgaccacactcagcaagctccagctttcgaaggagactccactaattagcttagtcggcatagcatctggtaactggttggtgggataaacagaaaagactcccgaagtgaaggatggaaaaatgaattctccaggccatgaagagcaaaatgaaattatgagcatacaacccaaaaccatgaagaagcttgatcatttacattagccgcatctgtaacattgcctggcacgaaatcctgggccaaaatggagataattggaattatgcaatactcagcgcttcagtttggcatcagtttcataatataataaaacttatcatttgtaagcctgtctgctttttcaaaaaaagacctagaacaatttgatctgtcctgctacagcagacactgatgcaggtggtttaaaaacaaagcatttaatcaggcagggttttacttaaactacttgatgattcatcatccagcctctgctcattgtcaattgtgcctctctgagctattatttatagaatatttaaagagcctggactgcatgtgcctctgtcttgggttctattgtactataaattataggtccagtttgtttcaaattcggcatggactgtcaggataccatgactcatcctctgttcagatgaatactgtatatggctaaagcaaaaagtactgttgttactattaatttataggtaattctggaatattcctagactacagttttgtcatgttttaggtccacagaatcactctattcctacattcccctatgttcttctttccacagggtaaaaataaatgagtggctttatgaccactatgtaaattctggtcttctaaatggccactgctaaaggaggttgttcgggatgacacaaccctttctccatcatgaaaacagaccaacttttcctaagtagagactgcatagatttattgaaatcacattctatatgctgagggatttttgttttgttttgtttttcttaagctgactattaaaaacaaagtaagccagaattagattaaagaaaggaaaaattgacctttaatgagaaaaccaagagggcaaaattttttgtgtctcattttttagcactcaataattgcaattaaatattcagtttacttcatccccataggctccttggaagcagaactgtctattttcttcatcactgtattctagcctttaacacatagtaagggcacaataaaaagagcggtggtaggaatcaatgcatgagtgaatgagtaaaagacaagttgtgtggctagactattgtgagtctggagaaagtggatttttttaacattaaaggatgagaataggaatgaatgatatagggaagagatgaaatggatatgtttgtatctggtctgagagtccacttcaaaatgaacattccctcttcagagcacccatgcattgctcatgtgctgctattgcacccatcacattgatttgttatagctcctaggggttacttagatggattagttcacctttttatttccagcatagagtgtggcacattagaagtatccgaagtgcatttatgtatacactgactcatactggatgaacagtatcatcatcgcccaatcctaaagtcttgccccgtttaaggagctttgaggtattattgtcttgaaaactcatggaaatggaaataatgcacaagaagcaatgtctgaaagagtcaggcattcagcaaacacaattttttgtaaaatttgaaaacccaaaccacagtatgacattaagaaaacacaaatattacttagccaaaagaaaaaccattttgaaatttttcataaaatatttagaaagaaagaacttggagcctggagcagtagagtgagaaataaggaaggaatatgtgggagagaagagaaagggaaaagaaagtgcatcagattttttattgttattagcactaaactggtttgctttgggcccttagccagggttgctttttaaaactatccaaatattttttttaaaaatcctcaatgatatttatatgtctactaacatttcagttgtttttatagggtcagtgatattaaggcaaattattcagattcacatggtgaacaaaggcacttcatagaattcttggactacttagagaatcagagagatactttctctagctgctacttcatttgtggccttagagaaataatgcattaatctccaattagatcatgtcatctttcaggatgtttagctaaggtgaaatgtgtaattaaacattttaaattgcatgtcacctccacccacagggttgacacatgttttctttttggtatagttttgtgtaaggattcactcagtatatccagaagtcaccttgaccatgaaaataaatctgctgcaaattacagcctcacaattaactcaaacattatcatctattatttgtgttctctgacttgaggagcaggtatttgatttttttccactttttacttattaacataacttttatatttgaatatatagtaattttttaaattaccaaaatgatagcaggtattaagtgacagtcttcagaatgatcctatgtggtaccctgtgtagcttttcttataataaaaatatacatggaacatcagagagagagagagaaagagagaaagaaaaatatatgtaaatatctttttaatattgagctaatttaagcttcatcagtttgttgtgcatatgatatttaccctacagatttgttttcaataatggtatactatgatgaataactttaaatagaagtatttttcatttagaactttgttgaatattagcacatgagggaaaaataaaatatgtaactcatctatctgtgtaaaataataaatgctagatctaaaggagccatttgctaaaatgtacttaaacaaatgcatattgcctgcattatatttctctactcttttattgcactattagtcagaaatttaaattctatttttgagcttgtgattatcctgaatactaagtgaaagggaagtgatgatggaatttttattttaatgataacaacagttttcaagggagataatcaaaatctttttctgaagtttgaagatgagaaaactgtgtaaatccatctgctgagttcatgtgccttttgagatttgcttttctgtcttttaatttcacatttctggtttttaaattatttctcctataaaagaattttttgatgtcattaatgccgtttcattttgaaatgacggttaaacagagtttctaataattcaacagttctgtttggttttgtacaacatgttatattcaggtgatatctgaatgatcaactggatcaaaattcagaagacaagaaaagcgttgcttgatcgattttcaaacacacattcaggttttgtccatagatcttgaatgccataacaccagttgtgcctcagggaaaagcatatgcttacttgtcacatagatttttagttggtatgttagaccatttgggtcattataacaaaataccttagaccgggtaatttataaataacagaaatgtattacttacagttctggaagctggaaactcctggatcaaggccctggcagattctgtctggtgagagcccattccttatggtggtaacttctatatgtcttcccaccacagaaggggtaagcaagcttcttggcctcttttataaaggcactaattccattcatgagggcagagcccccccaaaggcccacctcttaatgccatttttggagacacaacattcaaaccacagcaattggttttagtgtcattgaactacaagctttataaggaccagaaagaaacttttttttttgcccttaacctaacagttttctgggtccatgcgttttattttctgccaagatatttgtgtgtgtgtgtgtgtgtgtgtgtgtgtgtgtgtgtgcatgtagagagagagagagagagaagcactcaaatgcaatgtctgcactatcaattgcattttcccctatcttttgaaatttcaagttcaaactcgtagtttaatatttttctttggctgaaaataaatgagttgatctgtgtggaatggggtgataaaagaggtcaaggtgtgtgggtaaggatggaaacttctataatatgaaaaaatactgcaatgaaggtgcagtatgagggtgctttacttctctattgaacacagatactttttgaatggaaatgtggtatgtagtaatttgggagagagtatcttagtaataatggagtaccaacattgacagaatgactggtatgggggggcagaatgtgcatttaataaatatttcacaaaagtgcaataacagtctgagaaatacctggaacattttaacataagatattaatataaaacacagacaaataatctggagacacacttattgagtttgaatcctagctcttctcctttttttttccatgatgggcaatttgtttaacttccctgagcctcagtttcctcatgggtaaaattggggaaacagtagcatctatttcattaaattgtcttgatggttaactgagttaatatctctctccctacccctgctagaaagaaaacttgaggaggttttaacgtgtttcaggaatgtggcccaaacacctgaaacaatgatgaaaatcattttaaacttaaaataggcatcaaaaatgaaaaaaaaaaagtgtttattgtcaaaaataatgacatttgtgcagaggttctgtattttagtagccaattactctgtaatatttattgagatttgactccgtatatataagggagtttcaaaaagcttatggaaaatgtagttaaaagataaaattaaaaatataaactttatttcttgacataagttctatcaagttcaagaaacttttgtacatgaagaactaaagttcctgggaatttaaatgtactctagagcagttaaatggagtctatttttcaaaacccatctaggccataaagcctttcctgacttgaaaaagaaagatcaaataggacaggagccccacatcagtgatttcaaggagaatgcacagcagagtgaatatggactatatcctttgtccattttatcagaggactaaggagataaggtcagaatcagaaaaagatttgctgttgaaagtcacatttgttgattccactggctgtccactgtttgagggagactgatgggcaaacatctgcttagtttttctatcaattgtcaatttaccggaaaatatacccatgtgccttgattattaagaagaacacctaaaaccggtcacagtggctcatgcctgaaatcccagccctttgggaggcccaggcaggaggacagcttgagtccagttgttcaaactatcctgggcaacatggtgagagcctgtctctattttaaataaagaagaagaatacctaagaagtagttactttttttccctactttcattttctccttaaataaaagtgctttctaagtattttaaagaaaactcttctttctcatcctgcctcttgctgaagcacttacgacgttcaaacattaagcataatacttacattatttcaactaatacaaaaactctttgggatgaattttattgactttattttgaagctttaaaatgaactcagaaagattaagtaatttgtctgtgatcacacagctagtaggagagtagagccaaggttggatcctgtttctttttaaaggaaaagcttatattctttgcatttctttgggagtcaaatagcgtgctgaactgaatcactacatggtttttgttattgttactgttgttgttgttattttgggttgttaaggtcctgtgcacatttttttttaaacctggagatcttaatcttgtaaggtgttttcaaataatactcacaaaataagtaaataaagaaatcctacaaaatgtagaaaatcagtaacattataccaaattgtttggttcagaaattgcttaagactttaaaatcagttgacccaatctgtaattttatttgctttccagccttcagataattttcaaacaaaagaaataactaaaaaactttaatttctcttttcctttaaattcttgcatagtttcatgtgagatcatagcctgttataattctgttcaaactaatttttatggaaaaaaaccatttttgagtgtacttttcatctttctttgtgaagaaagttataagataaagatttatctcccttctccaagtgtcctttaataaatggattatgcttctgaagcccaggtagtttcaagcaacagcacaaacactgcacacaagagctgtcacttagaaatgaagtaatcaataaacacttcaaatttctttttaaaatttatttcacaaatccaaacaaaacaagtttgtctataagttccttgccatgtttttttttctttttttcccctgtttatataattcttatttagtccctatcagttatgttcaggaacaggccaaaatcaatcaaaacacaaacaaggccgggagccatggcttacaccagaaatcccagcactttgggaggctgaggtaggtggatcacctgaggtcaagagttggagaccagcctggccaacatggtgaaaccccttctctactaaaaatacaaaaatatgctgggtgtggtggcacacacctgaaatcccagctactcgggaggctaaagcatgagaatcacttgaacctgggaggcagaggttgcagtgagtcaagatcacaccaccacactccagcctgggtgacaaaagcaaaactctttctgaagagaaaaaaaaaaaactatgcattattgtttatggtgattgagttttattacttgcagctgtaatttgaaataaaggaaaccacactatgcttaacctcattttggatcatttacgcaaacgtggaaaactttcaagatctgtatagtatctgagaaaaatatttagagggcttacaagtctactttttttttgatatgtgaaaagatttcctacataaatattcttataatatgctaactcaaacttcattctttcatttttcagcaaattattcagtcaatccatttagttactttgcaaactgatagaaagctgtcaatatctacaaactgataaaaagctataaaactgcagcataagggaagcccatttgcattcagctgagtttaacttgaatacctagataacttctggaaatttgagaagctacctaagctggaatgcgcaaatgtagctacctgcttacctcacagttattgttatgaaataaaagactaaaaccttaaaaaaatacagcatgtatatacgtaatttatatatgcatgctgtattgagggaaactcgggagatgttccaaagtgttgaatcagctagaagaaagatttttttaactaaatatgtatgttcataaatatatttagaataaaattataggtaactgcaaatataatagcttaagatgtttgtttagagttactgagataatcttattttaaaatttgtaatttaaaagctaccttacataaaaatactgattttattttgcttcaaatttgttctttaatttttttgtacacatctgatatcacaaaaacattgtttatgaattggcactgctaccttaaaatgtaaatgagggggaacttcgccatagatatccattattctgttggacaattctagcaagagacacctaaaaaggaagaataagtcaaacatagaggttctagcctcttattacaaacaacagctgtcagggcttcttaagaatatgtgcccatcagagaaggctgctgagttcttctgtgtctgaaattaataaaaacgcagttgcaatgccagctatgtaagccagggaggaactcggtggaaaagtgagataacaggggaaatgtttttatgtctttggagctgtaagtgcatttcaatgttatgccatgatcagaagggccatatgaagcaattttgtttctgaagaattgtggttatagagtttgaactgcaggtatcagtaaacaaataaacactactggtgattttgaaattgatacaaagccaaagttaggaaaaactgcattccagaactgttttaaaatgtaatataaattcaaagttccaaaatttatatatttttaaattcttggttttttaaaattttaccgtctaatagtcaatacattagtgaagaaatttaataaaaatggcaactttaccactcatatgtttttctgggagttatgctggcttttgttttaaccccatttgaacccattcttttaggtagatttctttctaaacattggccttttcagattttctctaaatatgcatttcaagtaataacttgaatttcaggaattttttggtcatatttttctgccacaatttaaatatatacagcaatctggcaatatagtgacctgcaaaatcagtgctcatttcttgagtgaataagtaaatatgtttataatttggaaaatagaaacacttttctgactcaatctttatccctaagtttcccttatcttaaagaaatgccaaacaacaacaacagcaacaccaacaacaaaactgagttcctttagcatgaatgaaaccatttggtgagctaaatgtaacaaacaaatgttctcgcgtgcttcctgctctgggacatcccaggctcttgaagaggaccaagttcagagcggcaccatcagtgtcatgttatgaagggggctgcaggatccgcaggtacccaggaaggattctcacttacatcaatagggttagagatggcttctgggagatgtcacctggaatatggaacacttttgaaaattttcaagtgaaaaaaacttaacctagctaaaagttttaaagaaggacctaccatgtttttttcctgtagaactaaaaatattagtttatacttgaattgcaagaatgtctattagcccagtggtctgtgttcacatgttagcactttggagcatacggtagaggtggaaagcaatataaaactatcagaattgttttatatagcccaatatggctctgtcatccattaattttctaaagttttcttcaaaaacacgtatatattcattctacctttctgaagtagtttatttctgtactcaaaatgcccattgagtatttttttgttgctgtttccttaagtttgctacttcaagctttattttttttaagaaattttttttttagaaaaagtttctcactttgtcatgcagcctggagtgcagtagtgtgatcacagttcactgcagcctccaactcctgggatcacttcctacctcagcctccagagtagctggtactacaggtatgccccacctacccactggctaattttttgaatttgtattttgtggcgacataatcttattgtgttgcccaagctggtcttgaactcctggccccaagtgatcctcccacctcagcctcctaaactgctgggactacaggtaccagccactgctcccagcacattccacactttaaatagttcttaccctcttaaattctaatgatgcaagatttctgtgaccacgttcctattgaaccaattggctgctttcatgtcttcatgaaaattgatcatacctttttgtctttgtagaaggagaagattttatctttgtaactatgtctcctatagtaggttgatatttccctgggtcgcaagcagtatggcatataaacatgagaaggtagttatagaatacattgcttaacaatgagcaattcttaggcattactaatgacaacttgaaactatttaggcagaagggctcttagtacagataaaatgaccatccttccagaagatataagctgtataattgaactggaataattgttgaacatggtatccttttcttttctgcttgatatgtcatattttggcaaatggacataatcatttactaagtagctgatattatactttagcaacttcacagtgacaactttttgactcataagttactaagaaccaatcaaagataaaaggtaatattataatattcttacaattttttaatgtcacataattctatgtaactaaattgtattgagacgaatgtatcggattatgttgtttgttgttttataggtttcttctcgtttttgttttcttttgttgttgttttgctttgtttggcttggtttggtttgagtttaggtttgcttacttcagtgttttggactgtgctgacatagagagtctacacacaagtttgggtcactcagctaacttaaggaattatctcaatgaggctgggtatataatggagcaaacatacatatgaactatctaatatgattgttacaaacgttaaataacttaatacgaggtaaagtattttgaccactgcttggtacgcagtaatcattcaatagcattctttctttttttttttttttttttgagtcttataattaataatagcatcacttcgtgggtcacgtacctttgcttttctcttgtgcaaacttatcctttatagcctaatgatcaataaatattggacatcagtactagaaaactatctcaatgtttatgacctaattacatcaaccaagtgggtaaatttgtaaagagattggaccaattgaataagtatatatatgtgaggtgtgtgcatttccatcttgtgtggtgggggagagagagaggttggcctgtgtgtattctcattcgtaatctctataggatattctaaatctgagctgtcatttaaattatgttttaataatgtggctcataggtacaaggaatttgattaatcagaattggaaagaaaaaattgtgtagcttaacttgtacatctttgtttccctgaaatctactcaccatgccacagccaaaaatgatgtttcaaaaattcaggtctgatcaagtagaattgcccacccggcttaacaatttttaatgacttcctttttcattttattgtggtaagaagagttaacacaatatctctagaattaattcatcttcataaactgaaacttcataccaattgaacaactccccagttccccttgcccctagtctcgggcaaccaccattccattttttgattctatgagtttgactattttacctgtctcataaattagaaccatgaagtatttgaccttctgtgactgtcttatttcacttagtgtaatatcctcaagtgtcattcatgtcgctgtatattataggaattccttctccttgaatactgaataatattcaatcgcatatatatatatatgacattttcttatccatttatctgtattcttaaaatatgtttatcatagggaaaaacatcatgacattggtttttgcaatgatttcgtgagtctgaaaataaaattacgggcaacaaaagcaaaaatagcaaatgtgactacatttagctaaaaagtttctgcacagtaaaggaaacgatggcgtgaaaagactacctacagaatgggagaaaatgtttgcaaaccatagataatgatgggtaaatttttaatgtaggaactcctacaaatcaatagcaaaaaaaacacactgacaacccaatttaaaaatggcctaaataccagaacagacatttctttaaagaagacatacagttagctagcaaatatatgaaaagatgctcagcctcacaaatcattaggaaaatgcaaatcaacaccagagatatcacctcacacctgttaggatggccacaaacaaaacaaaaacaaaacaaacaaaaaaacagatgctggcaaggttgtggagaaattgaaacccttatatgctcttggtgaaaatggaaaaagggttcagctgctaaaaaagcaagaggaggcttctcagaaaattaaaagtagtgctattatatgattcagtaatatcactcctgggatttggtcaaaagaattaaatcaggataccaaagagacattagcactcccatattcatagcagcagtattcacaatagcaagatgtggaaataacctaaatgtccattgacagatgaatacattttttaaatgtagtatatacatacaatggactactgttccactctcactttgctttctgtgcttcagctgtccccggcacatgctcactcattttggaggaatctttggcattctgaatcatcctcctataacactttcccatccaggccccacccaactaatttttaatcataatttagatctcaacacaaaggctggcacaaaggtaagtcccaaaaatatatgtaggatgaatgaaaaaaagatgaatgaataattaattgaatgtgtattttctcagaggctctggaataaagtataatttgaaaagttttcattagtagtttttcctctatttgagttagttttatattagaattatgtcaaaacccaacttaaagcttccctttcttatatttcataatcatgtatctgaatgtttaagattcttagcagggtaacagagaaaagaaatcctttatgtgctactattttcttttaaaatttagggttactgcattaagcaggggaggataatacatactctctttagaattttggacgatttgagataaggcccaaaacttagctcactgaaaatggaattactgcacatatcaaaactacactgaatggtcacaattgaaatagtgaatatgctgcatatggcataaactattttactatttgtgctctaaagtgttataaaactgtagtcatacaaagatactaaagtttaaaaatcttaaagtaaaagaattcctgtaagtgttatgaccttaatcccctgcaactgtctcagtctcctctcacagcagtcttggttgtttagagtgagtaattgagacaaaaataattcttttgaaagaaaaaacatttgagcctcaaatgctgataacttttcttctcctcttagaagagcaaaaagaaagaaagatacaacctctgcactttacttttatatataacaaggttgttgtggtcaaataaatgtgaacagtttagaattctataaaattataaaatactgatgtaaataataatattttattattaactattattaatgcaaatatattctgatatgccactgaggaaagtgatacattttatgcacactaaataaaaataggcccaatctgacaatgagaaattattcctaatcttatttctaagctttgtaaaatttgtaaatttaaatgattcaaaaattttatattcactttaatcttcctctatttgttagttcctcaccatattggaaatcaatatttgttgtctgatatatttcttaaataatacgaattaaatattgtgagatgttttaggcctttaagagatatcatttttccttttcagtttatgaaaatgctagttgccattttatatgtacagattaggcagctactatgagcatagaacaataatactaagcaagtgatgcacaacctctgctctcctggagcatatagtctataatcctctgtttccagcttcctactgaatatttgtgcttgattttcctattggcatttcaaatatatgatatttaagttcaaatcaaatacatgtgttcccctcaaatctacatctagtgctaatacttacaatctttacaattataacctagtaaatcaaatatcactttaactagtctttgagggaaaccactttttgagagttttcacaggtgagaaacaggaggcttaatggggctcagccacttgccaacaatcacatagttaataagtcccagagctgacacttgagccaagatcggtctccaggccccattaccatcatgtgatactctctcatcaaagatctcatgttgcgtggagcctagtaaatcatcaaaaatattctggaataggcttggtgcagtggctcacacctgtaatcccagcactttgggaggctgaggtgggtggatcacgaggtcaggagttcaagaccagcctgaccaagatgttgaaaccccgtctctactaaaaatacaaaaattagccgggcacggtggcaggcgcctgtaatctcagctactcgggaggctgaggcaggagaatcgcttgaacccgggcggcaaagattgcagtgagatgagaccacgccactgcattctagcttgggtgatagaatgagactctgtctcaaaaaaaaaaaaaaaaaattattgaataaacgaatataattgacttttattaattcatagttcacatttttttactatatctattttctgttttgttgacaaggtagtgggaagggaccaacatttgctgaacattaaacatttacatttatttgtaatcatttatttgtttatttgtttattttttgtattatttatttattgtatttatttgttattatttgaatcgtttatttgtcatatatcatcccatcttatcctcttaactctaagattggtacccttatcatcattttaaagaagtgaaaacccaagaaattgaacaattttctctaggccagtgtgtgttaaagtcacacactgactttagacagacaattccaagtctgcctaattctaatgacttaaatctactacaccatcttgctgatccattttgcctagcaaactatagagagtagtttccttcttcacatttttagcgtttcaaaagatgtatggcaaacatttcttccatattacttatatcaggtaagtcagaataaaaaagttgatgaggtgtcacctatttacttacagtgcctcagcctgaacccaggagcatgattcaaaaattcaggcatgtgtgttaatttcccactacatccttttgatatgatgttggagaaagcacttattccttctgtatcctacagatacatataaagcataccaaaaagttaatattcataaaagcattttcttgccaaaaatagataaatttaagagaaatcattgttgatttctgagttacatgtaaagtcaatatatgctgctaaactctctttaacttttccagtatgttacagtttttaacaatctgttgttcaaaaactaaataccagaggtatataaaatattagataatatttgagcataaactgttgaaggcaacagcataattttatttccttatgccataatagagcatcacatctcagtcagcctaccccaatgatgacatattttctgaattgtttttacccacacatcttatgctcaatttaacaaatatttattaagtgcatagttggcaaggtgacactatggaggagatgaaaaagactaaggtatcatttgtgcccttgaggaattaataatctgacggcaaaagctgacatgtatacaatcaactgtagtatttgaaaggataaagtaagtcctttaatagcaatataaactgctcggctagtattgagagagcaaggctagagggcagagcaatgtgaagcttggattgaagtggcaggatattaaaggcaagacatcagttatgaagctaaagcatatataggcaataacatgataacagcctgaattagtcagtggactgatagaatagaaggaaaaggaataccaggggcatttcactggaagaatcaatagtatgtgacaattagatgtgagagtggaaattaggaggagtcaaagataaattcaagttttcttatcagatactgggctaggaaacacaaaataagaaaactgtgggagaagcatatgacatttcatttgaggtttgtgggtttaatataccagcaagccatctatgagcagatagccatcagtgggaaatttgagtctacagtacagtaaagagaccagcagcaaagatatacagcatagcagtaattggagtacatagaagattatagaaataggaaagtgccgaggataaaaacttgggggaaattaaacacagatatgataaaggaagagtaagcagaaaaatacactgaagtagaacacaaaactagaaaaaacaaaatgtgtgtgcattgacacggaaccaaaattttgaaacaaagagtgaaaagaagctcaacaatattaacaatgtagaggagttcggaattgagaacgaggtatgggatttgacaaccaggacttttgtgatgactttagtaggatggaatggggaacctagattactaaagattacatatctatatatggaagtaaatgcataaaaatttactatgaaaatttaattgtaaataggagaaagaggagtatatggttaaataggatgcaatgtggaattaatattttgactcagtatggagaaaattgaacatacttgtgaaccagtagggaacagaaatagagaaaaatgtagcaagaattcttaacccaaaatcacggattaggagtctattaggttgtttttgatctcctgcaagcctaggcaatatattgaatgtacatgtagttttattggaagagtcatcacattctcataaagattcatacacccctctagcccccaccaccctcaaaaggaaactttggaatctctgaaatatgtagacagagtattttatgagcaatgcccaagggaacaagatgaaatgcatttgagaggatgtatattctacactatttcattgaaagttcatctgtgaatttcaagtgttccctgtaaatttaaaacacatttaaaaggagtaactcatatctcttaatttactctgaatcttgagaagaaaatagatctaaaaggatctccactgtattcattagttcaacaaatgattgttgaacacttcccaatctggggcatgcatagtgcagagtgtacttcaacaattaagcaggatacctaattaacccagactttagagggaccatgccaaagtagggttcagtaatattttagcagacataatatctaagctcaggcatgaaaaatccattcactcaacaaatatttatatggtgctcatataggccagatactatccaagatgctggtatcatgtgtgtgaataagacaaagtgcctgccctcatgcattgtatgaaagagagaaaataaacaaatgaacaagtaaacaaattctataatcatgtagtgataagtgttataaagaaaatatatatgcagtgacccttctgtatccacaggttcaacatccttggattcaaccaatcatagatcaaaaatatattttttagaatttgaacatgtagagactttttcatgttctatttcctgaacaatagactataacaactatttacatggcatttacattgtattaggtattataagtaatctagagataaagtatactggaagatgtacgtaggttatattcaaatactacaacattttatatcagggtcttgaatagccaaagattttagtatttacaggaggtcctgggaccaatccccaatagatactgaggaatgactgaataagataaaggtacaatggcaatggaagacttccctacaaaggtgacattcggaaaaagaccgcaataaataaaagaataagccaggttaacatccagaggaggtggagggaagagcaaatgcaaagccctgggtaaaaacatatcttggttgggcttcaggaatgaccaatgtggcaagagcagtttgaggaggacagagaatggtagataaggccagcagagccattatgggccatggcaggggatcaggataggaataagtcaacttgggattggaaggagtagcttggattggaaggagtagcatgacttattccagaagtttgatttgactgtgatataatgaggggagtgtggtgagatgaagtaggagaagtcagcaggacccaggaaataaagggcattataaacgtaagttatcatcagagcaaaggtgagccactgaagattttaaatggggaggtgacgtgctttatcagtcttgcattttgagtattgcattttcactggatatattatagaaaatgccttggcagatgatcaagattgtcttcaaggataaaatttacaagtaaaggcccaggattcgatgtctattgctctttctactagtactttctttcctaataatgggaatgattatgtactcaagtatattaggaaaattaatctgaaactggtgtttcagatgaaggggaagtagaagattattccagagtttgttacagtatctaagtataaagtggtaaagatctcagtcagtccactcaatgtattaatgatggaaattgagagaaaaaggtgagttgctgctagagtcatagaagaaagaattgatagacttgtgcctgattacagaaagaaaggaaaaaagcaaagatgacctcatgtggtattaatgactaaagacattgttatttgtatttgtgggcctagcccattgcaaacctccaataaaccctacttaaagtgaataaatgaacacaggaccaagtgagaaataaagaaagcaaggttatgggaactggttttagttttaggcatcttatatttgaatagaatgggtaaagacagttgcctaaattttaaaaggttatcagtatattagtttcattttacatcctggactaactcagtagtattataaacatgagtcagtttagctaggtgcacctatgtttcagcaatacacagaaaaaaaataagacagagacatgtttaagagcaaggtcttgaagcgtgatagccagggttcaaatctcagctcaacttcctgttagtgtgaccttgagaaaagtatgtaattgttatattcctattatcttcttcagaggatagcaaagatgtgataaataatctgctaccactagcctttagcacatacactataaatcaggtttgcagatcaaagacatcactgagtaacttaattacccaagattctcaaccgagaaataaacccaatatggcttattatgagctacacattttaattggattaattacccaatcctcataacagcaatgttggagatttactattatacccattgtttttgtttgttttctagatgatgaaatcaagaattatagctaagtaggtggatcacctgaggtcaagagctcaagaccagcctggccaacatggtgaaactccatctctaataaaataaaatttaaaaaaatacaaaaagttagcagggtgtgatgatgcatgcctgtgatcctagctactcaggaggctgaggcaggagaattgcttgaacccaggtggtggaggttgcagtgagttgagattgcaccactgcactccagcctgggcaacagagtgagactatgtcactgttcaatagatcatgtgagttaaaaattttctctcatcataattactttcagcaaatctctagactagattcctttcttaaccaaatttatcttataaagatgtccaaacttcttttgaataatttaaaaataaaatttgaaaaataaatttacaaaagataaaagaaatacattcatctgtcctcactaacaaaggactagagaaagtgaaggcaattcagttgaacaaaaacaggttgttaaaattcacagcatagtctgtgttgagattttagaaataataaaaaaaagagtagatgcattgttccatggattaaatcagacaagagagctaagcttttcaattcacttttctgaacaattcacaaagaaaaattatataaagtttcttgtgtctttcatttcacattgaataatatggtaaacaatttttcctaacatttttgataagaaaacaaacaaattttatttttaataatgaagctaaaacgtgtatttctacgtattttatactattttaactttgtgattctagaggcaaataaagtcttatgatggcttgacttggactatatattatagcagaggcaatgtataatgaaaagggcacttttcactgactagactgagaatcaatagatatgaatgatacttcaactatactactaatacgctgtgagactttgggcaagtaaattcaatttctgaacactgttttcaaggaagggaatcattgaccccttttaagggtctggtgaaaatgcataaacatgtataattttacaaaatatttcaggaggtttgcagacttctaggaattaaagttcctattaataggtaattaaatgaagaaatacataatcctaatgtctgttttacattctgtttctaatacaatttgtaatcatttaattgtaaatgatttcttaaactaagaacaaacaattgaacggtgtaggtgaaagtctcgctcttctattttctcccccatttgctgcctttgaccttttaaactaagattcttcttatgtaaatatcatgtaagatatcttgccacaaagaatatttcagtgtaattattccttaaatattcatgtctcaggtaattagctgatatatcatctgtgatttgcttatacgtaaggtcaaaaacctaaggtaatgcatcataaactaatcatttatattttctttgccaaggttcactgaatcttttaacctacattgactacgataaagttaattttccatattaaagtaatattcaaattagacttttaaaaattatgctatgggaaaaaacgaacacacagaagttaaaattaagggtgccataagcaaataacttggcagcttttctcagcaaaaaaaaaatatatatatatatatttatgaggcacatttctctaaattatttaagttggtgtattaaaccaatttatatctaatccagtgaaatttatgtcacatatgttcattaggagaaaataattgataaattaagaaacacttcactgtgaaaaatctattaatattcctaactcattcgatttttttttcacctttgagtttttatgaacttatttctatgccataacaatataatatagataagtataaaatacatacgtttggcttaagttatatccccaccagtctccctatcaaataaagggtgccagacagtctgctatctgcatttatctctaaactgagaataactaaaggattcagaattttatgtaaacatcaagacaatgggcttaaaataattgaatcttactctacaataatcgaacttaaagtctcagagaaatatgttagttaggacaaacgtattttgctttcccattagcctctttaccttctatttttcatcaatttgttttgcccaatcgggttttatttacacctttttaataaactacaacaactctaacaactgtttcttttaaatttattttttaattcacaggaaaaatgatatgtatttacatgcacaacatgatgttttgaagtctatgtacattgtgaaatgactaacactagctaattaacatatgcattacctcaaataattactgtttttgtggtaagaacactttacatccactcttagtatttttatgactacctcatattattaactatactcaccatgttgtacagtagatctcctgaacttattccttctaactgaaattttgtttcttttggtcaacatctccccagcccaacatctaaacaccccaggccctgataaccgccattctatggaggcttctcaagaaattagaaataaaactaccatatcatccagcaagcccattactgggtatatatccaaaggaaatgaaaccagaatgtcaaaggggtatcgccattccactacatattgcagtattaatcacagtagccaatgtatggaatcaacctaaagaatgtttttaatgacaaacaaccaggaacacattttgttaatctaatgtgctccaacttactacacaggttgaccttgcataaaagtaactttacaagaatattagcactaaataattcctaacatcttggagacaattttcaaaataatgcgtttgtttactcattcaagatgtatttactgagctaccactgttatatgccaagtgatgttctaggtcctagacatgtagcaaaaaccaaactgaaaaaaaaattaactcttgtagattttcaaagcaactatagcagcaagaggaagagacgaacaccaaaaaaaaaaaaaaaaaaaaaaatatatatatatatatatatatatatatatatatatatatatatatatatgcagtcatgtcttagtgacaaggatatgttgtgagaaatgcatcattaggcattttgtcattgggtgaacatcatagagtgtacttacacaaacctagatgatataagctaactatatacataggctagatggtatagcctattgctcctaagctcaaaaccagtacaacatgttacttcaatgaacactgtagacaattgtaacacaatggtaagtatttgtgtattgaaacatagtacagtaaaaatatggtattataagcttatgagaccatcatcttaaatgcaattcatcattaactgaaattttattatttggtgcataactatattggataatgataagtgctatgaagaaaaatatagcattacttataaattaagaaaacagatcaatctactaaacatcaggtcttccgaaaattattattattattttatttttatttatttatctatttattttgtgatggagtcttgctctgtcgcccaggctggagtgcagtggtacgatctcagctcactgcaagctctgcctcccgggttcacgccgttctcctgcctcagcctcccaagtagctgggactacagccacccgccaccatgcccggctaattttttgcatttttagtagagacggggtttcaccatgttagccaggatggtctcgatctcctgacctcgtgatccgcccgcctcagcctcccaaagtgctcgcattacaggcgtgagccaccgcccccggccctgaaaattattttttaaaccaatataatagttattcctgagaataggtacaagaatttttttaatcatgataaatttcatatcctacccctcttcattcctgcctccacctcaatccattcttcaaagagcaactaaagaaattagatcgtccagaggcttctcgtgatcctccttgcatagacccttcagcacaaactcacccatgcccgcctccagcttcatcatcctccgtgtttctctaaactcactatattcaagccatagtaactttttatttttttaagtctgtcaaacgtttaatgctccttcctgccttgggtcttcacacatatattgttcccacgttgcgcccacccccacctccctgatcccaccccacccccaaacccgactaactcctggtcactttttaataccgaagtgtgatttctgcatggaagccagttctccatgaggttcctctgttttcactcttcaagggtctttacctatcctttgggaacttactactatttaaattatgtaaacacttatgttatactctgtatatttatcaaatacccctcctcagattgcaagttctgcaggacgagttcagagaaggggtggaggcagttgtttctctccttggccagtgtactttcactgctttgcaccctgcctggcatagactaggcatttagaaaattgttcctgagagaattaaagaataaatttcataaaaaatgtcttcagtttacaacatgtagttttatgcaacacttggcaaagtgggttctggtgggagctggtaatatcctttaaatcatgggactgagcaaatgattctagttgaatctgtgttatttaatctgtgtttttaaatctgtgaggctcttgccccagactctacttgaagtctgctgtgcttgcctgtaagctcataatcccaatgacagatggtttttaatctttgctatttggcttctagaatgggtatgtattactaactcatgtattttctctaacatgtagaatctgattctggtggccattccctctgaggaataagatactttctgggacttgtagccatgggagaaaggtttaaaacactttcagagagttgaggggaagccactttatgcttggaatcattgttgaaaaaaattcaattatgaaaaatcacaaatgggtaaaaccattaaataatcccagatagcagtagctcagggcattattgtttaatcatctcatgctcaatattctaaaggacacacacatacacagcaaacaaacagtgttggtgatgttttctgtgttttttagagtgagaaattagaattatttttgaggactggaagaatctttcctcactaactagcatatcccaaatttacaccatgacacttaccaatttataaaaatattttattttatttccatatatgtcgccctaacttctttagaggcatgaacctatcttttctcttttttatccccaaggactggccaaaaagaagaaaaaaaagtttaaaataggcaattaatattcattaaataaatcacagatagtaaagaagtattaaaagcagcctgagctggagtcaactatttcttgtctgtatcagccaggcaaaatgttgctcagaagccattcagggaataaaactctcttgtgaagaatctgttcctttaaactaaggacttacgttttcccaaaccctgtaaattcccatgtttttctatatggatttatgccagaatcattccaatccactggttggcgaagagaatggtttaataactgcaggggaaatgtaaaattctattcagaatataatgaaagctgtatggtattatgtattcatttaccttgtagtaggaaaactcaaatcttcaaataacagagtgttgccatgtcagcttcctctggagagttgaaaactaaactgtaaagacagtagaacgatgtgatttgtattggagtcactggaatcgacaaaacctaaattttttttataatttatttatttcaattaacaaatgacaaattttataaactagtggtatacaatatgattttaatgtatgctctactatgcaaagcctcaattcttaattggtctacaggattcagctgataacgtgaattctgtctacctgcgtttttatatttgtgaaagaattatgctactttataactcagttttttagagtttctatattctaaaattattactttcaaccatcaaatataagatagtagaaatatggggcaaaattttttgcagttttatatcaaaaaagtagatgaatgcaatagggagtgcattaaagagaacagaaaaaaattttaaaagaaagaatggggaaaaaagaagagaaaaaaatgtaaaagaaaggcgaaggaagggaacccgaaagggcaaagaaagtgaggaaggaagggaatattgaagtatttgatagagcttccctaccacccagatgctttagtatgtgcagtatttcaaagttcttcctaggtaaatagcaatgtctttcctttttattagcactgctgcagctgctgttgctcacaaagagattcacaaatcaaaatagactcagttagcttttcaataattctgaaaaggtaggagaacattgccagaaaaggatagcactccagtatcctaacatagagtcttgttagcaaaacaaagtgtgaattgcttagataattccctgctgttggtaattccactgggtgtcttctgtggcagcacaggctacttctcctctatagaccaatgccattgaacagaagatgtcagaatgatatgaaaaagttgctcttttgaaatgtttgttcttctagatttttttaaaatgtcagcatgattcatacctattggttcttagcctggagcacccagcacaaccaggaattgaggaagctagagcaggatgtgaataacgaatgggctgcataagcagaagtctatacccagtcaataagcagaagtctatacccagtcagtgtgcagagttgcaggctagcattttcacagattctattattctctctctctcaagggaaaacgggaaaactagcaagagctagcaagaactagcaagagcttgaacaaacgcctggactcagattggaagactgctcatttgtctactgcctcattcctggaaattgcactggaactgtctgattaaggtatttggaaaaaacaaatttttgacacattttgttgatgatcaacctcctttatccatccatatctttttatatgtggcggcggggccggcggagggaagggtagtatttgtgctgaagattgaagaactgtatctctttaaaaattcttgtgatattaaggggaaattagtgtttgtcacatattctgaaattattactattattaatgtttttgaaatgctgttttcgttggtggggcactggctccttgtataacatgtttgctttctcccactgtcattttgtactctatcaaatccaaagttgtcatggttcattatctgtagatgatcttgagcagtcttgcattctaaaagaatatgccatggcatctgcctctgtgcttttgtggcctgctgcacagatgatattttagcacgagtattgggtgaggggttagaggggagagcagaatttgtctcagactgatgtttccttgtaccatgctgtgtctcattctttcatatatggctaattcaacagtgaagtacatatatcacactgtgactattacatatgttagagtacataatttgggttgtaaagtatctgtttgtcttaactaatgaattccatcaaattcaattaccattcttcattaaccaatcaaattactcctttggtctaagtcatttctaacacacttttattaggcatacacacaattctatgaagtaaacgtgaggtgattagattatctcatgatctttatttggagtcccatgctacagaagtttggatttctaaagaatagcctttcacattacttccactgtatacaggagaaatagtgttacagtgtgaagctctgtctttaagactctgttttactacttctatcttagactttcttttccctgaggaagtttgctacagtggatcgccaatacaaaaatacatagaaatacaccaactatatattcctataaaattaacctatttattaagtaaatgtacctatacgcttatgcgatactggatcataatatttttcaccttttaggaataaattatttcagtactagaactttctcctatctcttgcagtaagataccacagtgtaggatcacagttgttattgttgaaacacttttttcaaattatcattatttctttacatggatttctttttaaacaaagtggttctggaaatgcatatacccagtattgatagtacttcagttttctaggaaataattgccacagtactaatttacattggatattttaatcattttacaatgaagggcaggtgcctaatgtccttgcagtatgattcttaccatacagatcttaaaatatttccattttgttctcttctacattaatgtcttttaggaacattttcatcttctttcctacaactattttgagaaacatctcaaaatgtggtctaaagccaacctacaaaaatacatgttctgagttccatgccagacttaagtcagaatctttgggagtaggccctaggaccagcatttaaaatatacatattaggtgattataatgtaatccaaagtgaaataaccactgctctacaaaatgagagcaaggaaacaactgacagaaaagcattgtaaaactagatgtataactgatatgaaaaataaaaacaccacaatcaagttaaatttgaattttaatttttttctacatgttttcattacttggctgcaaaaagcattctaggttgtttatttcacctttaatatgagttttaaatatcttaaattaaaattttaatatttagtgttaattaaggatatggatgtctgttatttaaaagctttttccaagttgccaaacaatgaatgatagttataatggtaaaaggtattaaatttataatttgtatcattcattagtattttcatatttgaatctttagttttacaaagctttgtaaataacaagtctatctttaatattttatatatctaataaacaacactttttaaagaatttcaaccgatctttttgttaaggtttccatttaaatgaattacgtgagtgtcttactttcagaagatactttattaatacaactaaattgaattctttgggctgagatttttccattttttcataaatgaatatttccatattatctaatcttaataagaatattttctcagtgcggcaagtaagacatgtttgccaatttaatataccaaactctaaagtaagtatacactcaaatgagagttaggggacaaagaactgtcttctgaaccatgaaaagacggaatgtcgtgattacctcaggcactgaaagacagcaaaaatctacattagttctagtagaaagactacagagaatgtttgacccataaaattaatttttgcttcctacatagccgactccatggagacaaggtctaaaaagggaaaatggtcgaaatcttaggtttgtaggttaacttactttgtaaactagatatgtcctgaaaagactggaataatttaaattgtttctgcgttcataagaatcattttatgtatcaaaaattcttttgttttcagctagttttgaagattgtatttagattatggacagactactttaattgggttgtgtttcaaaagtttcattatgaagttaaatatttgggactcaaaacttattttcaaatataaagaatgctataaatgctgtttcatgcccagattcaattttatgaaatccacaacattatagtaaaattacataagttataaaactagaaattgaagggaagaatcattgaaaacaatactatatgatcgtcaaaattaagccaattagacaaaaaatattacattatatatttactttgaatataaatgctaaaggaaagtaaatttgcttataaataaatgagaaattaaaagagggggtagaatatttttctaaaacacagagagagtggggttatagcatgaacagtattctcctgagccaggggggagagggagatggaggggagagatgctgggtagatttagagaatgaaaggcaaaaggatctcaagtatgagtggccaacagcattgaactagctattaaaaagaaaatttgctcataaatggtaggcttataatccagaagaacaggtgtattcaatggtttgtttgtttttgtgttttttgttgttgttttgtttgtttctttgtttttttttttttttttttgagacggagttttgctcatgttgcgcaggctggagtgcaatggcatgatcctggctcactgcaacctccaactcccaggttcaaatgattctcctgcctcagcctcctgagtagctgggattacaggcgtgagccaccacacccagctaattttgtacttttagtagagatggggtttctccatgttggccaggctggtcaaaaactcctgacctcaggtgatccaccaccttggcctcccaaagttctgagattacaggtgagagccaccatgagcagccttaattcttttaaaatgaataggtaactatgttgttacatatccatttagaaagcagctgtgtagaggaaatggtaaggagagatagtgggcgagcatgcatgctaactcagtgagtgccaactaatggagtgaagggagaactaatgaatctttggccttctactaatggctttatctctgagtggattaactccttactctttattgagttccactttctaaggaattctaccctttgtttctttctgaaaattcagcatcaagtgaaccaaatttaccaatttgctgcctttgtgtgcacagttgttcatttaatttatgaaatagttattgaatacctactatgtagtcagcactatgcaaattttgttacttttagcccagacattaggacacaaagaatattttgttgtatttgaattttagtattttgtattttaccatttctcatttattttctgtttcttaaatttggatagttgaagggaacaggtggcatccatgcctagggatggagggctaggagtgtggataacccagagaagaaggtgcaaaaaaaggaggtatctgtcttgttcctctattctgctgattttaaggaggtcttagcagccctaagcagagcccccatcacttccatttaaccttaaaaacaatttttagagatggaaaaaatagaactatttgctcatgataaaaattctacattcaaagtgaagaaaaactactacattcaaattgaagacctgcagtatatagctctttttgagctgatatatctcattactaggctaatctatggtataagaagcaagaagttagaaaggcatcctggaaaaatggcccataattcttcatcaactgtaattttcagtgaaataaaagtctaaatctccattactagttagtttgaagtacagaaggtcatcatgtaagtttctaaaatcccttttaactctagaaattctactggagagacaggtgaataagattgggaaaaaataattgttcatctttcattgaagaaagttatttagaggaatttttcaatatcaagcacccctcctttccgttccattttcaagaaacaagagcaaaggatgagttttggcaacattccaagaagtgtcttagggcagaaatggtcaatgcctgtgttgagttacctgaatctctatttggcagcttctgaaagctactataaaaacctgggcttaagaagaggatgatggtatggtctcgcagccttgtgtgaattttctaaacggttttgttaccccaaagcatagaagtgatacctcaaaatttataactgatgctatatcatagttatactcacatataaacttgcttgataatatttcctacagttgagtttccaatcaatctatttttatctcctacacttccctgatccaacaaatcttatccatcatgcagcctgagttcatacctttgtttcttcaatgtttttattaaacatctacaatgtcagttattcttcaaaccttcttgtacaggcccctgtcctcatggagactaccttctagtagagaggtagactattaacaaggaacaaatatataaataataagacccaccaaaatcttgtttattcactaactttaatcgtatttttgtctaaattttcttcttccaagtttttttttttcagtcagtaatcctactcttcattttagcctacttgattcttactgttttcaacattgccctcaaattaatataatccactattttaactcttttaagattttccatcatcttaagtggaaggaacaaataaattcataaatttacatattagataagatgaattgccggagaaatttgatccgtatagccagatgtaagtaataccagagtggctccaatgtggccattatggaatcaaatacctcacagcccaggcctcaaaggcatcttttcttatcatgagatttttcttaattacattttccagtgattaagtgtcccatttctacacattggaatgcattttctatattaagttgtcaatgatcataaactatctgtcaagaacttattccaattatcctaacaacctcctctaggatccctagcttaaccattctacatttactatatgtacttggcacaaagatggtataaaggtttagccctaaattgtttataaatttttcacactattccaggatattagaacaggatagtcatttacttgtgtacacatataaatgtctgaatacacatcttgaaaatgcaataggttacatctgatgatggttcaagaagaactaaaaggataatcttaagggaacataaaaatttcgtgtttgaagttactgctaagaagaatagcaatgtaagagttcagataactgcaaaagtaaagaatcaaggcagtgtaaagtttctataacttagggaacttaactagctgttaaaagggcacctctctgacagcattaacatttcaaaaatttgatacataaagatgtgccagtacaaagtttggtccttagcaataatcaattaatgatactgtccttttcattcagtgaatccaagaataatagttttcagacctaaatatttacaaccacagtttcatcaaaatacagagaatatatattgtatcaagtgtgcctttatctagggcaaatcttaatagcgtctagattcagaccaaccaccaagacaaattgccaagagaattattaagaaatttgtataaatccctttattacatcttagattttaaaacttctcaaaacaattacagcccttacatacctgtgatggtttttaattccctggacaatttatcaagaaattaaaaattcagagcaccctagcaacacagtggtatatttaccattgcagtatgccagttttgtttattttttatggcacaaataccacaatgtattttatttattaatctattggctgaagtataatatgccaacagaaaagtgaataaaacatgcattttatatagcattatgagattttttctcttgctttttggtcattgatcttgtaaattgttattttttagttattatgatgaggatttaatatccagaatatattaagaaatcctacaactcaacaacaaaaacctaatgtgtctatttacaaataaaaattacaaattagtttagataattacaaattagaaaacaatgaagaatagaatttaattgaatggaaaataaatgtttatattcatggaagaaacacacataaagatgaattataatttgctatcaaatatacagaaaattagatggagtttttggttcacaatagctgacaagttgacaatatgcttatgttaaaaataaacattattctaaggtatttaaatagaaacataacaaaaataatcctgggtacggtcacttcgttagagacttgggctcaaatttaggtcccacaatagaaaaagaattaacaggaaggtggaaagagcaacaaaaccgcagttatttgtagtttgcgacataatcttgtaagaaaataagttcaagatgctaaagagagaaaaaagaaagatgcatcaagtgtggatttaaagtaaatatataccattacaagacacattgtataccgagaaccaaaaagaaacttactgaaattgtaggaaagaacaacgaatgacataatgcaatattctgagaagagaatgttgaaatttattcttgattttttttaaaagacagctatttatcttttgtgaaaaatcataatacagttctgtttaacaatgaagaactattccactgtattacctcccaattctcacatatttatacataagtattaaaactatacgtagtataataaacctaaatttctgaaatatgaacactatcacaattttctaggtgataagttattatacgattttgttatttaactgtaagcaagggagaatctaagaaagaagaatatattctttctaaaataactccccttcaagatggcagctgaatacatagaataatcagactaatcatttggggttagtggttgtttttatgttacatagaaggagaaatgaccactatctgatggcatccaagaaagtgcctctctggggacagaattgtcaccctgatcaccattgctcatgaacccccttcatgttaatgggcacattccaagtagaagacgtgataacaaattctttatgttcttttaggactgttaattctaaaaattttgggacttattatatagtgctggttaattctgagtataaatgtaaggaaattctgtttcataatttagtgtctagaataggactttataaattggtttatgatcagtgtgcttcaagtttattttgggtaccaaatgttccctttatttaatctatttaaatcaacaaaagaagcaatttcaaacggtattcatccaataaactgtagttaggaaaatgttcattaatctatttttatttaccaacaactttgtcattttctttcgaaaagcactttgaaggagggaaaaataaaaacagaaggaaagagaaattatataccactataaaaattatatgcagttttgcctgctttttatgtaacctagtattcaaaacttaactggttttatcagattccattatgttatgaacacacaggccagtatttccccaccagtttcttctaactaggaagtacattcaaacggaaaatctaagtttgtgtttttctactgaaagaaatgtcgctggtgaatagcgaagatgatttatgtgcataaagctgaccttataaaaataatctctgtgttcatcataattttattgctatgtaacatttgttccattttctttttgtatatctctgataaaccattagtttgtagatctctgatgccttagaacatatgacagtttaaaaatatctattgtgtttttccccaaattattttattagtcagtagttttttttgatgaaacagtgacatcaatttctttcatggttacaatttttgcagtgttttagctaacatattttactaactgaaaattatccttgccttttatttacacttcagaagttaaaaataaatatatttattaattaacaattatatctccaaaacaaagtaacgattatttggtttctaatgctagcagttcttgtttatatttaatgaaaatcgcatttctcctgacaggggaaaaatatttttccacattaagaaaggcttttcattcatgtcctgaaactacatatttttgttctggaatataaatcatctatttatttgatatgtatgttgaaatttagtttgtgaaacagaatatatatctatttgtatgtctctctataatagaattatggactgtgatgagttgttctccatatacatgaaggattagatacatatctttcttctttccaaaaatgccatcagcattgtcagtctcagaaaacaggtggaaaattgcctcagtgtttctgatatctcttattaaagatagttacgatgcagaactgaaaaatactaaagttttatgaagcatcaccatgaaataataaaactttcctttaataaagggctcatatccaataaagggcttatatctgaatgaatattgtcgttcactatggtcaccttaaatttcagatgcttccatcgttcaaaatattctgctgtttgtttgcaacttttagagccagtttatgcaccaggaagcagtctttgacaaacaccactgtgaaggcattatatcattatgatcagtacaaatgaggaggcaccctttctaagcatgaggaacatttcttttaatgagtctgtgccctctccaaaggaaatatgcattcatcaagtacactttaattcaaaatggtgtgtgttttctagacaaaaagatacatctctcataaaggagaagtactctgaggctgatgggctcatgaggtcacatgttggctaaaagacctcgcaggctatgcccagaacattagttagaccttttcaagatgtgggggaaaaaaagacacataaagtttcaggctgaatcaaaaagactatttttttactcagctcttgttatattttatagttacatccttatcccagacaggatataaggtcctttcaagaacccatgaggctacacatgaccttcccctgctacctctctttactggaatatgaaaccttacttgagcctacagtactctgcatacatagttaccatttgctatttactttacattagggatatataaaaaaaccctaaaaagccagcctataccaagctcagatgggcttactagtgaattttactcaacatttaaagaagagatattactagttccctacaatctcttccggaagatagaagcagagggaatacatcctaactcattctgtgaggacagaattacatgaatatcaaaactagacaaaggtaatacaagaaaagaatactatagaccagtatctctcatgaatatagaggcaaaactcctcaacaaaagccagcccataaaccatcctgtcaggtgaaaaggtaatggaactgtggagggatgttctgctttccattacaaaccatttattcattcaaccaatatttacttctgtgaggttgattctacgtggtcaagaaatcaaacctgtcatctctctcattcagtcagtcacttattaattcactcactgaacaaattttttttttcaaaatgtacaatgcgttaggcattatacctggtgctgggggatacaatagtgagcaaaataggccaaatccttgccatcatggtttttacattatattggagaaacagacaataaatgagatattaaacaaataaacaataaacaacataaatatatctatgttatatactatgttatctttatatcaataaatcaagatacatagatatcttgtttattatctatttctccaatataatgtaagatatatagtaagatttatattatatataataaatattatatatatatataaaatgtaaagtatgctaaagatatatgccaagaagaaaacaagaacttaacatgtacatacggtgaaatttacatagattgttcagagatggcctcattgagaaaatgactttgtgtaaaatcccaaaggcaatgaagaaaagcatcttgataatgtttcctggaagagcattgcagacataaagaacaagacacaacaacagaggctggtgtagagtgagtgaggaaatatacttggagatgtgaagtcagagatttagatggaaatcaaatcatgcagagccttgtgagaaatgacatggagttgtgatttttggccaaatgtaatgaacagccattggagggttttcaataggaaaatgctgtaaaatgattgactattatacaaaatttattccagtttctgtatagaagacaatatttagatatcaagagtgcaggcagatagaacaatagaagttattgcagtattccaggtgaggcagctaccagagttggtaattttgattaggcttatggctgtacactactgagaaattaatagacttgagatatgtttttaaagtagaacctatatgacttgttgatgaattgaatatggaaaataagagagaaggaatcatcaaaataattaccctagagatttccttgaacactttggtgaagccatttattctgatggggaagactccaacagaaacgggtaggggaggagaaaacaaattttgtttttatatgttaggtttgaggtcatctttggacttctaagagaagccagttaggcagttaaaatataggaggctggacctcagggaaaaagactggaatgaagatatcaaattaggatttgtatgaagtaagatactctcaatagcaaattaaagaataccttactaaaatttacttaaatattattaatatttgttatgtcactttattatatctgtttattaaatccaactctagagagtaccaaggtttattcagtagattattgatatgaaaaccctgggtcagcctctctgggagtctcagggcctagcccccccgttcccagactttgtgcagcatctcaagcatcatatcctcccatggcaacagagaaggcagagtcactgtaaggagaacatgcaggagaaagggattctttttaaagttagctctcttatctgattggggagaagagagaaaatatcttccagaaaactaccaatggatttccctaatgtcttcctccagagctacagcaaatgcccatccctataccatcctttgcaaaagggaagtgtattgtctaaaattgagaggacaagtatgagttattacttgtgactcaggttccatcatcaaagaaaaaactaggacatgttgggaaggtaaccttccatgtctgctacaggagacattctcttacagattttatttaaaatcaggaccagatgatgtccccaaaaatacacccactgtgcactcaagatatcttcatcctctctgtataaaactctatgtggctactggaagaaacagattatatcagcctgataaggggatagacagacctgttgaatcataaatagaacaagcagaaataatagaagagcttagaacattcacaggaaagtagaagaaactggattttggaaaataagtttctgggtttttgtaccacaattgagggattgtgggtggtatttgaacatgagctagtgcacctgaatgtcttagatgcctgtgaatgctgccattcaccagcagcctctgtgagagggcttaatgggtattaattgttcatttgtttctgagactctccgatataccaaccaggtgctgtgcctggagcaaataaaaagcaggcctctatcctcaaaaagttcataatttctgatggtgatctaggtaaattagtaatatattaaatatttttgccataactctcctattattgtaactttttctgactttaaaaactataacccaagcaatctattgacatttaaaccatgactatctggtttacactgtctttccagacatttactttgttctatttgttctattatagaaaagacaatgcgagttgatatctacatgtgtttttaagtacaaattcttatctgtgtctgccatatcacacggtattgtgagaagtccaaaatttaggttctttcttaaatttaattatctggtactttcctacaacactgtgtctcctattgacatttcaaatttcattttgttcacatatcttatgtttgtgtctccttgatatggataacaatagctggtgtaagagcttatctccttttgattctgaaaatgtaataaagaaggaaaatgcagagtaacagccacatgtgccggttattcaagcaaccatccaacttctgtatgaagttaatttggggaaaatatggtatgcacgctgcagctcaagctcacttgtgtcaaagagaaatacgaaaggcaagggatggtgctactttgacaagtacatgaaggaataaagtattgaaataaaacaagtgaatgtggccttatgagaatctttgttttacttataaggcacagcagtttcaagaatatgaccttgcttaatatattactgtttttacttcaaaacaacagcatttgtattcttatctaacaatttatgaatacaaatgacatgaaaatcatgagatacttttactctttatattaatttttattccatttactccacttggatatatatcctaagtaatcatcaaaattaaatgaatatttgagggaatatataacattaaaagaacccctgagaagttatgtagttcttgcctgactctaggcaaatttataatatgtaaagatcttctaaagaagaaattcatataacctattatagaaactcttccttatttctaactcaaatctttatattttatattaagcttgttgaagttttttcttagaaaatttgtaataaaacatcatatcatgtctctttggcctatagcgaatgaaaaaacctcacagttaattaatacagagattttaaaattgtagacctctagaaaactcattttgttttctttggattttatacataaaagtaaacattgatttgtaattaagagaagagaagaattcatgatttggaatcattttctgtaaaagaagaatagaattaaagatgtggcactatttaaaattagaaattagactttttatccatgaaaactctagagaaataattttgattttcaaatatgattagaaaaactcaaacattcagccttgccctttctttgaactctttcttaggctaacaagttcttctaatcttatagttttaggtgctgtttataaaattgatagttgtacatttatagattttacagaaatgtactctttttgtggataagtatctttatgccaagtttatttggctttgtgtgaattactgtttgaaaaaagactgatcattttgtaatgagtatcattacatgaagagctattatttcctggaaactttattctgcagcctcagaatgtagatcaggggccctagcaagttaaggtccaggctcctcatcaaggtcattttccttttcataccactgccctttccccaactcaaagtcagcctaatggtcagaaaggttcacttacagggaaagaaaaggaacagtgccttctttacctatgccctgcatagcaggtaacaattacctaaaattcattgtggaggattggaatatccaagagttttagaaacagttatgctcagacacctctgtgtgaccctaggcaaagtgactaagctctccaacgtattgtcctttatacacaataattaaaaagagtcctcaaaacattatctctaagataagatatgaaggtagttatggtttttcccaaactattttgacttgttctttgtcagtagcatgaggctatattaagatacaactttaaatagtgcttcataaacagtggatggccatggaatcgaattagtggcttgtgattggcatttgaataaaatagaatagaaaaaaataaaggatgtaagttacatcaaatgcagcaaggattagtattgctttgtgaaactttgtatatttgtactgtgtatatgaaattgtgctgtaaaatgtatttcttaccgtgtgtaaaagttttccaaaaatgtttaaaagatgtcagcctacagaattggaccatctagtacaacatgaaaaccccctaaaaaataccactcaaagatagagagcacagactggcattcagcaccactagaaagaagcagtgcagtgatgatcttcagggtctgtgattgctttgggcagtcttcttgctgtcatgttgcagtaagtaaggtatctgagctgcagtcatcatgtgggtgtaataagtaaaaactcacacatgcccattcagttgggcacttgtgggaaaaaagcaaatagaatagtgtatccttatttagtatatgtaagagctgtgtttaggtatctttcctcagaattcatggtactatgatgactgcagagaaaattctctatatgtttcctctacaaacttttacacttgctctttggcatttttttgtcagcaacaagatggcaactgtatgctaataaaatccctgtgcatctacctgcaactcatcccttctgatggctttatatctaattacttaaagcctgtattatgtttatctgttttataaaacagaatatgaaactgtcaggcctaaattatcctgaaccccaatctgtgaaaggacacataatgatggggaaaatatattccttatcagaacaaccaggtgttctcaaatattgactgagctgcataatcatttgggcaaagtatatcttgcaagaaaaggcagtaatgttcaaattcttgcatttttattttccatgagtttggtgttttcctttcagaataatcattgttcatgttcttgataaaatcaagttgatgcatcaaggcagctatccttgaagatataaagcctatgacattaggtcctgtgatgttgttttacatgttgcttactggcatggatgcccattcagaaattctgctattctactgggactccatttctgtttttctagaagcaactgcacatccatagaatctttcttctggaaagaaaacctttcaaataaaacacactctgcatttatttattttaagccacattaaaattttaaaaggcaaacaaaatttttaaaagtatttacatgaaccatatgaaattgctgatactttggttttttggcctataaaaatgatgatttcatatagcccaatctaatattacttttcaaaaagtaatgtaatattctaaacccaatatgcaattgcttttaagtatccaaattctttgagttcagctggtattagaagcagtctgatgctcttcctcattctcatacttaacaaatattgtcctaagtttctgctatgttcagagtgccaggcatgtggtaaagaaagaataaagctgacacaacttaataattatgaaacattttttctgatgatagtatgttgttggcagaacaaaaaagttgtgtttccattgcctacaaagtgacccaaaactttacaactccttcacatgtgtggtttttcttaagcatttcctcaacttcgtactgctttttatcgaattccctgtatttatttcctcctgagtagattcaccctgaatcaacctgtcagtgtagtttagtctttcccagatattgttccccaatttttaatgtaagaattagcctagtctttctgtgtcttgaaacattaacaaagcacttaagtgagcctttatcatttcaattgcaccaaccacgataaataaaacattagttgttctcatatattattgttccttcagttttgaggagagaatcacaagtggatgtctatgtagtttgtccctttgtaagacattcactgaatagtctgcctattgttctgcctagctctttcacatttacttgagaagtgtcatcataatttttctttttctttgttttctttttcttctccttttttttttttttcttttcgcttggtgagcatcctttgttctgaggattttttttttttttttttttgagatggagtctcactctgtcgtcaggctggagtgcagtggcgtgacctcagctcactgcaacctccaccctctgagttcaagcgattctcctgcctcagcctcctgaggagctgggattacagacacctgccactgtgcccagctaattttttgtatttttagtagatacggggtttcaccttcttggccaggctggtcttgaactcctgacctcgtgatccacccgcctcggcctcccaaagtgctgggattacaggcgtgagccactgtgcccggccaatatttttgaaacgaatgtttcccaccatcaatatacccaatgctgcagagtttctgttttttgttttttttcagagctctcactttgtttctccaaaattggtcatcccacctgtgattgctgcactgacgctccccagtctatatgctgagtaacagtagggaaattcatggaagccagcgattctccaccttcacttcaccctggatcacctggggagttttaaaaatactgacacctgggtttcactcccaagattctgattaaataggcctgaaccaaaggctgggcattaggatttttttaaatctcccagggggagctaaatgcacagtgaagcctgagaaccactaattgaagttttaacaagaatccccaggcatagccttgtgtctttgacctcattgaaaccaggcccaaactttggaataggctaaaagcaagtgtctatatccacttttagaaacccattgtggtgattcattggctaccatttattaagttttttctatctgcccaaaattcatcagagtagagctcagatctcaataggggtgagaaacaataaccataatggtcttgaagtcactttttggtatccactgccagattatgctactcacctaacaatttgggcagctttctccagagagtaattaacatctttgtaaagatgtaatcacctgaagcagctatataagcaacagcagtctcaagagctttcatttctagcagcaaagaaattgtattacagtagcatttcgccagcatatcttagaacatcagtgtaatcagtattagaatgatgcattgtaagactgaataacagaaagagattaatttctattaaatatctacatctgttggttccccaaggtagattatgctgggaaaatctaatggaggattttttttaacccagcctcctttcactccgtgcccaattcctgcagttgttgctgaggtttaccagatggattaaaagaaaaaataagaagtggctccaaacatgtaagcaatcctcaattcattgctgtttgaatgaactgtggtgttatttgcattcagtcttaatttacacggaaaatgacatccttttgcttagaaacaaagatagttttctttttctacgtaacattactcactgtaggatcaaaaacttgcctgaagtttctgaaccaaacttattgttgtccataatgtcactaataacccaggtctatctccatccaggattgttacaataaggtctggaggtgtaattataggtataatttgacctcttttttactaccttcatacaatttacttggttgaaagatctctgtcagcttttgctgaactttatgcttcgctacctcagtgcattaagtaaaccataaaaagaggtattaatagtaattttcaatgaatataatatccagctgctctcaagagaatcccttgatcacatctattgccatgattttgccttagaaaaatgttactaagcaccgacttctcccttaaggaagggttggtttcaggattttataggggaatcttgcaaagacacttttgcccattgaccagtatattgagacaaagttagagaaaagaatgagatgggaactctgctaggtgtctgttctgttttgtcagaactttgttaaagccgtggggaagagctttaaacttcccttgattgttattttagacgctaatagtcaagggtattctttaaggttcttaaagttcagaaaggccacattgacactgttacctatcaataattaggtttctaaacatcacatcaaacagcatatgcagaatgagcccaagaacagtacgatttgaggatgccgtggagttccatgccacaccctacaaatccatatatctgcttttcctgctcaactctagtttaccaaaatacagaaaacgggtcaaataaatcacagatataaagaacacaagtaaactaacaaaagcagcctgggaaatgcagtgctttaaaggaaactcagaaacagagtttggattattcacagaataaatataggcctggtcactgtatgaagaatctttgaatggtaagtcatagaaaccatgtgagctaatctcagtgatttttatcaaaaaagacactgggctatctacagaacccaaggaagcattaggctttagcatctcaaagagagagggatcaaaagcaaatacagggaggtcagcagcaggagtatggtctccaggtttctggaagtctcttagaggcccaacagcatatgcctctatatctctcagttccaattccaaactggcaggaaagttatttgatttttctatttggataagaggctcatcctatatgaactagtgaattagcaataaccaggaaagctgttcttagaacaaaaacatggcccgtgggaatcattgctatagacagtgtcagcagttctcacttagaaggacctagatagataactccataagattctgttatggctattttcacagagtccttaaaataaagaaaggtcaccaaaatatagggaaacttatgtatcatgttattcccaatgccttgggcttttctattttggctaaattgccttatattcttgacagctagatattaaataattatgccttgagagtaggtggtaatactttgcttttaaaaatagggttaaactagtctgtaagcaaccttgagtttcttttctcttgagtttataagtgatacttgaggaggagcatgcactgagggtatcttctgccctcccagaagccatctattacccaaattatgtatctttcccctttctttccttctttctctttccttttttttttttctttttttgagaaatgaggaagaaaacagtggagtttggatgagatgacgggtaggaaaggccgtgaggaagaagagacacatggggaaggaaagacagtgtctagcagagaacactgctgttaaacgaggtatcccctcacccagcagcctcatggaaagagaaccactgcttcaaggaataattctggagaagtgagactgactccacagtcaccccatctttctcttagtgatcctggtgcctgaaatgactttacaaaagctctgaccctcagtccacatttaaaaaggaaagactggattcatttaaattcaaaacaagtgacaaattggctcctatcagatctttgccccagatcaggttttggtagatctgagaacaaatgaaacaaaagaattacaataatctgaaaaggaaagaaagaaagagcaggatctgagaacccccaaaatgactcttgctttcttcatagtttgcctagtgctgtccttgattagaagtaattttatttcatttgcctatgaaaaagaaaaatattgaaattatgaccaagcatggagatattttacagataccaacctttaatttagctgaaggaacagttagggcaagagcacaacagtcaggatttgacatgaaacaaatttcattcatactcattggaagataaccctaaatatgtgaactcagtgcaacctatgtgtgaagtctctttgccaaggagcaatgctgcttgctttgttcagggatctggattatgagcactctgagaacagaagtcatgtctactgtgccatgacataacacccagcacctagcatagggcctgcacatggaggcgctggactgagtaagatttgctgaaaggatattaaatcataaagcagtatctaaacaacgatatgatgtttgagaaatcttgggaagaagtgtagaattagtagtgtttaagagtggggactctcaagttagattaaattgattcaaatcatgactgtattctctagctttgtgatctccgatttgtttactctctctaaatctggttactttctctgcaaacttggagtaataatatgagcttcctcatgggatcattcttaaaaatgaatcagcttttggacataaagcacttagcacatcttctttcacacaatgagtactcagaaatattaagtacaacaagttgctgtacagctatatgcaaagtccagtggaaatttggtcaatatcttgagtttccgtattgacagaaattttcattctatcacactgattactgatcaagggatgggtgaaataaagcgtggtgataaaaaggtctcgtttgtagatagtaatattgatgttctagaacatcaatactttggaccatgtcacagaacatggcttattttagtgctctgccctatcaactaaccaataaataaattataaaattcaaataggaagctctgactcagcaagtaatttttggaaattcatatctcgtgtttttcatctacattagcatcattcaaggagcagtagcatgctcttggctgtggtcctaagtgtttttgaaacttcatttgcaacattctctctagaaaggcagcaaacaatttagaggcaacatgatggtgttatttgtcaagaagattcttatgtatatctatagtttcactttctgagggttatttttaaagagtctggatctttgacgtatttttctattttttgtctaaaagtgggagactaatagtgctgaccaaaaccaggataaccatgatgtaaacggtttctgacagcccttctaatgacaagttcaattttgatttatatcacctttccttttcttttctaatccctccagcctggaagaaatagtctactttggatggaatgtatatctatcagaatacatgtgattaatagcaactggaattaaaataatcacactctcaatatttgaatttgtgtgttttagagaggataggtacatgtaatgcagggttcagtgtagcactttggcccactgaattgaggtaattcaggaatcagtcactgtcagtagttaatatattcaatattagtgagaatgggagaggggaccatcacaaggtgtagaagcttgctaatatccctacaaagaattcattaacttcaatatgatgtgatttgagagaaaacgttctaatcactacacattttaaataagcacttgcacttaataggtgccagggtgccgattatacaactggatattatttcatactaagaaatgctaactattggaaatgtatcagtgaagttcatggaaatatacaaaatgtttgaagtgtgaaataaatgcaaacattaccaatattagatcagattatattaaattggattggggcgtgttagaatataggacagacaacatctctaaagtaattcaaaattaattcaccattactaagctgtgattcagctgcaaacaaaatggaaagcagagtgcaatttttttttcagctaagcagtggaaggattaaaaattgtaaacttcttggaaacaaaatacctcccttgctgtttaacataagtggtatttaaaaatgactttttagaattgccttaactgcttcttttttttttttttttttttttgtgacagagtttcgctctagttgcccagcgtggagtgcaatggcacaatctcagctcaatgcaacctccgccgcctgggttcaagcgattctcctgcctcagcctcccaagtagctgagatttcagttacaggcatgtgccaccacacccagataattttgtacttttagtagagacggggtttcactgtgttggtcaggcttgtctcaaactcctgacctcaggtgatccacccacctcagccttccaaagtgctgggattacaggtgtgagccactgtgcatggccaccttaacttcttcttaatttgaatacataaagctctttatccttaaagggaaattataatttgtctgtatagttgaagctgccaagactgaggttggatttcctaatggtgccttagtcattcatacacattattctggggccaaagggttccaatcagtattttgtttggggaagaaacttttttttcatcacgatttaatgaattaaatattgtggctagaccaagtggtttaccttttaacatcaatatctgttgatcaaatacctgtatattcagtttctccaagaaatgccaatttaaattcccccaaatatcgctacttagaaaaactaaacaaaagcaatcttagccacactgtcaacagaaagtttcaaatacattggataattgaacagtgcctttccaagaattctgaaagtttacgtttctaatgtgattgcccatggaatcccttatttgtccataccttaattcatatactattctagtgtaaaaattacagcaaggataaggggctccaggagatttctagtttaaactttcagtagctaaaaattgccattatttaaccagtttacctattttacatgctacatttaatggactaaaatgatgatattttgcaaattctttacacattatgaagttcatttcttttaaaaaaaaaaaagcccctatccttctaatgaagccactgtcagtagtacagtagaacattctgaagtttcatcattcagagataatttagagaacattaactttagttcctattattaattggattcaaatatcaatacttagtagttttctcttcctttagggcaaattttaactcttgtataaagaacacagttcaaacaacgcatttaaggagaatctatgactagggtttagaagactaaagatgttacactgctctctctacgatccattctaatggttggtaagatcaggtgctattagtgactatataaaggctcaaggagtcagcacaccaccattatctgactaattgctttgtgaagtgcttttagaaaaattggaactgaaaggcactccatactaccaatttattttctgttcttagtgtcagtgatgcatgagagaacagcatattgtaaagtgtgtttttctggtgataatatttttgtcaaagtgatgcagattttaaaatactctcttgctgaaaggtacagacttatcatctgtttttcctgatgtgaagtttatcttctggatattgatttcttcaactttcttcactcagataaactagtgtttttttttggcacttgcctggaatttaaaagaagctaaaaagagtacatggattaatttcagtggttgaattaactgagaagttttgcttttggtgatttcagggttttataatcctattttaagagcattctctactttaatcatctgcatgataaaataactaaaatatttaaggaaaaaacactgctacagttgcatagaaatgtttataggtcccttttataaaaaagtataaaaatataatgtttgtttctcatttctttcaaacaattaaatcaattttattatagacttactacaatcctttgctgtttaaaaaaatttgcagaaataacatggaaaaagtaagcttaagcaagaacaaagtgcatcaatgcaacatgctccctccccagtcgaaagactatgaaataaaagcaatcatggcatatgcttgctgctcctttattataattttcatttatgaacaacttacttgctcttagctgaaatttcctcagtaggaggaataacagcgcacttgtgatttcaacatgaaatattccttgtttggctttttgctcattgccagtatttttttttttatgaaggaaaattttgcttaaaataatgtctcatcatttcacatttttaaaagtttttcctaatgaatgaagtttggcttttgacctcaatttcggtatccaggtagggagctacaccaaaaatgttctcatgctgtttttatttaaattccctgaactcttgccctgagcttatttcatttatattccaagtctcctctaattgtgaatctagtttagcatcactaatgactatgtattccttgacgctcaaattcactgagtcactccattgggatccttctattgttgttaaggagatgaggaggtaaaataaggcagaatgagaaacataggagccccctactttgtttggaaatgattttatgagatttaaagttttaaaaatatgtgttatattaagatcagtatgtcgtttccttttaaaatgagtacaaggatcttttatttatgcagcacctttcttccctaaggagtgttacaaactatacaaactatacagagtgcagaaatcacttgacccaccactggagtagaacaaagcagctgtttaacagatcacaacaatactgcaaaatcatttaagaaaagaattcaatgagaaagtacagcatcccaaagaatctatagggagagtcagaaaaagcagactacagtctctcaacttagaatttagctaggatattcaagccaaacacttcattccatttttttccccttaaaaattgtagtgcctttgatccagtgattggtatctagaaatttaagtgtttctatcacatgacatctcctagacctagtcccttggaaattacttgtctagaactgatcccccccaccacacacatacacacaaattccacttaatgacttgcaatcttcactcttctagtgtacctgccttcctaccttcatgtatcctttccaaacacagtcctagtcaacattagcaatattgcaacacatatgttatttaaaacccacagtggcggagttgtagcttatcaaaagcctcataaatatgaacaggcacacacttaagacatcactgcaagattagaaaaaatttagagatattcaatgaagttaagtaaataatgtagtagtaaaataaacctagtatgcatcattgattggttgttgcttctttgtttctgattacaaaagggtatactttaattcatattatactgcagatctttctgaactccagaatatgatctattcatacttgacacgttgatgatgtagtctgttttctcaatttgtaagtgttgaacagtcccatttcattttacataattctatagaaactacttctacaaagaaaaaatgtaggctttgaagtcagattacagttatttttttttccatctggcaggtttgaatcatcactgtctctaaaaggattaatttcttttgttccaatttaaagcaacaattgccagcatcttgaaaagtatcaattatgtgggaaaacagccatgagcagaaccataagaaaacagttaaccttcgtctttagagtaactgtgatgccactaataattccattttctatgttcccaaatatctaatgaccctcctttttaaaaatctaatactctatccaagaaaaggtaatcacatttagtttatatgtataagaaatgataatgaaaaaacattcatattcactgaaattttattcgatttacagttattagtgaagctaccagttgtctaaaattcttaaaggtaatgtacttgggcattttaaagcatgctatattattattaaaaacaaattataaatatgaaagtgatgacaattgcaatttctgttaaagtaattatagcatgtaactaattcatctaattctcactgacttctcttatgtacctgatcaattccaagatttggatatgaagcactgaggacagtcttgggaattactgagctctacacaaattttgccatttttattatactatcgttttctttagttgcataagtaattgtataaattactttagttagcataagtaatttgaatgaaatttcaataaaatgtcaataaaatagctattttgttttgttggcttagggctaaagataagaaagatttgatgttgcaattgcttttggatattttattagtacagtagcaattgttcataaatacagagtgaaaataataatgcaattttgatacagatgtgagaagactctagaccaatattttgtatctaatatgtctcagcttcctttaagtactttaccacatttcatttcacaacaacattatcaagaaaatattatttccatatttagataaaggaaatggagcagaaagtgattcagtaacttgcccaggtcacatggttataagtgatagatcaatatagctaactctaagatcctttctattaaacaataatattggtttggtgaataatatgctcatataatttcaaactttcaaagcagagtttacacaaaaacttgaagcttaactttagttgtatgaaaccccagggtttcatagaaggtaacttgaaaaccataatagatagcatcttataaaaagatgcttattgtgtgggcacagtaaaactttcctttagcactttcagtcctagcaaataaggcttctctgtgactatgctaattttattttccttagctatatgtgaagtcagcggagaaccttatttcaagggtgcatccaacatgtgttataggccagccatagactttagaaagagagtattaatgagctcataatatatctgaacctatttattagtaatgtttttcatgataatattttattcatatcatgaaattcaattatataaatatttattaatagaaagtataccccccatggatattaagaacatggaatttaaggtcccacaaacctggattgcaatctcagttttccttttgctggctctagatctaggacaagtaattttaattcactcatctacagtttccttataggaaaactcaggccaataataatgtctatctcagggctgttgtacattaatcatgtattaaattagatagtatatgtaaaacacttaatgggatatctgagtataggaagcccttcagaagtgattttattatttttgcatatataatagcattattagtgatagatactagacatggtccttaatattaaatagacacggcccctacatagacatgtaggttatggactgaaaagagaggcagttaaacaagcattggccatgcagtttactaattaccaagccagaaaagaattaaaattgtcagagttccaaaagctttcactgagttcaaaagtaatttcaagttgagaactggtcccattgaaggtatatatgtcatgagggccccagtctaaactcacattttcaaattgtccttcccaccatggaaacacttcaacactcatgggttagaatcagatacccaaaggagtattgccatttggataggcgctctgtttgcctacatttcttttccctaattgttttgcattgaaagtgtttggtgcaccttttaagatgccaaaagaccacaggcctcatctcctaacaaccagatgtgactgtgaataaaaagtttagagaggcttctcattcaaggttttcttctagggaggaccaaaatcttgaaattgactaaaaatacaatttctattttagcttagagaggacatgatggcattcattactttcaggatttcctgtctctggcaggccaacttgtgaccatgtatgaagatcacttatatcaggtttgggaattaaagtattagattcggtcatcaaaggaatgcttggttaagactagccaatggatcaagtgactcctgtatggctgaaattgccaaggccaaagagtggctagtatgtaagaagtggttcccataatatgttgtcattggaatgctctatgaggggaaaaagcagaagcagcagtgactgtaaatgaggtctagacaacaggtgcttttcttgagaaactggtcatgttactaagaatgatgatgatgatatatatttggcttttcttatcttttggcagtcagtagggataagtatttggtgccatcttctgagagcccctgaaatgacatctgtcccatctgttttatttatttgtgtgtgtgaattttttcttttgttttgggttttgttatctgaaatatactatgtaggatcgttagatatttgtgagaagatattctcggaaagcttcagagctttgcgtagtaagtctgattgcaatgggggaaaaggggaggatcctgcaacacagttcctgctttctccactatcagccatgctgatgcttttggcaaaatgcattatgatcacacttaattcctttgaaacacagtttgttaatgggtaattaagatgtcttgcattgattattgactttggttgatatatagctcctgatatttcttgctttgtaaattttttccagccactagcagagttctaaagaaagaagtaggtctgtatccttacaaatatacccctaagctctctgcccattaacatttcagtttataagtgttttcaatgtgaaactattcacagttaccttgttggccatttttcagcaaaagggccactcctgctgctgacaggcatgacagccagccaggagaaactgggcatagaggagaagcaaatctcccctcaaaattatgtgaggggaaattatatgactaaatatagcaactgtttaaattcatccataattcaagattttatcaagtccctcctcctctgtgatgcttcgttaagtactccaagccatgttgaccaccttgtcctctggactttcatggctcttagtttattcgggtatttaaaatgaaaagtaagacacattagtcattgagcacatggaaactattttcctagagggtgaaaacatgcatgttttatgtgattattgtatttttttgtagtcagcttcattaccattattaggagattattgcctggatcagtcctgaccaaagctgtttaaccatcatgtggtaataacagtactgcaggaacttgatgcccttaaggacctctatgtcaaatatctagaatttactttttcttaatttaatagatcatttgaactcagaagttagtgaacggttaatttgggaatggaggacaaaagctagatcatacttatacccttttttgttcccatacgtcaaccttcatttcctgggaggtgtcaagaaaaggctttgggagcagaaggtgaatagtagatttgagagctcaattctcattagagaggtaatgaaataatttcagtgcaaaagttcatcaaaggcagaagagtatgtgggaagtagattctgagataggaaatgcatgtggataaaaagtatgagtaatggcccccttcagtcattcggcattcaactacaaatgctttctaagtgtctggcactggttttaggaagcacttggagatatagtaataaatatgttagccaggatcactgccctcaaggaacttatactctagtgaaataaaaaaaagaaaataaccaatatgcctataaatagtgattactgtggtgaggggaaacatgaagataaaaagggaataatgagtagtgacttgggagtagaaggtccatttgtatagcatggtcagagaaaggctgtctgaaatggtcacctcttagttgaaacctaaagaataacaaccatcctggaatatctgaaggaagagggctccaagcagaggattcagcatgtgcaaaagtcctaaggcaagagtgactctggtttgttctaggagcagatagaagtgtatggctggaatttagtaaaaagaagaagagaggattggatgaaataggcatgaccacagcatgtagaatcgtataagccatgacaagtggtcggacttaattctaattacaataataagccactgagatgttttcagcagataaatactatgatcccagatatattcaagaaatttactctggctattgggtagcatattgactatagggagaaaagataagagttaagagagtgaagagaataatggaagtgatttagactataatagtggctgtgagaacgatatgaagtagttagatttggaccactttttggagacagaatagataggttatgataatgtagagagtgagggaaagaacagaatcacagatgatttccaggatcctggaatcagcagtatgttggatacgtaaggtgctccaaatgccttctcagccacctccctttgcttattcctgctttttgctagccttgttttcctgcctaatgtccttctggacaagtgcccccatgtcttttctccacaccgtgtctagcatagcttgaagtacacagcaggggatcaattaaaactccatgaactgattttctctactacctagaaaagaaaatatgattcaagaacaattttcttctataggaaaaacattttggtaaaatttatagaaactttagctttgctctaaccatgtttatggttccaagattacttggaacatgattgttccatttagtggccttccatcaaatttaaaatatgagttgttcactttcattacatgtttaacttgcacgaagatacctctttttgttattatgtgacaacttctgttgtggctgttatgaaatacaaaacaatattttaagagctctataaatggttagtactttctatgagaaaaaagtctctatgattactgtgtatcgtattttcctacactaatactttaaatcttagtgacttcaccatttagataaagagccctctggtttttgtttgtttgttttgttttgtttttgaattccaattatttatgtaaggccatacactctgtggattgtcaaaagcagtaggcaaacctactttcagtcttccctgacctcagaataatctttggttgtctgcatacttccttatggatgagcattggcaaatgcaaatcatagctattaatattaaattataggtattaagttcttacttgctccctggtaccatgataaacacgtgtatgttttatttcacttaatcaatggaaataccctatgaagtaagtaacataattatccccgttttactgataaagactgaggcttagaaaggttaaacattgtgccaatatcatctagctgttcaactagaactgaaatgaataaaagtctacaactcacattcttaactgtttagattttcagcattttgaaatttgatgtgctttcacttgcatctcttctttgtttccccatcaatatcaattccatttgtttcattatcatcctatgtttcctttcttttatttttgtttctgaatctagatttggtgcttttctccacaggtactttgagcttagcacagacggcatcctctatgtttcatggcactttcccctcattgctgtcactgttctctctcccagattcacaatactgagctctgataatatttccaacatttcttacttgcctttcagtgtctgtgaatggaatactgctatgtgagtctgaggtttgtactggaggttttatgggtttcttgttattgctagatgaatactgtaggttattactattactgtaggttaatgtttctttatcctgttctttcaatatcttcctagtatgatggagagagaggttgaaaaatcaatagaattagaattgaaaagagaccatgacaagatgaaaattggatagaaacaaattgaatgattttttttccaagttgaagttcaagattagagtaaagaggtgtctccagcttctctcagaaaataaaaggtggggaatgtctcacatgtatctatcacatgcccttttctcactttggttgcctactatggaatcctccacttcattctgaacaaattctcctctcaaaatgtttccttatgtgttcacagcagggaccaagctgtttgtagtagtatttcctactgcctcccttgatgaagaccgcacctctttatatgaaagtggggagaggaggtatctatattttatcccctcacttattaaataaagcccactacactattccctactatattttttaaattaaacctggattcctgatttaaaatttcaattcctcctataatgcctccaaaacacccagatcttctgatcttttgattctcactgattatgcctttgttccttcactacagactcataaagtcctgtcctgctatcagttttcaagtcatccctatggaagttcaaaattttttctagaggtcatcctaatcatttcacctttctatctgtattttcattattcattttatgaagacaattttcttctaaagctagatcctctaattgtacccttcattttatatttacctaattcctgagcaatcttgctcccataagaatgttgtcgttttccaaacctattttatttcccctcaaagggaaggaaggacagaggtgtcttggtctagaattgtacctgcagagatggtgagaaatagccagatttaggtcattatgccaatcattgttgagaagttcttacagaatttgcgttctatttcttaaaagaaataatggctaaaaggttgcattagaatataatatgaaactttactcgaaataatataatgtcattagtgaagaggaagttaaggaagagaccacagtcttcaagtaatggaaacatttatttaacatttactgcatattttttcatgcaataagtatttattaattgctaggtactctgctagatattaaagattctcttgagcatacaataaacaatatctccttaagtttacataccagcttagaagaaggataattaatcagtttattacaaggaagtgtgatgagtgaccagattgggaaattacagagaaatatgcaaatttatagtagggcattccatctagtcaagaaggaaataacatttcatcagagaccctaagaataaataagagttaatcctatcataatattaaggagagaaagttgaaaaaaactgtccctgacctctaagaacttacaacacaggaatctatatgctttctgaaagatcttgctagaaatagttcaaataaactagggaagaatttttaaaacaatagctgccaattttgctcttaacattttccagagatttgtaaaaaaaaaaaaaaaaaaaacacctgtgaccaatcaccattttaaacctcctgaattaaaatttctgggagtagatcctgggaatctgcattttataagctccctgggtgtttcatatatatatgaataattaggaaactttgcctaaaatataaacataggttttcttaagaaccatctgtgggtgttttaggcctggcatggtggctcacgcctgtaatcccagcactttgcggggctgaggcgggtgaatcaccttaggtcaggagttcaagaccagcctggccaacatggtgaaaccccaactatactaaaaatacaaaaattggatgggcatggtggtgtgcacctgtagtcccagctactcgggaggctgaggcaggagaattgcttgaatccaggaggcgggagcagtagtgagccgagatcagcccactgcactccagcctgggtgacagaatgagattctgtctcaaaaaaaaaaaaaaaaaagggagagaatcatctgtggtgtattatatctgcatactctcaggctgtacctgagaacctggaatttgtagcggtaagaggtccagactctatttttgggaatcagcacagtcagtgctggttgaggagtagacagaccacacatggtaactgagaactctgaagtttcaccaccatattatctattacagaagacaactgtggactagacactgatttaagttttagaggcagattggatccaatcacctggatgatatcttactttttgaccatacatagcacaaaccatctcttactcaagcataattgagcaggtactattctggtatacaaaaggcaaacacttctttgttcacaaaaatgtaagtatatgtagagatttcaataagtaaggagagaatcacttttccaattctattatttgttattgtggtgcttctgggatctatgtggtcacgtcaccattatatagctcttcctttcaaaaagagctgaagggaaaatttattataatatttcctggttccttgtgaagtgtgtaggcaaaaacagccagctgtctacaaacaagtgttcaatgcttctgaaaacaggagagtgcaccctgtcgctgctccctgtgcctctttccggactgccactgctttgtagtcagaatggcattttccttctgtggtttctcattatgctttatgatgaggtaatgtccttaatgtggcttgctgtgctttctgggacgtaccccagcccacctccagatgcatccaccctctttctttgcttcattaactgtgccatgctcctttctactacaaggcccctcctcccatgcagtcccttctacctggaggtctgtgccacctctgcttgcttccacaccagcctagctaacactcgtctttcacatgtgagctcaggagtcacttaccaaagaagcctaccttgattccccatcaaggtcagttattaaacactatttctatcttgtagagtgcacttctctgtttgtttttgtattctctttcatgagtttatttgcttaatatcaccttaactagactgaatgcagggattgtgtgttggtgtgtgtgtgtgtgtttaccatattgcctaagcatagtaggtatttcataagtatttgttgaagaagtgaatgagggtttaaaacactttgagagcatcaggtctatgatttcagttcactgagtgggttcatcaaataattgttcaatatttgctatgtactgagtccagtaatgggcaccaggaactccaagagggattaactgtttataaactgtaactacaacttgcacactgaattttagccaactctcttacaagtagatgctgttggagcacccatttgtataagcggtagccctttctcactaactcatctccccatcttctctgcaagcatctgaagcatatttcactatatttcctgcgttttttcctctataacacctaggaggtcttaataaaaatatccaatccagtccagttatagaaaacaaagcaaaaacatcagataggttcttcatttactatataaagccacttttattctagatagttatagaatgtaaaggctaagagaaaacattagaagggtaagcttatgaaggttttcttcatgtaagaccaagattctatcattatgtccattttgttagaaaataagccttcaggccggacgccgtggctcacgcctgtaatcccagcactttaggaggccaaggcgggcagataatgagatcaagagattgagaccctcctggccaacatggtgaaaccccgtctctattaaaaatacaaaaattagctgggcatggtggtgggcgcctgtagtcccagtactcgggatcatgaggcaggagaatcgcttgaacccaggaggcaagggttgcagtgagctgagattgtgccactgcactccagcctggcaacagagtgagactctctccaaaaaaaaaaaaaaaagaaaaaaaaaaaaaagaaagaaaaaggaaaagaaaataagccttgggtatttttgacaacttctaatgaaaaaccagttcaaatattttcatcagtaacaagtctcatagttagtacaatttattttttctgaaatttaacctgaaacctatgttcagatatgattcccagtcttttcaaatactttatactatttagaataatgtttagaattcttccctttaaccattccatatcatgcctattttagtgcaaatatttcttctctttgaaaatgcattctcaaaagaagacatttatgcagccaaaatcacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtatactagttcaaccatgtggaagtcagtgtggcgattcctcagggatctagaactagaaataccatttgacccagccatcctattactgggtatatacccaaaggactataaatcatgctgctataaagacacatgcacacgtatgtttattgcggcactattcacaatagcaaagacttggaaccaacccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaaggataaaaaaccaaacaccgcatgttctcactcataggtgggaattgaacaatgagaacacatggacacaggaaggggaacatcacactctggggactgttgtagggtggggggagaggggagggatagcattaggagatatacctaatgctaaatgatgagttaatgggtgcagcacaccagcatggcacatgtatacatatgtaactaacctgcacattgtgcacatgtaccctaaaacttaaagtataataataataaaataaaaaataaaaaaagaaaatgcattctaaaactttgatattaaatgtaagttaaaagtttcaaagctaaacttgcactctaatataagcttatgctgcatagactggactccaatttaaatatgtttgtaatattgtccttttgttttaagtaataataagtaaccaacttttttatttgtttttcctatttttataggtgtgcacatcaatttataccatatattatctctttgacaatttgttttatctgattcatattgttgatgtctgtatcacttactactttgctaatgatttaaactagaagaatcagagcctaaatagccagaaaaataaaagtttatgcattaaacatattcatataaaaaagatatgcagccagaatatttcggtctaatggaccgaagtaaatataatcgctccctatttgcttaaacgaatccaaaatacctagttgtcaaaacagttctgaagttcaaatgaaagcaatttgtttaaaggcttatgtgaaagacacagtaatactcttatgccatcatgtttatcctttatatcaataaacttccatgtacatacctatttaatgtattctgctagtgtttatttttgccaagctaggtaggccaggattatctacacttcttataaatgaaaaatctgaggtaaggggaggttaaatgactttgccaaggttgcacagtgagtccacagcagatctaagatgaaaacaaagtgtaatgagccatggtgcctcccttcctggaaaataatttatcaagcacttatcccaaatcaagattaataaggtcagatgataacttttccttcactgaaacacattcagctaatacaactgagatctgtttaagttaccatttctaaattttgtgtgtaatgaatcgcaaagagaaagacagttaaaaacagaagttctttctgttctctaataatatcaaaggtttcacatcttttcactatcacagcatctgtgtgaggtaggacatgtatagtgaatttatcacacctatctccagataaaagctcaaaagaaaaataggtctatggctcttcaatgctctgatatcatacgtgtttctagaattaaggctgtgtctagtgtgtttccataagcattatgctttcctttggagtcacatggttcctgtttaaacagctgtcctcagtgcaactgctttcatactggttgtaattatacttcaaatgaaaaacattgttgcattgttatttataaattggggagggagagcaacttaaactacatagaggttagtttttcagatctggaatcagttaaattatttactaagggcgccagtgtcagaaagattatcctctggtatatttatacatttaaaggggaaaaactcaattacaaaatccctgagcattaaatgggtagcaatgcttactgcaacttaatttgaaatggatttttaaaactggtggaagttgttactaatgatgtcatggaggaggcatggtgattaagttaatgttcagtatatgcccaggatttaaatatctgcatttggtctcccattcagtttgtaacagtttaataaataactaccaacaaggtataaatttgggaaaattgttattttttatttgaaatgtagtgtagtttgatggatgaaggccaccataaatccactccactatgtactaactatgatgattttgggcattttaagaggcaaagcattggtctgtttaattatctgctcctagatatggacaaggggcttattgtgtttacacaaattttcttacatccatcacttattgacctattagaaatccctggtgggaatggagaaaaatatagtgactccctaatattccacaagatttccaaaggtggctttaaaaaacaacctcaagtcagctacctgagaactgggaagttctctgctttatgataggtagatattcactttaagaaaaatatgacttcagatcaggagacaagaatattagaaataattgtagtacattcattttatacttacttgtattaggcatttattttatatcaagcattatgctaagtgttaagaatagcaaaataattaatcatagtctttgtcttcagtgagctgtctaataaaataaccaagcatgtaagcaaataaccacaatgtaatggtagagtctctaattgagacacatagatcaacaaagaaaaattaactaggatagttcaaaaatataacagagatgttactgaagagataattgttcaatgatttttcaaagtattttatttaccaacaaactgatagatgaggagggggttgtgagcaatgtgtgtgatacaaaattaggaaatctaaaagggcatgacacattgtggggaggggacttcaacctagccagaacatgtaagagttgggagccaatgttggaggaagaggttggaaatataaaaagaggttaggctgataaaggtcctgcatgctctgctaagtaatttcaggaagcagctgttgaagatttttgaccagaaaattgacatgattagattgtactttgataaaatgtctctgtcaacgaggaaataaatagatagaaagagtaacacaagtcatataaagctagcagccaagagtttagtatagaagtcatggcatggtccaggccaaaggtgaagaggtcagtagggatggtttaaaaagactggtttgaaataaaattgtttattttggttagaagagtagtgtggcatggatggcaatggataatgaggacaaagaaggacatgaagagcagatctaggtttagggcaaaagacaatttttcttaaaaattgtgcactgttcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccagggacggttgtggggtaggggaggggggagggatagcattaggagatatacctaatgctaaacacgagttaatgggtgcagcacaccaacatggcacatgtatacatatgtaacaaacctgcacgttgtgcacatgtaccctaaaacttaaagtataataataataaaaaattgtatatttattaaagtctttcctcttatataaaacaaattctaagtgaaaaccaagtaccaagaaaggaaagagctgctagaagtggatttcccttggttggatgggccaaacctaagtcctataaaggcctaaagaaaaacatttgccacttgagggtggagactttctagagttgggcagcaagacattcctggaagaaaagttgctccttatgggtatcattatttaccttcagtaagcataaagactgggttctttgagagttaaagagtttccttctaataatttgggaaagacatgttaatctcagttccgtgaattagtagttataaaattttgtatgaatcagttggattctctctgaaactcagttgtattatgcttaaaatgggagaataatatctgcctcataattatttctaaaattaaatgaaatagtataagtaaggtgttttgtattctgctcagcacatacgtaatttgtaaatgatagctattcgtcaaattcctattgaaagtagtacatgtgtccattaaattaagggttgccaaacctcaattttatatttctttatatcttgtttctctcctttattcaatcaacaagcagtttttgaagtgttgtcctgtatcaaggggtcacagatttgctggctatggtctgacaatctaatggagagagagaagtattgtcaaataaagacagtaaaatgtgatttcgcagtctataaatatatacaaataatatttcattcatgagtattcttttaatgtccttcttaaaataacttaatttggggatttgtctttaaaactctcgcaaaaatttgaagccaaattaagttactcatgagataactagtttgaattaccatcaacattccagggttatactgcaaaacctatagatgatataactacataaaccaatctacacattgataatatcataatgatagtaatcataatgaagttaaaagttaatgcaaacattatatttcagagtgcctacctaccacagttgctatctgtatagatgtaattatcaaggataatcaacatgagagacattttatttatgattcatctgcctggttggtactatgttggttacttttaacttcgatgggaaaaatgacattggactgggaggagttagaagtgaagaaacgacctacagcatttatttatttatttattttactaaactcctttcatgtcagagaaacataaaactgctgattagagaaaccaggagtaaaatttgtcagtgaaacaaaacaaattctaatcaattcttgttacagtactaaaatgctttcattttcataacccatttaacaagtagatgtttcctgtgatgcaaaaatacattttttttccttttcacacctctacaaattgcttttgtgtgatacactgcaccacaggacacttatccaaagagctaatgtaaaaacctcattttgagaaacaaaagtagtgtcaatttatatgtcaagagaatgaatactgcattccaagttgatacaggatctgacatttcaaatccaacataaattatttggaagactcctgtctttttccctgatctctgtattaacagcttttgtgaccttgaatgcaaatgaagtacaatactaaggatgttcttcatcagtatgaattagaagttttttaatgtatgtttctgtgatcatcagcttattttccaacatttattttttatctccctaaatcagtttaaccagcagcatgttgcgaatgtgactcatgtcatctgtgcctgtggttaacattatgttgctgcaacaagtccacctgacagattttttgagcctaggaagttgtccatttcaattaacaggatgcccaggacatttccctggcagaataataaaagctcacactggttctcctcctctctgaaaaagaagaaaatattatgtactattaccataaagtcaactttctatttttgtttgaaagcacagtcttagcaggaaaccaatataaacaacaacaaaaaaagtatgtgctgaaacttagagaagtgtgatttctttattctctgcattatagtatatgcaccaggcattcctttcttaattctgtctctcctgtggaaaatagatggatacatccatgagtttatattgctgctattgcctgctgttccctgtccatagcaataggtctgggttttctgtgctctggaaagaaagcactttgaagaaaatgcatcattctaatgtttaaatagcatttactctatgaactctttgaagaaacctgtggtgtttaattcctagaccattgctaagcaaggctacctaatgggtggtaaagtaaaaacacagtgtgatgatgactccaaagggcttcaagaagaatttatgcagcttctcaataatactttaatgagataggaaactgacattttctcttagtcaacgttggtgctaaacttttaacaaaattgcattgtaagccataactcttttagtccaactcaatttctctctgttctattcttgataaatatttttaattttcatgtaaacctacatcagaaaagaggccaaaaaaagaaaaccaaactgaagcaaagctccattcagctataaaaacatccttgcaaatgtatgcaggcactccttagatataccattttgtatggttgagcttcacaaactcatctctgcagcaggctgcacatttggctaggagacaactgagttataaaattggttttggactgttgagaaaagaaatggagctaaagcatagagattctatcatgagcctagtaaaataggaaccatttcttttagtaaatttttcctctaatattggtttattgtctttcataaggggcctgatcattatcaagctgcctcaccctgtttctccatgcacagtgatcctcaattaaaattgtgcatatatagatagtgaggagatgagcctaaaatactgaaaatatctcctttcttaaaaaaatcaattattactgaaaatagtatcatagcatcgtacaattgataaattatagcattatgaaaaataattataaaaaaagaaccatagcatcatacaatttgagaactgaaaggatgatcagttaacccctccaaaaattattttaaagatgaaaattgctgtgcacaaatgttgatttgcaccaaatcagaaagctagctagtattggaagaatagaagtttagaaaatatataatgcccaaacctaggctttttaagaaaataatttagtgtaattctttttatttgatttttcaaagaattgaattctaagcagaaaatttaactcactcattaacatttttattctgttgccaaaataaaattattttttatatttgtacgcccccttttttttgaaagcatcttcaaatctattatttttgtcttcatagccattctgtaagttagctataaaaatttctgatttacttttttcccactgaggacagtgtaaaacagagataaactacaacatttctaagttcacaaatcaatgtcactacagacattgactatataattatgagtgccaatgaatttgcggaagaaaaaaaaaagaggaaacttactttcactgaatacaaagttatttgtgctgaaaactattgagagaagttttatatttattaggtaattatctgtggagagccattatctcaatttcccaaacaacagactgagtctcttagatagggtaaataattcaactgaggctttaaaactgcttggagacaaaggtgggattcaaactcagtattgttactccaaaacaactacatggtctgctacgtcagtggctctcaaagtatgatctgggtacctgtagaccccaagacgtttttaaagaagattctaggattaaaactattttcattataataccatttaaaatctcattctctaacaattgtacactggagttttctagaggttacctccagctgcttgactgaagaagcagagtccatctgttttctcttaaatcaaacatttaataagatttgcagatacaaaaaataatgtcatgcttcttattatttgttttgttttggaaaattgttttaaatatattaattatgttacatgttagaggtttattgtttattttaaaataaattaattatatttttattttttacttttaatatctagtaggttatatgtctgtagatgcagctcacacacataaaacctctcatgcatccttaatttttaagagtataaaggagttctgatacaaaaaacattttgagaactgtgctaaattaagcttctttactgagtaaaattggaagctacaatatacagcaaaacaacccaggatctagctttcgaaagacaagcaaatctctgtgtaccttagttttagtgctagaaataacctttagataaaatcttgcttccatgccggttttttatttaacttatcctagaaataaatcagtaattattgttctttgcttggaggtcatgagttatgaattgtcactgtaaccaggtatttaaatcagactcttttgacttagtttgagcaaaggtctaaaaagccaaaaaggaaaagatgggtgataaaacttgcacgttccaatgtgaggggctagagtctccacagggctttcaaagacaactttaaaaattggtttgacaatgctgcttctacctgaatataaaagagttgaagtaggaaaagccaggtttttggaaattaaataatttatttgattatggctgtcattgtgctctgaatcttcatagaggagggaagaagaaagcttctgtctcccacaaaacctgaggggtggggctttagagagaccatctggagatcctcatctgtaacacatgacatttctggggctccacagaggatgtctgacccacagcaggaaaagtcaaaggtggggatattgtgactgactcagccctcaaatggaggagcatgcattgggagcttcattgagagcaatctgtgcttacagagactgagagccaagaatgatgtttcctctgggaccagatattgagaaaccagcctgtagtcgttgtttttagtaactttttattttttattatatataactgacaataatacattcattattattacataattatattgcattatttcatgcctacagacgttacaagacaagcacaaaaatccccatatactctttaccaagcttcatcaattgtttctgttatctcatttgctttattattccatctctctctctctctttctctctctctccatgcacattcatcacacatccacttttgttttctgaactattcacctataggttagagacatcatacctctttactcctaaacacttaagtatgtacttcctaagaataagcacattttcttatataaccacagtacagtggtcaacatcaggaaatttcacattgatgcaataggattacctaacacatagctggagttgttttaaattcttcgcaacactgcctggaagagcatcctaacctcacggagggagagaactgctgttttcccaaaggttgaaggaggaagtgtgaagggcaaacagatggaaatgcatggggttctaactcagtcttgagtgtctagcaatgattctaggaaattggggctggaaatagaatagaatcatttactgaaggacaattcaaagacgtatttgctgggtaatgggattgagagaggcgtgtggccagcaagcagcaaggcaaattcgaggatgggttggagagcacctatcccaagcttctgtttgtgcctattgactaatgtcagaattggtggcagaacccagggttgtgctgcttcaaaaagtaaagcacatttatgttagctgctgtactcttatccaaatccagaattttgcttgacagtatgttaatataatgtgtaatgtatctttaacattctagggctataaactcatttattcatttaataatcaaatattaactgaatgtctaccttgtaaagatacctgagcagtttgttcaacactcattcattcaacaaacacttacagataagaatgatgtaccagagtttctaattgctaggaaaacagtatttgactaaaatgggcaagacccctgctctcccctggaaagtactttctagggtacattctgttgtccttgttgaacttagcaatatcatttctgtagggggatgctgaaatgatgttttggtatatctgacatactatattttttatttttgtgattaaggaaagatttggattggagaataacgctaaataaaattttgatctagctttgttcctcagaatgatctactgtcttcttaaagtcctgtttgttggctacatattttgttatttttaaatattttcaggatagcaggtactttatgctgcatttattgtgacctttgatagtctaaagcaaagcagaacacacttatttaaaatgtgcttataagatgcttctttaggcaaatagaatttatacattcatgagcaaaagcttacagatgtatacattaatgaactaattattgtgaataccaagtgttgattttatatccaaagttccatgtgtgtttttaatatttaggaagttatgatttgtctacaagtattttgacgtgatacatgtattaaacactcaagcctgaattcagagtaattttcctctggaggcaagaaaaaaattatctgaaccatcattagttttacttcaatgtgaatcatgactccacatcaacatgattccatttcccctaagctgactttaaaactcttaaactcaaagccaaagctataatgacatttgcttgttgagctttatagaagcactgggaagcctggaaatgatgcttaaattatattgaaccttgttgtttctagtagccttttttaaaccatgagaaactaagtttagtagcttgctttggggatattatttctagacacacaaatctagtgaaaagaactcgaagtacactgtgtcagatttctggctattatacgttgtagaataaaaacatgattgatatcttaggcatacacacacatataacacatatgcatatatatgatatatgtatgtatatgtgttttatatatacatatatatttcttctatacatatgtatataggctctgtattttgttcttcagtacttgtaatgtatgcattcatatatatgtttatgtgtgcgtgcataatagctattaagtggtagcaagttataaagcctgtttgactctagagcttttttaaaaaataccagacattgtaactgtataagtgaccttttcagaaggttggtaatattgacaacctcgttgggaaatgtgttttgattttgctaaatagaagtagattatgtttatatatgaatatgaaactactttaaagtgaatctttccctcagtgctagatataagatactgaaaatagatatttaaaaagatccttgaaatgcaaatgcctttggcataatattatgataaagcattgtgtttaaagcctgatttgttaattttatgcatcatttatttgaattttatataatttttaaaggaaatattactattcaagtgttttaaatcacttccttttataattctaagttaacagattgcttacagcagtttatgcttctgttcaaacattttaaaggaagaagaactttattaacttgttgggcatagaaattatatctgttccataaacatgttccaagtacagtacacagttattattgcttcttgatgaaggaggagtgcatgtcctagttatagaaatgaggaagtaaagatccaaagagttagttgcattctctgaatgtgtaatgcatttatatattgaacattggaaaaaatgcccattcttatccatttaacatgttctttcttgataagaaaatgcaattttgcagttaagaaaagcgaaaagttataacaaataaaacactatgcttttatgttattggaatcacgtggtttatttatttattggtttttagctattagaatatatttaaagctaattgaaattccacagaactggatactgacttgttccttttatacacatatatgtataatattgtgtgtgtatatacatatatattttatatatatatatatatatatatatatatatatatcacactttcattgtccattcactatcaatggacacttaggttgtttccatttcttagctattgtgaataatgctgcaagaaatatgaagtggagatatctctttgagatactaatttcttttcctttggatttatcaagaccacaatgagatttcacctcacacctattaggatggctactacaaaaaaagataagcgataacaagtgttggaaagggaatggagaaaagggaatcctgtacattgttgatagaaaaacaaatgctacagccgttatagaaaacagtgtggaggttcctcaaaaaattgaaaatagaactaccacacaatccagtatagcccacttgtggatgtactctgctttattaagaggactgaggttcttgctatttcttgaacacagagaactatctgctgcctcaggccactgagccttcagctctctccaccttctctccaggaagtttcttacctggatcctcagctgaatgtctttctcactttactctggtttctgctgaaatatctttccagagacccctttgctgaccgcctactttaaataggctctcctccctgtctcctgcttacttccattaagctttacctgcctatatttttcttcatagccattattactaccaagagttatattgattcactttctcaatgagtccatgagagtgaggacttcatcatatttaacactagaaacactgtctatcatattaaggaggtgtcaaaaaataaaatgtcaatgcatatataaggcatataaatatataagtatgctttttattatatataagtataacaaataatacatagatattatgtagatatatataaacttgtcaagccctctgtggaataaatgcattgggcaggttgaaactcgaaagcttttaggcatgtgacaaccatacatactcgaagccaatttgtgatcttaaaaaaattcatttttttcccaaagaagaagtcaaactaaaacataatattctatggatattttaatgtggaacaatagaaataatttatttaaaaccataaataagaagctttattaagatacattctatctgcagcaatataaaagcatagcaccacatcaattatcttgagtttgctttaaacagatagagaccagtatagccatagacttcacatcaaccaccggccaaattttcatggtctgatagcctttctgtggatggacatttctccttatacattcccaccttgtgtgcatttgaacttgtctgtctctttatgcagtcatattatggactgataaagatctccacatttgatcagattaaaggggaaaaagaggatattgaatatgaccaaatccataagatgagattatcaattgcttgttcaagtaatattgtaaaaacacgtggttaattttgtcatctcaaaggtatttctatggtgaatgtgttcaaaaaccagaaaaatcacatactgtgtactgaaagcctcttcaaattttctgtctgtcgagttattttttgtgttctactaaccctgtcagaccttatcagatatttcttcacttcaatacaaatctgtttttaagcataatcttctcttatgttactgttcttctaaaattttaagtgtaaatgctgcagaataatgcatgttgctgactaatctaatactatagaagttcaaaattcaaaacacagaaataaaggaatattgatagagctaagtgctattcaaagttttttctgtagagaaaattagagcctgtatattcgttacagagactgtaaacactaggagagtaaagtccctgtgcgcactgtgggcctcatatccagggcacttagcactatataggcactcaatacatctttgttggataaacaaaaatttgaggctatgtaaatgatcccttttcccccaaaataaaaataattataacacagtattagccatttaggtataattggtaaatagttaatatagtcttactttggtctaaaatgtgcctgtttttctggatgtggtattgggaaggaatgaattatattcaataaacaatgaaatgtataagtattatagttgtataattgagtgacaattttatgccgttccataagtaaaaacttcactttacccatgaccttgtctcaagagcaatagaatagttgaaatgggacaagacatagaaaacgtatgtagaggttcctgccattcaaggtggaataataacagtaataaatattctaagagcattatttcaaaagagtcttttatgttaacaatagtcacaaaaatatttcatttttctatatcttgtggttgggacattagtctcttatgcagaaatatgtacaagatatatttttgtttttgaagtcctacatggtagtaggatactttcttgttcctgggtaatttctactaatgcaggtatcagttatgccttcaaactattcaatacctcacccttgcatactatcggtagtgcagatttgtttttgttttatagcctttgttaatgcatttgcagattgcactgaaaagagcctgagaaaattactccatatatcagcatcaacagtacaaattgtttttgtttcttttcttttttaattcacacactgtgctagtgtgccatattgtacaaatcagtaaaaaaaaaaaaaaaataggtaattaaagctgttctggaaagttgtagtgctggagcaaatatattttttcaatgtttctcaaaaccaagcaacagaaagggtaaataaaataaaacgtgaagccaaacatacattctgccctcttccaaccacaaggattcagaaatatttgcaacttctgatttggtgattaatttagcatcacttgtgaaattagtgaaattaaaatatttttcatgcatgtaatgttattctctagctaaggaatcctgaatgaaattttatttatgtagatatgctaagtgtggccataggaggttacatggtataagttaagtaattaataatagctgtaataaatgttattctaagaattctcacagtaacattttacaattagagattattttataatcaactgtattataaagataatgattttcttctttactcaaatgtagaaagaaaagttagctgatttgtatgttgctagccacatgtattatataaattctaatacaattacatgtcactgtgcttagtttttatgtcagacttgcttcaccattcacagttttcctttttctccttgaacacagatcatcagtaccatataaactacatgaaattttgtgattttaagtcaatcatgttttctcttcaacatgtgatgaatttcagtattaaatacacttctatgaaagaagcaaaaattctacatacttcataattcactttctaaattttgccttacaatattttattttattcaagtactgtgacacattaaatgaaacattacctgatcaaataaatgctaccaaattcttgtgctatattaattttctgagtttatcactgttctcatgagaaacctgaatttgctctttgttgccctttgtgaccttattctaaggatgtctacaatatggtccaatcaactttttcagtcttctttctctctccttcccatacttaccttattctcctgccacactaacctactctctagaatccaaacattcccagtgcttttctccctccataacttttctccttcataactgaaacacttttctctatcaaaacgcatagaaagaatggtcacccttcaaggaccaaatgccattagggcttttactattccattgagctctaatttgtatgcataaaaaactcattatagtctgccttgggtagagttttaaatgggttgaactctccttttcccactccatcttctggattaaaaattcttgaaagcagaaatttcttgagatttcttgcttttctattttaaacagcatttgggaaaatgctttgcccaaaatagtctatcagcaaaatataatgaaccaatatacattatgagtgaatggcaccaattactttggtgaggccatcccaaaataaaaacaatagttctttatacacttttatgtttaaattaagtgaaggagtaaggtgatgccatcagctctactttgtcttagaagtatacctacattgtctttaaataatgatgacatttagatgagatgggttgagttctcctcagagatatgttatgtctccagtagagttatagtattctccaatccttacctccaatgcgtactcactcccaacaaccactatctaaacttttggagctgctgctcatttatatatattccagaaagaatgaaatgcgtaagtttaaatagagaataaacacataattttaaaaaatgatttacataaataacatctattaaaattagctgctcaataaaatctctactagttgaaataatcatcaaaatagtattgattatactgatattaactattaatatcacaattatttgacttctctcatgttaaaactctattctagaaaataaataagaacattttccttagtatattaaataaacgtaaattttattttatgccttctgcaaatacttctgatattcccttttaagtaatattataaaatttgaggttgtagtagattgtgcctaatgtattcatcagggcttccatgttaagttattttcttagctttggcttcttcacaataaagaaacatgaacaatgtacaacacagaaacgacctctcaggtttgtggataatctgttatagcttgtcagaaaatgcaggggaattttatatttatggcttgaatatccctaaatcaccaaatccatccgctcttacttcctgttaagatgctaattcttgttagaaccctattatgtaactttcatattaaacacatcacagaattaatcctggctcttccttatagaacttaaaagaaaagcaaaggcatgcatagttaatgggcaggaggttagtaaggtttgaggtgtagtaattatcagactgggaaagaggaaaaatgagacatagaataagatataataatattctacttttggaaatcctaatcatgggaaatgtctagaatatatgcccacatatggcaaagtatctcctgtacccgttttttctttctattaatggtcacaaatcatgtttaatgatgcaagctggcatgtaagcctttgtgaaaatatatatatgttattaatctaaataaataaatatcatgggagataattgaaaattattttatgtcctacataataactaaatatcctgtagaaatcaagtaacttttttcacgtttacataaaagtcaggagcatagctagtattaagcctaagtgtaattgtagctccatgattcaactgtaccaccagattggcaaggtaaattctgagtgagaggatgctgtgttgggaaaggggactgattgtgtcctttgagcttttagtttaacaaatatttatttagaaccttatatgtatataccaggcaatgtgctaggtactgtgaactgaagattagttagatagcatttcttggggagcttctattgccctaaacaacaataacaaaaacaaacagtgtaatgcactaagtgatatatgatagagacatgaattttataggcagggaccttatcttgtactcttttttacaccacacaactcctggaattaaacaatttgttgatgtttgcctgttttatagaaatggaactttggcttcacttggggctacctccagtgtattgacataagaatacaactcacaaaaatactgtgatttgtattcagctagaagggctgagcttcccatcaacctctgccaaccaagtttgctagtcttaatacagttagcatttaaacgatttcattatgttgacattttaggtcatgttacaattgttagtaaaattaaaaatccacatgtgatagatggtgttacaagattccagtaaagtctgttaaagtgaattattttatgattattttctgattattccctatttcaaggatacaaagtaattgtaagaaagacagtttcttttcaaaagtgttacaaacttaaaccataacaagagagaaaatcacaacgctaagggattctatggcaaataccacaatgatgacattgaaaaacaaagcaaaaaaatcacttgaaatcacttgctatagtatataactccaaaagaatttgaatttcaaattgaacttcagtctctttagttgagttttatatcagaagaccaaaaactcagatccttataatctgcctcgagttgtacctcccaggaaatttgcctgttctaaggaattaatctgatatttctcttgaatatgttcttttgtcagtaaaaattagttgccattcacattagacacctaaaagatcaaagattggaagctgagaaaacagctcatccatgttattgcttcacttgatctgctgttattctattcattgtatcatttcatgggtgaaatgagagtctccttccaaccaagtcaaatagtgtcaaaattgtaggtgtaattagattgaactcttccccaaatctctaaccatagtgcacccaattgcttcctctagtgaaaactttagtatgacttaactatacgttcctcatgtaatttgttgaatgctgtctatttctctcaaatataattacattactttaaaaacatctttgaattctcctctgaataaatcattgatttagaatttcataggattgcatttatgctcattttaacattaaagaataatttgatcagaattaggtggttggttcttaacttatggtgagcttctttcttgcatcgtctcctacctttggtcttttctgtttatcagtatgtttcatccattgaagggggatctagagtctagtattctgaaatcatggcttcataagtactccaacttccgaacatctaaatctaagaactagcttttaaaatgtgttttaaccaaagtaaatttttaaaaattttacttctagggcttttagaattaaagaaatgctgtccatttaaaaggagtgtggctatttgggttaacatggtcttttgtgatttcaagtctccatataacatatcttacccatctctctagtacttacctcttcacttagattttcactcatattttatagactataattaagacaaaacatatctctagacctccatagacatgtggttttgttttatgcctaatgtaattctatgtgaactatgtagaaatagatgttctggagttaaaagtagtatgacaaatgttttgaacttctcataaatttatcctgaaggcaagcccacaatattaaatcatcatgtgtagaggaagctgtcctgttgattttgaattttttaaatataagaatcatgctgttcaggcaaaagccccaggaaaactgatcaatttaaagatgttttatcttgaaaattctttggaaagcccttttgttttaaggcttttgttcctctaagattagataaatgattttcagaaatctaagatacctcaataaattagtaaatctgttctctttcctttgggtaaatactgctttctccccattttactgatgaagaaattaagatgaagaaaacttacattaatatgaaggtaatatatctaataagtagtaaggaatgtctaaaaaattgatttactaccctctcaaagtccattccaaaattacagagacttttttgcaagagaaaaacaggatttggatacaaacagaattgaatttagatcccagctctgatacttattaactccaaagaagttatgaactgagtttgctcatatgtaaatagagataattaacgcctactgaacaatttccttgtgaagctgaatgtgataaacatatgcaatctgctgaatgcagcttattaaatagcagctgtaatttttttaaactatgctgcttctccataaataggcatatagcctcctccagtgaatctctgaagagggcaattttcatgtgaatataaaggtccaggatacctgtgaacaaagctgtattattttttataatctgacacctttttaaaaagttttattctatttttaattgatatatgcccttttgatatacctgtaagttggtgtcttaaagacagggataaaaaataatggtgtctttagagtaatttagcatgagaagttgattatttcctattttatttctacagttgttctccacatggatgcccaacagtggaaaccaaagaccacttcctctaggctgtaatttttgtccttactggtcttgcatttccagcttggcaccttcccaccattgtcatcacagggtatggtactgaactaaactcagaatatagcaaagcacctaaagatgagccgctagtcagctcagaactataaaaatctcacgccgaaccccaacataccacttacttgttcaatgacacactgctgggtttgaatatggagcaaaccaaggtttaaatacataattttctcttcttcagtcttaggcgtgtatagagaattgctaccccattctctctacctcacttccccaaaagttgggaaagctgaatccatttatgttcattgtttgtcatttcaccaacatcctccatccttataggaaatgtgcagagtttaggcagttaccttagagcactttgtaaagatttttggttggcttctcctttttatgaagccaacaattatgtatctgttttatctcaacattctccagactctaactgttgcagcatcagaatctgtgtagatatcaataccttctggaaatgaaataattcctttgcattctctttccctcatgccttcctcctcttctgtagtcccctttgtttacccaccacttcctgcccacaaagccacccattctgccatcactgccatgccagcttccttataggaatattgccatggtggtcttgatttgtacatagaatcataagagacattctgctctgttttgatatagctgagaaaatgacccctgctcacccctgcagactcaactggcaaggaaacttgaagctgtagcttcagttgcttgtaatgctttttaaatagacctttctcattaaagaactgtacatctttgaacctcatgtgataagtgccctggcctctctttccaagaacacctaggagaatatgacaatgagaaaacaaaacaaacaaacaaacaaaaaaaaaaaaaacaaggtagaggcatcacagaagtcccaggaaccatccagccttcatggctgagaagtcatctttggcagctgccaatcaacattcctgtccagtttttaagctcagagtattttctgctcatctccattcattgatgagagtttatctaacaactactcattttaagtaccagcttattacagggaagcacaaatatatagtgcatggcctcctctagttgtcaagactaaatgagcattgatgaaactgggaaaatagagagatcatgtgtaagtaagtgttgaattttgtgttacagaatgtaagtacctgacaagcttgtaggaaaaaaaatacctaaggaagccattgttggtatggaaagcttcatggaggtgtcagtaattgccagatgggtattgaattagctcttcatggaattaaatatagatgctaagaatttattcagctccttttcctctacaatgagtagtctcaattatatgaccctgtagtaaaagaatgtttacataaactcctaccattttgtagcatcttttgaacactcttcatatctcttcacttggggatgctaaacgtggaagcaggaagtgtgtagagtcactctgactgtaataaaaagaaaagataaagatttctacatctgcatacctatatcaatagtacatgtgaatgtcagttcatgcatacaaaaaccataaattacctttggcattctctcctttatattaaagcccctttcagtggtacttacttttcattatttgaatcagtgcattgatcctttattcatcttttctatttttctcatttctctttatataattcatatcaggctattctctttcacgagagtgttcacaatggcccattttaataaacggacctgtatgcagaaatatttaaagctggaagtcaccttggagaatcaacttctcccactctctcatttcacagctaatgaaatcaaggtcagaatagatgaagtgatttgcctaaggttatggactaaatagaggcatcagaaataggattataagatacagaattttacttttgtcattatgtaaccttattaattgaacatttatttatgtgacaggtactattctaggggctggagaccaaccaaagcccccccaggtacaattctgctcctgatattcacatctctgcagatttcagttagatgtgctcaatgtgactttccgttatagattttggtaaatagttttgtttcttcatgctttgatagtgcccttatcgtcactcagtcccaattaacttccccaagcttctcatttaattaattcccatcctttttttttcaaggtacatactagctctcctgacttagtgccatcctgcctcattgtcatcccccctttctaaaataattattttgagtataatgaaatgttaaacatgattgaacccagtatgtgattattgtaactctggctgccaacagatgttttcgtatttgttgacttgtataataaagtgtcaaaacagaaaaaatgagtagttctttcatccctgccccctttccctttttaaaatctttgttactaaacatttgttctgtcataatgagagcgggcttgtagacttatgcctcttacatggttgtcaatggttagacaacaaaagagaaaaaataggaaaattcttctgccctaaatatgaggtacaatcttttggccttctaccttcatttccaagaaagtccatattctgaaccattaccttccatactgttcctaccagcaaccccacaggtacttctagtggttacctgtaaccatagaacatttctttgtttactctattacttgatgaattctttttctttcactacctaatactctttagtagttatccaggtaaacattattatcttctatagctgtagacacaatcagataatgttgtgcttaatgaacaaaataaaatagccacagtttcatgtaatacagtattgataatgaaaatggcattttatttttgtttaatatttttaaaggatagttgtatggtctttttttggtaatgtttattgctctataattttaagttctcacaaaaagctgcagggatagtacaggttctcatatgccctctaccttgactcactaattatttaccttttgtcatatgtcattttttctctatcttctctctctctgtgaatatatgaatatatatatatatacacacacacatatatatacacatatatatacacacatatatatatacacacatacatatatatatatagttgtccaatacaggcaatttatctttaatataatggtattaatataataccattatctaaatcacaatctatattcaaatttcatctactgtcctaataatgttcttaacagttaattgttttatttcccactggtccaggatccaatctagaatcatgcagtgaatttagttgccatacagtgctttatttttgtgttgaaaagcttacattaacaataatgatctggacagtgtccttttaaaaataatccctgcttactgactgctgttccaataataagaatttaagtcaaaagatatgtaacaaaatcccttaggattagtgatatctgtgctgaggatatctgtgcacatcaaccttgtaactattttctaaccaccagttttggcatttcaatgggagagggtccaagacagaaaactctgagtttattaatattttacagttttgaaatttaaaccttaggactaggattctactgccattctagtccatcatgggttaaagggatagtgtttataagtagccatggaacaaggattcacagtgccctctttaaagccaatcctaaataaatatttagctcagcactatgctaccgaagcctcaaataaaatcaatattctcctcaaaagaaatgcttgatatatttaaaacaaaacctggatgtaaatatgagttgtcattcttgaaagtaagttatctttttaaaaacatacagctatgcacttttaaatgtccaacattaaaatgaatataaatagttgtcttcctccccaaaaatgccgcaaaaattatttgtatatttctgatgcctaaagcatgcagtgttttgcttaattctgtaaatagactatggttaggtctacagggtgtgagcagtttgctttctagcctctgtcgaagcaacaataatccctaaatctcagatatattttctcaatgtcaagcctgtttctaaaactagatacaaaaaaacactaaaaagtcatcagctttaccaactatgaatgtatataatattttgtgaaaaacacacaaccctacctaaacagattaatgttctttaaaagtattgtacaaaaacataaaagtatcaagccttgataagagaaaattatctgagtcagttaataccaattacattactgaaacatcagatagatgatggaaggtgcaaaataatcctttgctatgttcactttctcctctaaaataaagacaaggcatttatacatgcaagaaatagaaattagctaccagaaaaatgctgtgcccatccatattcagagcatagattaagaataaaatagttttttaattgattctaccacattttttatttttttattttttatttatttttatttttttattttttttattatactttaagttttagggtacatgtgcacattgtgcaggttagttacatatgtatacatgtgccatgctggtgcgctgcacccactaactggtcatctagcattaggtatatctcccaatgctatcccttccccctccccccacccaacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgagtaatgccgcaataaacatacgggtgcatgtgtctttatagcagcatgctttatagtcctttgggtatatacccagtaatgggatggctgggtcaaatggtatttctagttccagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggtttcgatttgcatttctctgatggccagtgatgatgagcatttcttcatgtgttttttggcagcataaatgtcttcttttgagaagtgtctgttcatgtccttcacccactttttgatggggttgtttgtttttttcttgtaaatttgtttgagttcattgtagattctggatattagccctttgacagatgagcaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtactgaatggtaatgcctaagttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccctgctgttttggttactgtagccttgtagtgtagtttgaagtcaggtagtgtgatgcctccagctttgttcttttggcttaagattgacttggcaatgcgggctcttttttggttccatatgaactttaaagtagttttttccaattctgtgaagaaagtcattggtagcttgatggggatggcattgaatctgtaaattaccttgggcagtatggccattttcatgatattcattcttcctacccatgagcatggaatgttcttccatttgtttgtatcctcttttatttcattgagcagtggtttgtagttctccttgaagaggtccttcacatcccctgtaagttggattcctaggtattttattctctttgaagcaattgtgaatgggatttcactcatgatttggctctctgtttgtctgttgttggtgtataagaatgcttgtgatttttgtacattgattttgtatcctgagactttgctgaagttgcttatcagcttaaggagattttgggctgagacaatggggttttcttgatacacaatcatgtcgtctgcaaacagggacagtttgacttcttattttcctaattgaataccctttatttccttctcctgcctaattgccctggccagaacttccaacactatgttgaataggagtggtgagacagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcaactattgagataatcatgtggtttttgtctttggttctgtttatatgctggattccatttattgatttgcatatattgaaccagccttgcatcccagtgatgaagcccacttgatcatggtggataagctttttgatgtgctgctggattcgttttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagctcctccttatacctctggtagaattcggctgtgaatccatctggtcctggactctttttggttggtaagctattgattattgccacaatttcagatcctgttattggtctattcagagattcaacttcttcctggtttagtcctgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcctgtgggcatttagtgctataaatttccctctacacactgctttgaatgtgtcccagagattctggtatgttgtgtctttgttctcattggtttcaaagaacatctttatttctgccttcattttgttatgtacccagtagtcactcaggagcaggttgtttagtttccatgtagttgagcggttttgaatgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagggttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgtgggtcactcaggacttgctttatgaatctgggtcctcctgtattgggtgcatatatatttgggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatatgccagtctgtgtcttttaattggagcatttagtccatttacatttaaagttagtattgttatgtgtgaatttaatcctgtcattatgatgttagctggttcttttgctggttagtcgatgcagtttcttcctagtctccatggtctttacattttggcatgattttgcagcggctggtgccagttgttcctttccatgtttagcacttccttcaggagctcttttagggcgggcctggtggtgacaaaatctctcagcatttgcttgtctgtaaagtattttatttctccttcgcttatgaagtttagtttggctggatatgaaattctgggtcgaaaattgttttctttaagaatgttgaatattggcccccactctcttctggcttgtagggtttctgccgagagatccgctgttagtctgatgggcttccctttgtgggtaacccaacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccatcactttcaggtacaccagtcagacgtagacttggtcttttcacatagtcccatatttcttggaagctttgctcatttctttttattcttttttctctaaacttcccttctcgcttcatttcattcatttcatcttctattgctgataccctttcttccagttgatcgcattggctcctgaggcttctgcattcttcacgtagttctcgagccttggttttcagctccatcagctcctttaagcacttctctgtattggttattctagttatacattcttctaaattttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtacgctgccgtgtgaggtgtcagtgtgcccctgctggggggtgcctcccagttaggccgctcgggggtcagggacacacttgaggaggcagtctgcccgttctcagatctgcagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcccgggcaatggcgggcgcccctcccccagcctggctgccgccttgcagtttgatctcagactgctgtgctagcaatcagcgagactacgtgggcgtaggacccgccgagccaggtgcgggatataatctcgtggtgcgccattttttaagccggtcggaaaagcgcagtattcgggagggagtgacccgattttccaggtgcgtctgttacccctttctttgactccgaaagggaactccctgaccccttgcgcttcccaagtgaggcaatgcctcgcccctgtttcggctcgcgcacggtgcgcacacccactgacctgctcccactgtctggcactccctagtgagatgaacccggtacctcagatggaaatgcagaaatcacctgtcttctgcgtcactcacgctgggagctgtagacagcactgttcctattcggccatcttggctcctccctgattctaccaccaagaataaaatagttgtttgtcccctacagtagaacaagtttgcccattcatccttgtgatagatatgcatgcaaaaccaaaatgaaatcaaatccccacagatggctcgtaagtcaaaaacactgtttaattctttcactgcatccctttgggaagcctggcccttggtaagtagtaatgtacaatgtatatagtgtcaactattctcttattttttaatagaatgtctttgtcttatttaacaggtttttttcccatatttcttgtaagaagctctgtgtcactgtttaccttaatgtgtatgtccacagaatcttgctctagtttttgttttaataaaaaagaagtgtccgtatactaaaactatacaaagcatatctaaaattgattatggctctaagtcatgtttttagaggcagtcaggcaaacctaggtgcattttaacattgctcttccaaatggattttactaagaaacagttgagtttcaagcaggaataaaggaaaagcagatcttggagatttaactgttgagcagatgcagtaaatgaggttttggaaataccgctgtcactttagatattttatgctgagttacctatgtgacccaatagctagagctgctgatattaaaatatttttgtaattctgttgaaaatagatgccatgagaactcttaaaaacagagtaacatacttattataagacctattttaaatatttcattctttcctcattttcatgatacctaaattttttgaagactgaaaatgatgagaacttatataaaaaggtacttgtctgtagcatcatggaaattttcatttatgagttgttaacatgtcaaaccaaatcagaaattcctgatatctttattacattaaagcaattcttaatgttgcctcttgagaagggtttaatttttttactctttaaactgaaagtttatcttttttatgcaatgacgtgcaatcatttttctcttaattcctgatgggcttgtaatatatacatatttatttgtgtgtgtatgtacctacatatctattaatatgtatataaacatgtatatttaaatacatgtatgtttatcctatgtactagaatagttagtaggttatatctagatattgattagcttctgaaaataggcaaatatgtataacatattgaggtgtttctaacatcggtgaaaaatataaaacttaaaagtaacatggggctgtacaaggttgatttgtaatagtcatattggtaattgagacagcaccagatatttaattgactaagaatcatgtgatttatttcttaataaatgtaatattctctaatgtctgcctagattagtgttactctaatttcaaattaaaacactatagaaagcataattgacttttcataaaatcagtatataaactatccacagactctcaatctctagctcatcaaacaactttaaaatccaaactatctgtattatatatactaaatatggatatatatgacattatttttattggaatatatagtaaaattttaagtagaaatattaaataataaaattaacatatttatgacaaaaatgattctgaactatgtgtagtcaagtaacctctgtatatattgttttccttttagaaaaacagaataattctgaaagaaagaaaacaaagaaaaacatactccagaattcctaatagaacagtaagtactttaatgacacaatgatgataataaatctgtaaaattagagcttacaaatgtcttttatagaaatactaacttctattttctaagataataaattagtagaggaagcaagttgagccttctctttcaatttactggagtaaactgaaaatcatttgtcctataatcctcttacataagagggcaaagtactcgttgtgatacatttatggggcagaaaacgtttatgatgactccatcatatcttttgactagcatagtatcatcttaaattctaaagaagaaaacagtaataagctagatgtaatcaaagtgcctcattttctccatatgtgataaaaagtttttacttattttgaacaaaattttaaatactattgatgtgcttggtttatttataatcactaaattgggattattaaaaaatggcagctatctgcaggcttaaaatctacaccatattctcattagtacatttgtttctaatctcacaacttaactaaaagtgtatttcctagaaatgtatttccttgctattgtttgatgataatatagttttcctaaatatgttctcactaagcaaagtacatgttgatgtcaatctttatggtaaaattggtgacaatataaaattttcaagatgcaggcaattataaattttgaatatgtgaatatgaagaacaataacataaagatagaaaagcaaaacccatgttgatgacccacgttgtatcacatttaatatttttgaaactgcatttgaaattgcatttcaaactcaatgtttcaaaagtttcaaacaaatattagagtaaaacatagtataataaattaacaaaatgaaacatctatatcttagtacatatcaaactagagtcaagttcaatggaaaaaaatgtaagtttgatatataaaaagtagaaatttctaaataattttataggatatatacaaattattcctgcataataacattttttagccccaaagaactttgatgcataaattacatcttaactttgaatgattgggtataattaatcatcatcacgatgatataaatgaagtttatctgaaatatattttatttatttttgaggtgtgagaaaggcagagaaaacacatttcttttacctgcctgtctgaaggttatgtatgttacaacttcacacaaagcactctgccacttactttttgttgtagttatgaacggccatatattttaaacagaaatctataaaatttataattcaaaatgtttacacttttaaaaactactctttgatttaaaaaattaactctaaatgtatgaaagtctattttgagtattcagagcaggttacgggcatgtttacatagttctgggtacagggataatttaagaatcagatttttctgtcatatataacaatttttgaaacctgcaaatctgcgtgagttacaagatatgaaataagtgagaaatttctttttgacatagaaattttttatcatcttaataccctaacatagacaatgaaatcattcagccaaaacaaacctttttcaacatctaaaagactagactgtcttaaagttttgtttttatatatataattctgtttctaaacataatttcaattctgtacaatactcattggaaaatggttgaattttttaaactgacaggactgacataagctctttatgcaagaaccaagtgatatctacttcactccctcacaatttctcggccctctgagtataatttcatgtgaaaagccatcaatgactccttttctgcgctgatttatgtataagttatttgatctattgttcaggtgtgacctatataagttatttgactggaactgtaattttcataattgtattgaaataggatttagcctagcatacctcggagacatctcattcaagtaatgagatctcctgttcatttgcagtaatcttagaaaaaaataacatacatgtttccaaagaagaaattatgcctcttttcatgcatttttatgtggtttggagcaggttttaatctcagattttaattacctattatttaataattatatgctaaatcactcataaattacatgcaaaaaaagactcttcttattatactgtaataaaaagtataatttatcctttaaaaattttatcagatattgtgaagaggaatactctgacttaaatgacattgtcaaaacataagagttcttaaaatatcttagccactaaaggctcgtgagttagtgttagacaatacatggaataaaacatgatatcagatgaatataatagataatacagtgacattttatctatagattgtgcatgtgtttctagcccatgaatgagttttatgaattgtattggaatcaaaactttataaatgaaagctttttagcacaggaaagctctacaaacctcttacaattttgcttttaaatccatagcttaagaacaagttgataattgattaaaatattactataatattgctaaagacgcttagagcacattgcatttattgcttacaaaaggtttttgtgcttaagaaatataaaagataaaaatataagatgctttcttataagaatagaaaaataaaagaccactggaaagtgtattctaaaatacagttgactcttgatcaccaactcccacacagtcctaaaattccatggttaacttttaactcctccaaaacttaactactaatagcctactgttgactggatgttatcaataacataaatagttgattaattcttatttttcatgttatgtgtattatatactcttcttaacaataaagtaggaaaagtgaagaaaatattactaagaaaattgtaaggaagagaaaatgtatttactattcattaagtggaagtggatcatcataaaggtctccatcctcatcttcacattaactaggctgaggaggagaaggaagaggaggggttggttggttttactgtctcagcagtggcagaggcagaagaaaacctgtgaataagtggacctgcatagttcaaacccgtgttgttcaagtgtcaactatagtcatctttcttttgattgctgaagctcagtaatactttcaagaacttcatagtctcctccttgtaaactctgatcacactggatactaataataaagagggtgtgtttaaaaaatcattcagatgctcagacatccgtgttagaaactcttcatattatcctagatttcctaagcctctttaataaaactgggagttgatacactcactcaaagtgtgacaactattaacaacactgctttcctgaaaaaacaaatatagcaagaagtttttagtaagagtgattctaatggaaggcagattttaaccaataaaacatcttgtggctcattagagaataaatattatttgcaaatatcccaaatgttacctgcaaatgctcctgacaagttttacttagtcaatatttccctattagaagtaataaagtcctgcaataaaaaagcataagcctgtgagtgtgtgtaatagtggcataaagctaggagaaaatttagaggtcacctattctaatattttcattttatagaggttacctcctctaatattatcatttatatatggcctgataggtcaagtcatttgcctaagctcttatatctagtgatagaattgaaaaaaaaatctgtgctaattaaccacccaccatttttttctatctgccatattaactgaaagtgctgttattaaaaaatgcatgtgtcggaactgttaaaaaaaaactcttctccaaatttaatcttttttcaaccaaaacactagtgaaaatttatgtaaattattgtttgtctaatctctagtagtttaaaattgtattttgatatagtttattagaatgatgtttataaaagttatatatctccacagtataacctttataaataaatatatatatacatatatatgtatctccactatgtatgtataaagagagctcatttatataggtatttatttatttatatttatatatatctctactatatatgtataaagagagaggtaatctgagtcttggcttaatccatctccacctaatatttattaatgataagtagtaaagaaaaataacatatgcacattaagttttcatgtgcagcgaatccataggaaaatgtgaggacattcaagattacacagtgaaaaaacaactagataataataatatgtaataataatacataaaagcaatctgccatcagcaacacttaagcagttatctcaatgagtctcccttttctcatctgggtaatgaaaaatgtctacccagcatacttcccaagattctctgagattggattaagtatatgaagatctctatagtgatatttaatttaaaattcttatatatattatcctttccccattgcttgtttttgtcaggtttgtcaaagatcagatagctgtagatatgcggcattatttctgagggctctgttctgttccattggtctatatctttgttttggtaccagtaccctgctgtttcagttactgtagccttgtagtatagtttgaagtcaggtagcgtgatgcctccagctttgttcttttggcttaggattgacttggcaatgcaggctcttttttggttccatatgaactttaaaatagttttttccaattctgtgaagaaagtcattggtagcttgatggggatggcattgaatctataaattaccttgggcagtatggccattttcacaatattgattcttcctacccacgagcatggaatgctcttccatttgtttgtatcctcttttatttcattgagcagtggtttgtagttctccttgaaggggtccttcacatcccttgtaagttggattccctatttaataaatggtgctgggaaaactggctagccatatgtagaaagctgaaatgggatcccttccttacaccttatacaaaaattaattcaagatggattaaagacttacatgttagacctaaaaccataaaaaccctagaagaaaacctagacgataccattcaggacatatgcatgggcaaggacttcatgtctaaaacaccaaaagcaatggcaacaaaagccaaaattgataaatgggatctaattaaactaaagagcttctgcacagcaaaagaaactaccatcagagtgaataggcagcctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacgcttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttctacactgttggtgggactgtaaactagttcaacccttatggaagtcagtgtggtgattcctcagggatctagaactagaaataccatttgacccagcaacaccattactgggtatacacccaaaggattataaatcatgctgctataaagacatgtgcacatgtatgtttattgcggcactattcacaatagcaaagacttggaaccaacccaaatgtccaacaatgatagactggattaagaaaatgtggcacacatacaccatggaatactatgcagccataaaaaatgatgagttcatgtcctttgtagggacatagatgaagctggaaaccatcattctcagcaaactatcgcaaggataaaaaaccaaataccgcatgttctcactcataggtgggaattgaacaatgagaacacatggacacaggagggtgaacatcacacaccgaggactgttgtggggtggggggagcagggagggatagcgttaggagatatacctaatgctaaatgacgagttaatgggtgcagcacaccaacacggcacatgtatacatatgtaacaaacctgcacattgtgcacacgcaccccaaaacttaaagtacaataataataaaatttaaaaaaattcttatatatattatataaattcttatgtataaaataatgcatattaactttaattaaaattattttataatattgacaattatttaaaatatatatcaccaataaaatatattgatttttaattaaaaataattaaaatttatatataaataaacaacacttatttttaaacaaacaataagtattattacataaaacttagactatattattgtaaaaataagttgtttttgtgaacatttgccttaattgtttttggagtaccatgcatcattttatgaaggcatgtttctgaaacaaccaaagttgttggttgatttttgctttaggcaataatgatcatccagaaaaaaaattctctttttcttgaatttataatttatctttaatcctgatctgtgttcccacacataagcctaagagagttcatatatagaaggaagggagttgggaaaggaaaggaagcatttattgggctcttgttttgtgtcagctgtttagtaggcattgaactaaatttcatttaattattcaaagaattcttctgatgttatagtggttttgcagatgatgaaaatgtggattgaaaggtttataaggttagcttacttagtatgcagcagagttgccatttaaactcaggtctgtctgatttctccttttcaagttaggactcaactaaacggggacaactagtgaaagtaaggcatatttcaccttcctatatgaatgtctatgcaaaatacttaatgtgcacacgttacttttcttttctacttatcatcaataaatattagattgcatcatgcatatttgtccttcagatgctaaaaataaaccatggtaggagaatttaattattaaagacagcaatcttttgataggaaaagtagaacccaaatcaaaatggattatagccataagtataaacattcacctaaaggagaaaaacaatatttattttgtttgtaaataacaatacagtggacattcaccatatatacttagatttttatacatgctacattatctggacttattttctttaaaaactttggtacaactttggaaattcattcctttatccttcattctttattcaacagctgctattgattacccactgtatacatagttccaggtgttttagatataggaataaataaagtatagtctctgtcatcaagtagtttatatttttagtaattacaaatatagaaaagtttgcttcataaggagaataaaagttatattgactataagtcatagattttcttttcaagctactcgtctgtttaaccatgatcagattaaattatgtttttatttgtcaaatgattcagtgttttgtcactttccctggaaattgagtaaaatgggtttcccacaatcattattattcatgataaatctaaaccatatttcatgatttacagtattttttgatacactaacaaaggagtcttttataatcttattatagcatagtactggctttgaaaattctctatattcaaatgccagctccaccacttattaactatgggatgtaggacaattttttagacctctgtgagttttgatttctccattgagtaattgtgatattcaaatgagtcaaatataggcaatgtctttgtttatataagtgtcttgttgattgtagttactgtattcaagttagctattataattagttgatagaattcagttcattgtttctaaaacttcttattaatctttgatttgtaagctctcattgatattagtctttattttattctgaaaaacattatctttcatgactctgatatgtaagttgtctagtcaaaagagataaagtggaaattatttaaccagcatttacagttttaaagaaatcatgtaaagtccaaagttaataagactttaaatcaaatgatttagctatatgaattattagttttgatctgctataacattatgatttatttacttggctacaccagggttttgccttgggttgcattattctcctttgtaattaagaatgtttgcactggataaaaaactgtattcaagtgctatttctgccacttactacctgtgtgtcagcaggaaaacaaaataagctgcctcaatgtcctcttctataaaaatgaaaatgaatcctattttatacgtttcatatgagaataatgacatgtttattaactgcttattacagaaattaatatagtaacataagtaaaaattattgttgttatatttgttatttaaaacatcttagtaatatcaaaggggcattcttttctttcaaatttatttatttattataaattgacatcttttaaattataaaacatagtcatgtaccacctaacaaatttcagtcaatgatggactgcatatatagcagtgacaccttaagattataatatcagatttttactgtaccttttctgttaagatgcacagatacttaccaatgtgttataattgcctacagtattcagtacagtgacatgtacaggtttgtagcccaagaacaaaaggctaaaccatacagcctaggtgtgaggtagactgtaccatctaggttagtataagtacatgctatgctgttcagcaacaacaaaattgcctaatgatgcatttctcaggatgtacccctgttgttgagtgattcataactgtatatagaagtctagatggaataaagaggaagggaaagtgtgagggaagaaagaaaaggagaaaagtctggttggaaatctttaacacaagatgaaatttcgatttgatagagtaggatgcaggcttgctttgggaggagtccatcaggagccctctccttgaaggcctcttccttcttaaagcaaacacagaaattagacaatctcaatagcatgactcacttccagaaaggtggagagtaaagcttgagacattttgacagtcttcgtggccctagaagtaggctgaatcagtatgcatcacgatgtgaagggtagcaaaaatgctttctatcttatcatgaaattattttctttgtaataacaaaggggaccacttcctccagagaaaatagacctaaccaaactctagactgaacagatgtccagaaataaattacatcccacacattgttattacatgcaccattttaaagttaagggcagtatgatgccattacatggcaactctcattttaaaaaataataaaattttgtatgtgatgtctgaaattgaaatcacagcattattcttttaccaaagaaatctcagttgacaaagttgcttattttgctgcatttttccctcatgatacagaatactgtttctcctcattttaaaacctcaattaattatcttcaaatgaaaattttcatattcaccattttaagtggttttgttgtttgagtcattcttttgcaaacaccataaaaatccctttacagtctgacatgggctatcaatcctaacaccacttctcctttcaatgtaaaatcttgttatgcctctaaagatgagtatatcccagtcttagtaataactattcctgtttcagcagaaagtaattcataataagtatcttagcattttcctcctttccttggaattgaatcattacaaatactgacaattttatttcttttctattctgaaagatgaaaaatctggttcagcatatgctccattgtacatttgagcaatctatatcctctgttcttatggttaatatgaattgcttaatcctgtgattgtttttgttttccattttcaaaggaatcctggcaaagcctatgttcatgaatttgtacaaaatgtttcagactaaggaaaatgtctctaaacaaaagctcaaaatacattggtttctaactcatatgaccccccccaaatgatattatacaatttttcaatagtctgaaatatattataagaaataattcttagcagtagttttgcaagttgctcaggatttttgcttatccattttatatttgcatgtggcattgacacaatttgctataacatctcctaggaagtaatatattttttttaggcatttactatttgagctgtgaaggttagtcttagatgttctttctcttttgtactttaaaattttttttctaattttgcacaaggtaaaaatgtttttaataccctctatgtcttagactcaccatgcaggggtgtccaagggagagagtacagtcatgggttcttagtttctgtttctggttgggccagtaaaaccccttcctcatccctccttcctgcttacaattagacacagaaaccaaaaattatggcttcaggctgctaaaagcctgaaacaaaacaaaataaaaacaacaacaacaaaataaggcaggttggacaagctcatgagcattacatatgtcacaacctttataataaataccattttattacagaatgcaacaaaataattatttgaattatgcctagtaacataattccagaaagaaatgggtttggacaattgtatatttatggatatatccattgttcccattttaagaagtgaacaattattagtgtgtttttttgaaaggcaaagccagatttgtcattaaatgagacagctaaaagaatggaagcaatacaagcagtccccaacttatgaatgagttatataacaaaattccttttaagatgttttctttccattttataagatggatatttatcgacagtggccacacaaaaaaacctgtgaaaacccacagcttatgctaaatgacaatatttttagcattggttatggtgactgtgtgagtgagagggacacaaggaaaaacatgtttctccatttttcctgatactcagttgaccctgcccaatatgtgaaaaataactaaagccagcttttcacacagccttctctctctttgtcacctttgttttcttcctgaggtaatgctgtttcccaactgatattctctagctgccttttctttaaagtggttttggtttccaattttctaacccaacttatctcttgatcaaaatgactcagtacagctggtatggggaaatgtctaagaaaaaataattgggccaaagtgtccacaccagccctgcatcttgcatcccctctgcttctcacttcccgacccccacaccacaattgttaatttaaataaacaaataacttaaggaatttctggcagtgtggggtcctggagtgatacatgtatagatagtatgggtgaagatatttggagacaggaactgggataggtgggaattcagccttaaatgcagcatcccctgcactgctcttgaagtgatacattttcttcaatactatacttaggagcctatagtttctttattttaatacatacacattttcccagtgggtcttgcaaagcttgtgatagaagatttgttaatgaggtatgtattagtctgttctcacactgctaataaagacatacccaagactgggtaatttataaaggaaagaggtttaattgactcacagttccacatagctggggaggcctcacaatcatgccagaaggtgaatgggggtcaaaggcacatcttacatggcagcaggcaagggagcacgtgcagaggaactcctttttataaaaccatcagatctcatgagacttattcactgtcacgagaacagcatgggaaagacgcccccataattcaatgacctcccattgggtctctcccacaacaggtgggaattatgggagctacaattcaagatgaaatttgggtggggacacaaccaaaccatatcaagatgtaataagctagagataactgcttcattttttctaaaatgtaaaagtaaatgtaaaatacatgattatataatattgtttacctatattttaattttaattcttttcaatacctcaaatgtaaaaccatccactcataaagtaaattttaagagttacctctatatgaaagaaatcgttatttgtgttagttataacattccttatacctggccacccaaaacaagaaaataatcaagttttcaattttcaatttttttatcataactctggatataaatataactaaaatgttttcagtaataactccatgcacaatgatcaaacaaatgctgtacttgttgtgggctggcatcaacaattatgaaagtggcttggtaaggccaggccagacctttgtaaccagttataccaggctactgttagacagccccagatagcccatccctctgcctcagggcttatggaaacagtggatgttggtaactgaacacttactccctgctgcatgcttcccatgtcatttcattcctgtgaagtgcattttcatatctatatttcataaatgaggagacagattctgaaaggcaaaccaacttgctcaaaataactagcttatatattttgagccagatgcagactaaagtctgtgtaatgctaaaacctgtgctcctagacattatgcaaactgtttcatgggcttacactgaaataatatctgatgaatttctctttgcataagagagtgagctccacaagtgtggtaggcagagcatcctcctatctcagaacctgacacagcgaaggtgctcaatgctggttgaaccaaagtgacaacttgtttatccagctctatcatagcagtaactttactaaaagttctctgttcccttactttttttcagaaaagttatccacgtccccaaacaaaacctacgtccctgtaacaaaaagcttttattttcaagagctgtatctttagccatttttttaattgtggtaaaatatatataacatcaaatttaccattttaaccatttgaaagtatacagctcagtggtattaagtacattcacactgttgtttgatcatcagcatcagccaccctcagaattttttcatcttcccaaagtgaaactccgtacatattaaacagcaactccccattccccctccctgcagcccctggccatcactattttaccttcagtcttgatgaaactgactattctaactacgtcatataagtggaattaaacagtatttttccttttgtaactaggttattttgtatattgtcaaggtttatccttattgtagcatgtgtcaaaattttcttcctaaggctgaataatattccattgtatgtatatatcacattttgtttatccatttatctgatgatttattgagtaatggagttgtccaaaatgaaatctttttgccaattctttgatggaaagataagatgcaaatatagaaatgcaatgagttcatgatttttagaacatctctctttttatatcataagccctaaaattaatcatggaaaactagttcagtttaggcaatcagcaaaaaaaaatagatgggcttaagataatttaggatttatgagttataaatatgccacattttaactactcaggctggaattagcctgtcttcatttgattatctgttttgatacattgactgttcttcagaagattcgtgaagttagggtatttaaaaattgccatttctctaaaattaaatagaataatagggaagggagcattgattctaaataagaatgcaaatttatagccatcaagttttctactactaccatttaacttctaatcagcgtattatggaatattcttgttcaagaattggtgtctgaaccttaagtcaataagaaggaaataatctatacagtttttagtattttcagcagttttccttatgtgctaaccaataattttttagctggcatttatcaatgccagagacacgctcatatacacatattatatatcctataatacacagcattatcctctaatcctcacactgaaaagtagacatcatcaccattttacaaatgaggaaggagaggatcagaaaggttaagtgactttctcagttaataactggcagagttggcatttgagaacaggacttctagatacaaggctgctgctctgtcacctcacacttcccctacatgttgtgaatggtgctgggccacaaaaatgaatgggacagtctccaccctggaaaaatttatattatactggaatggatgggcatttttaactaattaaaatataatagtatgaagattagaagttctttggatgccagcaggtagacatagcttaacagtgcctgaaaagctttgcaaaggaaagggcattccatcttggccttacatgacttccttccatgctggttttccattttaattagtaaagaatttagttaagcacatgggatgattggttaaagttgaagctgtaatgagatcatgaaggttaaattaaagtgtttgaagtttatctcttagcagtggaaaacaaatgtttttatgttttcattcttgctacttttttctgcttaatctaccattctgtagaagccttagtaatagaacaagcgaaggagaagaaaaagataatttttttaaaaaagaatccttttatgagcttatgctagcttattttaatgttcttgcattataggcatgattaaagattttaagtgtatgactttgcattttgatcagagttatcatctccctcaaggctgctcaataacatgatccataatgacattttgttgttattttctgacctgttgggtgaggcactaaagccagcttccctaggtctatgtagctttaagttattgcagtgaggaaatttcacagtgctgtcatgcttttggttaatacagttttgtgttttgcttgggaaagacaattctgagagtgtcctattgattcagatgttttctgacagtagctgcctaccaggtttgccttcattgacttttcaatgttctgttacaaataacttgcatgtacaatttgatattgaaaagcctagaaggttccccactgtgcatgaagttagagcagccctgagccatggggtggtgagtgcttattatcattctgaaaatcatccacttgtcctaggctgttgccataaaagggttgtgttttctctgttattcttttttgttctcctgcttcttttattctttcagacattccaatgcacttcttattctttaaaagtttaaacttcattcttaaaaattccccatggtgactgaaacttgaaatataaagtcacaggtgttttctgatatttttgaacacacggaatgtgagatggcttggattggaagtacttattttgttagtacaatttaaaagaatcacttctgtgagattttcctaaaatgatgaatggttagaaatgttcttttataatcataataaaaataactaccatttatcgaatgcctaccatctgccaagatctgtgcttagcaactttcatgctatctataatattgacaactctgtaaggtaggtatcattaaaccatttacagataaagaaacaaagactctgagaagttaagtgacttgtccaagacaagaatgattacttctatctttctaattgtggttgacttctacttattaaaaatgatggtaatatcatttgggtttgcagagcacgtcacggtttacatagcagtttcacatatgccacctcctttaacctcacaaaactgataactatattttgcatttcaccttaatctttgtgagaccatcttgaggctttagatcagaaatggggtatgaatttccttgtgctgaaatatgaccctttgttaagttagcatcatttgcaaaaatgtcttcttttctaccattactagtttatgcttctattttatcaggggagaaggcagctggagaacttgtctgttgatgcccttgaagagtttgtgggattatgtttacccagaaaatagttgcctgtagcaaaagcataataatgtttttgagacccagctgctctgcccctgaaaactatgtaggaaatacttacatagctgctatttcctgctctctcctcccaggatcccagcccgtggcatctctgcctttcaaagacattccactgtgcagtctgtccctatgtctgcttgtaaaccaaagcataatgttcatttacacataagtggaggagggggaaggagaaccttatagaattacaaataagataatattataatgggtaataagtacatttctgccttatcaccagtatttccaaaacccaatggcatcaaattctctgaaataatttagggctctgaaatgggaattgggtaaagaaaataagtaaaaaagttgttggattcaatagggaaaaataataaaacaaatacagtaacaggtacactaccctcctctatcccccttgggaacaccaaagcaaacccactcacccttccaaaaagtatcatttctttcaaatatcagagctttgacccaggagtctgacctcacttttcctgacctaactcctcctaggcgagattggtttctccctctcttctgtattctcaaagcacctaggacatgcctctgcttcagtatccatcttctctactggacatgagcaaaatgagccccctccttatccctaccattccggagaacagtccatcacttggagcataaagcttagtgcacaagtagatgaatctattcagccatgcaacagtaccagaccttctgttagtgctgtgtgctacactcagagaatgtttaaagaaatgaggaatgaagaaagggagtgaagaagacagggaatgtaggaatgagagagacagggaagaaaagactgaaggagaaaggaaagagggagtaaggaaggaaggaaagaagaaagcctggcccaagatgtgaataagagtgtaatgatttcacttatcacatagtatttcacataatatctattgtttactttcagcaaagaaatttattttgagaatatgaatatttcagaggaataattcacagtggagatggggtagatagttttgtagaagactagaaatcagtttctaaatgtttctctttccactaatttcaaagtctatttttcttattactaaaatatttccacttttatatatgtgaagataaaacttttgcttactccttagctaatgaattttataaacaaactcttttatatgtttttataatataatatgtgaaatgagaagactaagggattttacctaccacctacatattaccatattaagatattcctgaataaagtaaaccccaccataaatgtgtgtgtgttggggggtatgatttttctttttggtctatgaaacagattatgctaatttacaccagcacttccaataacaactaactattctgcaccccaaacacacacacacacacatacacacacaacacaccccatctactcttctctctcctgctccagtactctgtagcattagtttagtttctcttattccctcagccccactctttagacaaaaaaatagagagaaagaaagaaagaaagaaagaaagaaagaaagaaagaaagaaagaaagaaagaaagaaagaaagaaagaaaaggaaacctttccttctcatttctagggctctaagggtttgcacgctgccactctaccattcttcacacattccaattagaaacttaagggaggccagcgtagtggcttgtgcctgtgatcccagcactttgggaggctgaggtgggtgaatcgcttcagcccaggagtttgagatcagcctgggcaacatggtgaaaacccgtcttcacaaaaataaaaacaaacaacaacaaaaatagccggcattatagcacacacctgtagtcccagatactagggaagctgaagtgggagggtcgcttgagtccgggaggtgaaggatataggctgcagtgagcctttagtgtgccactgcattccagcctgggcgactgagcgagactctgtcccaaaagagaggagtggaggggaggggaggagaggggcacaaaggtgccatgcatatcagaggatgctttcttgtctgcttatctcaaatctggccatacatttgaatatcaaataaagctgatattctcattttcttcctctctactgaaaaataatctatcccagtaacaacagttagcagtcactgcaggcaagatgataaagaggaaaataaaaaaatcttgaggaaaaaaaaagtcaaggatgattttgaatatttattatattatcttgaaacccatcataatcacttcacaaattcttaatgaaatctgaccaaaatgtgctcccactatttgttgagatctataggaaagtcaaaatgatacaatttctcattttatcattattttttgtgcacttatgcgcacagaagatactgtgtgaattggtttgaagttttccttcttttcactatcttatagcttaattggtaatgagcagcaaattttaaaagattaaaaattacgggggggaagggaagaggaaagttagtgccctagatagagtgaaaaaaattacaaaagaacaaagtaattattcacaagatgggaaaaagatataaatgaattgaattatgagtcagacagaaaagaccacacacatatatacccacatgcatgaacatacacaaacacaaatacacatgcacacacaaaaagacatgcacacacagtctacactacacacatatcatccacccacacaaatgcagagaccacacatttgacacatgctcacaaacacacttatccaaacatggcaaaattatgctcccaatttaattagcaaagaatacattttaccagaagcagggtaaacaccacataggatagtagcatatatcagagtagcttcccttgatccccagagtccttgtgggggctcacagctgcctatgaactggacatataagcaaacctataaacctgaattctttctgcaacaccgaacttttataagccagaggtacaggatgacttcagaaaatcttaaacttacaatttttatgcctctgattaacattaagcatcacatctcttggtttgaaaaaaaaaattaaaaaaaaaaacaactcagtgacatggaggccatatcatcatctggggagagagagcagagtcagtgagcagaagctatgagcaaaatggcattaccttgcagtaaatattgtgaattatacttaatctaatattcaatttacaaatggggataattaataattagtgcctaattagaaataaatgaaataatattggtaacatagctaatacaatgcctggcacatcaaagatgcttaaaaaaacagaaatggggaaaggtgagacagattttcacttccttgttataactgatgattatccagttgcttttggtctagttggttccccttgcataatccattagcttaaactaattgcattttccaacttgatctccatttagtgtcctaacatgtattaatatgggctactgaatctgcattcatatgtctctgagacctgaataaaaccttaaaattttcagggataggttggaaatacacattacatgaatgttactatacattgccttgatgcagtgttactataattgcctccacgcagtgtgctttgggatcatagatcaaaatgatgggaaaaccttcctgccacaacaagccagttggcttgtcccactgtgagattctcccccagcttacaaaatagacatgctttttcaaaagtgtttcttttaatttgttgaaatgtcaagaagagcctaatgttatagattttggtgaaaggtagttttcccttatcaaaatcatatagctcatacctatctatttttttcaaatgtccattgtacaaaaatacagtctttatgggtatttaactcctacagttgactttaagttctgctctctatattgagcagaaaaatagtcatggaactgtggaattggaatttgaaggtatgtatatcaatgccatttaaatattaaaagtagtaggaaactatatctatataaatatagtcattttctagagtcagttagtttcaagaggcttttctttttttaacatttaagatgctttacttggagttccttagagaaaaatttcttcaaatgctaagataatataaaaaccatagctttccaaaaacttttacattaactttgaaacaagtaactaatgcaagtgaggccaagcaattagtttgtaaggagaccttgtaatgcagaggtgtaggggattccaggtaaaacatcaataccaactgtacttttttgctgtgtggtgtagaaaggcagatgagagaagtcgggatatggacacaggtcctggactttaaagattcacttaaatttccccacttctttatcctggcatacatcctcccctaggatcaagctgccatgggctagaaataaagactcagaatatatttgttcaagaccaacagatcaagtagaaattgttgtagaacatatatgtgctgctgcgtttcagggttgaatataatcatttggcaatatcacctctacatttttatttccacgaagacacacccatgagacaagccttaaagaaggtgacagcaatagatattatttccagagctcctaccatgctttggattacaatcttatcaatttgggttgaagttgcaaaaaattcaggccaaaaatgaactttgagtagtttatgaaacccaaacacacttgtcaaacctaaccatgcaaaacagcacaaattaagtcaactttcaatctggttttgtgccaaatggaatgaagcctctggtgggctagacagctctatttcctgctttcaattttggagattccaattagtaaattaaactttaaaaagctgtctaaaataattaattaggtcataattattcagaagcatattttatagtgtactctaatctagtgtctagtctaaatacttgaaaacggtatcaatttcattattaaagaattaattataattgggcctaatcctttgctgatgaacgttgaaaaaatactctggggataaactgttcacatatgcgaagtggataaattctttcagagctcaagaataatagttatgctctggaagtgttttctgcttatattaattcctttgttaaaattcttacagatatcacccaacaaataaaagtttcataggaaaaagagccctctgtttaaatgagtttatcacatatggacaactgattttcctcctactctattccaaacattttccataatcagtacattggtacagaaaagagaaaagaaacagggagaagtaacctgccgggcatggtagctcatgcctgtaatcccagcactttgggaggccgagccaggagaattgtttgaactcaggagttcatgagcagcctggacaacatcatgagatccatgtgggaaaaattttgatatttctttaacttccttctcatttcttcctaatgtccttttatgatctagcaaatcaaatttaaaaactcaacatatcataaataatgataccagagatcagtatagcttacctgtttccatctatgtcagagagaagaaataaatatagaccatttcaatactcttcctgcatatacaggccaaatagaattataaagccaaagctctagagttcaataaaggaaaggcagttaatgattatagttttatgggtaaattgttgtagtgaattaatgtgtttttcagaagagagagaacaggaatggcaggtgttcatctataaatggtgatgaacaatgtgaaaccaagaccacaggtaatatttctggtaaggatttcacaagagtgtaaaccacagcagctaaaaacaaaacttaaatccataagtagacaagttaatcagaaacatattttatgcactgtttcttctataattttaggcttcacaaaatacattacatacataactaaggccataatgctgacttaagctcttatttaaatgtatttgttgaaaatattcacagactttttcagaacatatgttctttttatatttgtctatacatgtttctattttttttcaattgtgtttggatgttgagactctaagtgatttttctattttatttatggatattataatattaattttaatactaattcaaaattttaaaaatataaaaaggaatctaaaaatccctgtaatgtagaaagatggctactaactatgacttacatgtgacttgacattgatagaaaaatactcgtgtgtttacaaatgaacacataataagtatgaaataaggatatagtcagatgttaaaatccctttctggatctcagtcctcttggcaaacataactgttgtgttactctttttattttaatgggagtaaagtgtttgggtgaaagaataatttttacttttatgtttccaaaaatacaaatactgctgttttgagatgcaaaatggaaaaattgaatagaatagaattaagtctcattgtccaacagaatcaataaataataaatgagaaaaataaagagatgctcaaatataaccttgaacataatgctttgcagggttataagagtgttcaaatgcctttcattttcatcctttcaaatttttcaaaagctaattaaggtgtcataggtaaataataatgcttctattataaccaaagcctattctttgaaggcggtttatcaagcatttctgctagtttatataaccgtagtggatctaccaatacacccaatgagtggcatacaaactgatcaagatagacccaggaatctagatacatgtccatcagtgtgagaatagcatttgccaagtcaacatttttgcctccaaaatgctttatagacctcaagaaattctaacaacactcttgagagaacatttgctcttattaacaatttctagtgagaaattaatggctaattaatttgcccaaggacaaagaaagtcagattatggttttcaggctcatttttttttagtctaattgattattagcgttgcattatctctttttttaaccttgaaggtctttttgttttcttaaaaatgcagcattctttgctattgtgaatccatgttgtggctatacttgtatttgaggttacacttctattctaagttcctatttccaacaccaattttttaggcgtttttctcttcttttttttctttttctaaagttttactttattctgcaaagctaaactagaaagatgtactaaagattgtttggcactgggtacacttgaacataaacacgggaacaacagatactggggattactgaagaggaaagacagcgacaggggcaaggctgaacaactacctattgggtactatgcttactacctgagtgacagatcatttattctcgaaacctcaatatcatgcagtatacttttgtaacaaacctgcatgggtgccctctgaatctgaaataaaagttgaaaggaaaaaaaagaaagaaaattgtttggttttgtttcaattagccaaaatttgagataagtaatagctgcaagtagtaaaaaatagtctacgctgtgtgtacataagagtagataactcaaacctcggttcccctctaaacacaaactctaaataaaggaagagggttctgcccttcaaaagtgaagatatatagacaaaagaaacaaatatcttgaaatgctgagcctcatccttttcaaaaaatacttaaataactagaaaaacaaaataaaaatagaattcagggtgtgtgtttgagagcaacagatccttcttcagtatattattggctggaagtgtacagaaatctttgtaaattttatttaaaaataatttattggctaattcaagattttatttactactttctatgccagacactattatgagttctgaagttacaataacaaatgatatggactttgtccttaaaaagctcacagtctaagagagtgggggaacccaaatataataaatctgtgctaaaagagtacaaggaaagaagtaattattaatacttctgtggacaataaacactactatagatcagaaaactgtatcccaaagcctaaatgtggttaaatgcctactatatttgtttgctaccataacaaaccaccaatttgcataacctcaacaaaagaaatttattctctcacagttctgaagactagaaatccaaactcaagatgtcagtcaggcagtgcttcctctgaactcctttagggaaggctccttccttgcttcttccagcttctggtagccccaggcacttcttaactgtggcaacataactctaattgctgcctctgtcttcacatggctgtcttccctcattgtctttgtctcttctgttcatttaagaacaccagttatgttggacttaaggcctaccctactcaagaatgacttcaccttaattacatctgcaaagaccctatttccacataaagtcatattcatagataccggggattaggacttcaacatatctttttaagaggcacaattcaacacaaaacacttactcagctaggtgctcattaaaacactggatttctgccattctgaatttaaaaggtaatgatttaattaaaacatcagagaataaaatgacatattgttttacagtttacagttctatatataggcatatatatacacagctgtcattatttcattgttatctgtagaatttcttattctgtctttaaatataaaaaggattatcttctatgaacaataaaaaagataaactaaatttaattaccaattaaagatggggtaaaaaagagcaacaacactctaaaacagaataatcatggatattgtgtaacctctctctttcgtagtttgttcatactgggagactaatgaaatagaatgataaaatcttgtccagagatgaggaggagtattaaatgacatcctgttcatttaatgtgaatataataaacttcaaagtcaaaaatgtgactataataaagtttgaaatttttgaaaatatgacacataagcataaatacgtacataagattaacacattttatctataagttatttaaatttatatacatatccaacctgaaaattgtttaatatttgagttttttatagtgtctaagaatgcgtaaatggtatgcaaaaatattttcaattttttgcttaccatagttgaatgttacaaacttactgtatccagcaaattccaaactatatgctagaacttgcagagaaaacaaaatgttttccatgacagcaagagactctatttaatcattatattaagagatttaaacaagatgagaattaaggatgggatggatattccagagaaatggaacgattaattcattcaatttatatatgttgagtttctgctctataccaggcaccggtcaaggtattgggaacacagcaatgaacacaatgttccaagtctctgccctcaaataggttaacctcaagtagcttaaattctaggtgaaggagtaaggggaaggaagggaaacgggatgaataatagataaacaacaaataaatttttagtacaagtatgttccatgaaatatttgggacacttaaataattaaacaatgaataagttgtcagaataggtaatgacaaggacaagtaataatatttttcatatgtctgatgcaatagttagaacataattattcttttttttaaaaaaagacaaggtctcactctgttgccatgctggggtgtagtggtgccataatagctcactgcagccttgaactcctagactcaagccatcttcccacctcagcctccctagtagctgggactatgggtgcatgccaccatgcctggataggatataattaactaaaaagttttttgttgcttgtctgaagttcaaatttaactgggtgccctgtattttcatttgctccatcaaaccatcttaacaggaggagatagcaaataaaggcatttttaaaagtagtatgttatatggtgataaatgctttggagaaaataaggcaaggttaggcgaattcggaatgttgtgaggagtggggaatccctactccatacatcagcgggatgacctctccaataatgaagcatttcagcagatacttgaagaaagtgagcatgtggtccaagccaccggagtcttcctggcttggctagaaggacagcaggtgaaaatccctgaggcagaagaatggtaggtctctccagaaacagagagtccagtgaactggagtagagggaggaaggagaaaagcaaatttttgcttacccttgcagtatttgttgttggccagaattacttcttcgacattaatcaaaacatgaccttcagctgtatgtatctgctcacctctgtctacctgactctctttttctgtctctccctttatctctgcctctcagcacaggcacctatctgtcttcatatatagcttacttataaaccaaacacaaagcaatgtctgctgcaagaaaaaataatgagcaacttaattcaggccttatttaccctcacgttgtcaattttgatcatttgcttatttaactaaattgttctgctttcattccagtcattagcttccatatataaaaaataatgtgctcacattccataagtatgttagatattcacacattttgcattttgcaatagagaccaagactctggagtgtttttatttaatgaaacctctaatcagatcctgtggatttactagtaattaatctttaaaataacaccatatacaggactttaataccccaatatgttaatctcatcttttgttttgaaaatcgtcctctatttaacattctatcacactgtatgctgcctcactcctgcagccctcatctccacacagctgtggtctacatggccccaacatgtgtattcagtactgccctgccaattgtaaatgagaggtttaaaaggctccagatccaagtgacacatgcagcatttgtgttgaggttctgcctccatctttgtgcctaaatctctaactgtgtagcttcccacaactagtctctagaagcctggaactccacctttatcctctcattaagtcttttaaaaatctacttgttctctgatttctagcccagttgctgatagaatttcacctgctgataaaattttctgaataaaatgtcagaatatgaatcatccttcattcttgagttttgcttacttatgaactgcgacatcctatgtcagcctctcagactcctattcttgactttcccctcgacctgtaccctgctattatcatgcttcttgacacaggccaaggtttgcctgatagactaaatttctctgagcatcagctgatgctcttgggcttcattcaagcccaattctgaatgtgattccagattttattatccctgtcttccctctttggatttggcagggctgagacacttagggataaggtaagttctgccctcttctcaataatgggattggttggatattgctttttacttcttgttttccatgcagtaggaatataaccaaaaaatactatgtacttcactgtgaagtcctgaaacaaaaatatcatcgtaaataccctggatctcaaggatctctaattagatgtaccatacacatattgtataacacttccagaaccagggattagaagaacaagccctatatttgcagaaatgcgaaccttaactaatatatgtctaatctctttaattttacatactgatgcaaaagagatactaggagttcccccatcagttcgttcaatctcttgcttcttgggcaaaatcttcaaggctcttgaatttcatagtgaatttctctttttggtctgtgggcctactctccatctttgttacttctcttttgaggctttcaccttatactcactacaacttctctctctctctctcttttttgtgctaatccaaatagactttttggccttgccctagcagacatttagattttccttcccagcaagtgtctgtctctaaagcttgatgaatagttgccaaagaacactttcctgatataaggaaatagagccatgtttggttgggctttaagatgaaacacagaatcgtctttttcactgtggtgaagtacatctgatgctttaacatttatattctagatctaacatttagactatcagttgtgtgaccttaatccccaagtcttggtttccttatttgtaaaataagaatatcggctatttgatcttgaaggtcacctacacctctgcagtttgtgatacaactattcatcacatttagcagatgcccttctctttagaaaaatctcaagcctatagaatcggatacaatttaaacgatccccagcataattttgccctctcaggatttctatcttcatagtcatacacagatttttttgaaaaccccaagaaaagaaaaccatgcaaattagaagtgaatatatattagatgattataaatcacaaattatatcaaccttgtagggaagaaaagatttcttttctaacccatagctaggtttgtagctgaggcctttataacaaaagtcattaacaagagaaaagcacacagattttttaataaaaattttatgacatgtcataaaattacattacagaacacaggaaccttcagaagtgaagagcaaaggaacggggaaacctatgacctttttgctaagtttgatgaagaagtggatagttgtggagaagtatgatgtgatctaatggaacaagctgggggaatttaggagggcctatttgttcagattctcctctgtgtccctgttccttcagagataaggatgtttcttttctctgggtatagcgaggcacctctagaatgagggttttatgacctgcttcaggggagaaaaatcaaaggaaggtgaccgtgaccttcttgcttctgttgtttcctcaaatgccaagatacattattttgtggtagcgtgttctgaactccatatttaaaaaatagaatgttaccaaaattttctaaaaagaaataatatactattttatatgttgttactctcatactttctatccattctttactgttttatttgtaggtgaatacataaaaagtttcagaattttctaaattaaccaaatcaggtgaaatgcaattgtgacccctggtcctctgtttttgcttttcatagtagatattataaatataaaacattcagtgcgagcatatttataagaatataaattgttgaggcagggtgcggtggctcacacctgtaattccagcattttgggaggccgaggcaggcagggatcacgaggtttttgggaggattttgggatcacgaggtcaggagatcgaggccatcctggccaacgtggtgaaaccccctgtctactaaaaatacaaaaattggctgggcatggtggcacgcatctatagtcccagctatgcgagaggctgaggcagtgggcttgtcattgcagacttccatgcctagatttcactagtatttacagagatgttttttagcctgtcttccttcctacccctaaccccaactcttctctggattttccacttgctggatctactgtgtcaattactgagccagtcttgacaaagttcaggtgttttagtgcaggctgcatctcagcatgcctttattcccttgtcccagctgttgcattaaccaccatgaattttctactttggtctgctgctgccctgagctctcttggataaagccttattcctgcttggtttctgtcagccccacctctagagaatgagaagctatttattcctacaacattgctatattccttccagaaatgggctactttgcccagatacaaagcactgccatccacctaattctgatattaaacatactgcttattcttccatgatacagtgcattcacactattgtattcaatgctcacagtaaccacacagagatctaccatttgacactggataggaccaagggaaggtacactttctagtttccagtttcttgcccatttcctttccattgtctcttgttgatgaaatggctctctggcccattctgaccgatccaaatagtgagggaaattaggtggttatttgggtaagttatcatgttcttgggcaattaatgggaaaggaattgaggcaaattatgaatattcttcttttaaaataaagtgatattaagcaatgtattgaagggtcaactgtgcagtatttgcaagaaataaatgacaattaattaaagacataaattttgacaagagcattacatactttctgcttttcaatgtgttgttgcttttcctacaaattgttagctgaagggaactatgaaaagctgattaaaaataatgtcacataaaaataagcattgggccattcagtattatcatgtctatcttgctggccctattagaaataccatgccctttttaaaaaattgtatgctttttttttctggtttgataaatttttacatttaaattttaaatcattaaaaagtactactcacatttttttctgatatgttttctgaaatatttttgcattagtttttatgttagtaggtacagaggcaattttgtaaaactacatttaagaatacatttttggtgtttaaaacttgttttttatgaaatggttttttttctctaaaatttcaataagcttcactagaactataaaattaaggttgcctttttccctttactcactggtcattgtccagttgtaatttatcctactgactatcacttgagagccagagcaatgttggggaagaagcaagttgactttagacttagagttgggagctgagcgtgccttctcccctcaccttcactctgttcttggatctcaccctcttcagcccccaaattttctcatctctaaatagttaagaatatcagtgtcttctctagcagaggtcatttttagggcttttataatagccaatatatataaagcacttagtttagtgcctgacatacagtaggagcttaataaaataattacttaataaaacaacataattacctatctctgaaggaattaacctttttatattttccattattttttttctaatactaacaacctccttgtttttttcttcaacttttaaaattctggggttcatgtgcaggatgtacaggtttgttacataggtaaacctgtgtatggtggtttgctgcacagaccaacccatcacctaggtattatgcctggcctccattagctattcttcctgatgctctccctccctcaacctacccacccccaaaaggccccagtgtgtgttgttccctccatgtgtccatatgaaaaaactgccttttaagagaagaatacatcagtttgtgtatacacacacacagaaagaaacgggagcgttatttcctggtttagagtttcaagaaggttttatacatactgtttgcccctggatgcaaatggatacttatgatgtatggtgtgacttcatggagagtccattgtactcaatggtaagtgataaatatattcagctatattaagaggaagaatttaaaaggcacattaatttaaaagaatgcatgagatccacctaaaaattctgttctgacaggggactaatttaggctacaaccctgaatccccagtatgtttagcgcttgtgatgtttggaataccctataactaaagaatgaatagaaaatatttaacttgcaatcatggtaaaatataagtctaataaactattgtcacaagttggcaaaactattgtcacaagttggcaagaacatgagaacgatttcaactgactttcacctctccctacacagagattaatacagtaataattttactttgatgtataatccatattaaaaatacactgagtgatttaaatggttcctatgctatatgaagcattaggtatatcaaaagcccctgaatccaagatgtaaaagccttggaactttataagaagattgacatgtatttgtgagattatttttgtagaatgtaaaataggaaattttatctagctaaatttaaatccccactaatacagattatcatctcatttaaattatgatatatatgttgttatttaaattaattacctagatattttatacatagatatatcaaataaaattaatgtatcaaagtatgatagtagaaatgacattttcagatatttgaattcctttattttttctttcattgtagcaatgttctatatcaaccacagaacctttgaaacatgcacgttatgttatgaacatataaataaataattttattcatttgaaaggccacaataatttcaaagaactatttgcagttgacattgaccaaaataaaatacactgaagtgataaaacagattttagatcttaaagttgtagtggctgttaacattgaatagatccataaacatgaaaaatgggccatctgtcctttgtgctgactcaaggataatactttaaaaataagatcagtacttttacatagctgctgattgttatggataacaatcttaaattcaaatttaagattgaatttaatcttaattcaatcttaattaatttaaggagaatcttaaattcaaagtacaatattttctattattcgccagtgagtcattgttaccaaagtaaaaccttcacttcttcaatagcaaactttctgctctttcaatgagattaagcatttgactaatcctcattttatgtttaatattaacttattggtcctataggaaaacagcctgaggatttagtatatagacatttatccaatgatataaaatctgtgtatttggacaagaaagaaagaattatgcaaattacttatttctttttatattatatcagacatctgcatatttgggacatctggatatttgacaaccacgaacctcaatatgattaactgagcatttcattttttatctaaatgatttggcaccaggcaaaacagatttaatgattattaattaaccttcaggtccaaggagagttagagaaagttctgctataaaatataagaaaagccattcactacactaaaattattgtccctaaatctgaatctgaaaggaatcacaatggattttggtggatatacatataaatacattttcttcaatctttaagacaaaaaaaaatcacaaaaagatggtggggttgaatatataggttttataggctaaatatcacaagcaaaaattgatgagaatgtactggctccaatataaattagcagcaattacaccagacaatttttagactctattatcttaaaggcattcagatcttaccaagtccacaagccatctacttggatataacagctcccgagaggctgcctagcagccacaaggatgctgtagactaactaggttagtaccttccactttcaatacttcgtcaaaacagtttaagatgacagatgggacaaggaatttaggaatcctgtaatggatgtgagattggagagtgtctacagccaagacatgggtttatgataaaagcagattaaagaggatactattgtgactagatgggggatttaggtcatgctgtaaaactcttcagatggtatagagctatatgttaggtcagtgcagaggctgagggtggtgggaatgggtctgtaaaggaactgataaaagtttgggactgaaaagattttaaaaagacagagatcttggaagagctatatgttatatcaaaagctattgtgtgcctgtgcatatgcatgtgtacgtgtgtgtgcaccttgcacacataacctgctgcttactactcagcccccttgtgtcttctccccttccagagtaggccatatacctatgaacgttttaacgctcatgtataaaatctataaagaaaagaaaaaagcaaattactacatttttacctccacagtggaatctgagacactgttatgtcacacaaattcacttttttttttttttttgacagaatctcactctatcacccaggctggagtgcagtggcatgatcttggctcactacaacctctgtctcctggttaatctgattctcctgcctcagcctcccaagtagctggggttatatgcacctgccaccatacccagctaatttttttattttttagtggagacgggtttcatcatgttggccagtctagtctcaaactcctgctctcaggcaatcagcccaccttggcctcccaaagtgctgggcttacgggtgtgagccacggtgcccagcccaagttcactttttctacaagtgacatgtgaggcctattctgtatctagtcattcgtcctcatttctctctgtattccacagtttcttcttcctatcaaatttaaaattaacaatttgtttctctgatggagcatattctctgtcaattcaagtacttctgctctgctttccccaggagcttctaagagcacaagtgactgctttaccattgaattcatctcactgtaaaggagtatttgtcacaataagcctcttattttcaaacctgaaataaatacaaaaatatatagaaaaaatagaaaattatttttctacaaaatagaagtagtacatacattgacattaaaactttttcctactgaaactattgtggccaagatgaataatgtagtaagctggacctcaaatgcccatctattgaaaggcttgtgtgaattcaacacagattttggaaggaattttgaccttttatagatgctttcttagagaggaagttatatagccttttttcagagttttgtcattttttaatcttttattatttttaaaaatgtttgtgggttggtgtcctttgtcttcttttctgtatgtttccacaaaggcttagagacccatctcccactcaacagtctgcaagaagtagcttcaataaacatcacaggatagcaactttccagggagaataagaaaatctaatcattcatttattagttcatttaccataaatttttgtgcacctactatatcccaggaagtaccctaagcacaagtatgttagctctgaacagacatgatccctatcctcaggaaactggtacaacagagcagaagtcagacaataaatgaataagaaaataatatatacataaacatataccttataatatgtgttacgaagaaaataagttgagcagtgatggaaaatagctatcagagaattatgggaagaggatggcttgaatatatccctgaacccttgctgcttgctgtatctgagccaatcagctgctaaggcctcctgccctgctgaactattgaaagaaagagctaaggcaagaatttttacttcatgagccaaggaagaggcagggaccagttaggggaggtccaaggtgaggccccagtgcatgtgttagattctgagaaaagcctggcctgaggggtatatgagctaaacctgcctgtgagaatggtccttgccaggtgaacacgtcttctcaggctttgagtagcttccaggtaaaggaaaaattttttaatgaaaaaacaaaaataaaataagcaataaaagaaatgattgtcaaagataactccaagaggattaaaagaaacaaacagacacaaatgaaaaaaaaggtaaaaaacatgaaagaacaagtcaagactaagaaaatatatttaaaaaacaaataaataatccagaagaaaaataggtaaaagataacatcagatatttcattgaggaaaaaattataatgtcaataaatatatcaaacgttaaagctcactagcaacttctgaaatattaataaaggaggttgattgaaattaattaatttttaaaaaccaaggtactagtgaagatgtgaaaagataagacttatatacattactgactgaagtataaattagtaccactgcaaaggagagtatcttcaaaacacctggtgaatttgaacaggcttatgagctatgactcagcagttttagtagatgaatcccctagagtagctcccacacatttccataaggagttatgggccaggatgctcaggtcagctccctttgtaaaggtgaaacatagcaacaacataattatttttagtaagaaaacagataaatagtattggctgaaaaatactatactagccatatgatttttaaaaagcaaattgctaaaaataagagtattaaagtatttaaagttgtaaaacgtatattaatgtaaaaaatgcatttatatacaatctttaagtctagaaaatagcattacatatattgtttatatagatatccatattttatgaaatataaaattatgtggagatgtaatatacaccaacttcagcaaaatgattgcatttgagaaggaagggagggcaaaataatagaagaagctttagctgatatctaatatttgattcttggagagagagaacactgatgcaaagatgtcaacacgaacatctttgtgttcatggaagtggacatcctttgtaatattatttttgtatttcataaaatcaaaatcacaatggaagattcacaaatgagcatatctcctaacaagaactaaaacagcagtttgtcaaggagagaggcaggttgagggtgtcctatgtcacagaagtgcatatgtatagagtagctgttggtgtgctttgagatcaggtgtggagcagttcagatgtaactatttaccagatgtgaattttttaaaagagttatttctccttttaaagattcattattttcattaataaagtggaatctacttcacagtactgtgatgcaatgtactaatattgcctatataaaacaattgtcactatgcctagaataaatattccataaatgttgatggacacatagtttattcattcatctagatattattaaaatttcaggaataaaaacataattagcataaagatattatgagggtaaatggtactttaatagtgagaattagttgaacatacactagtctccaactaccttacataattaacctgataccctccaaataaccatgcagtggtgactccatcattctatgtaaggagaccgagactccaagaggctcagtgctttgcctaaatctgaggtccagattaaagtccatatctgactgctgcactctttcacttttagtgatattcacactggacttgcagaggatatgacagcttaaaaacatttgagaaccataattctacactacatgctctttatgaatactagtagatgttttctaaggttcagaggaaggcctgtacaattggccaatctataactttgataccagtgtaatatatcaattatatactacaagtaaaattttaaaaagaacaaaattgtttaaccttaagcttatgatttaatttttttgatgtgtattatagaatttgatatagataaagtagttaatcagatgtataaagaaaataatacaggttgagtatcctgtagccaaaatgcttgggaccagaagtgttttgaattttttgatttttttcaaactttggaatatttgatatacataaagggatatcttgggtttgggacccaaatctaaacacaagattcatttatatttcatagagtacttatacacatgacctgaagataattttatacaatattttttaaaatttttgtatgaagcaaagtttgtgtatgttgaactatcagaaagcagaggtgtcactgtctcagccacctatgtggacaacctgtagttgtttggcatcaccatcattcctgactctgaatttatatgctaatgataagcaatcattttcttgcagttactcacacataagtattagcagtaagaaatatgacataccattactacagtgaaaaattaatgtggcagaggtggaattttccacttgtggcgtcatgtctgtgctcaaacagtttcaagttttgaagcatttcagattttggatttttgtgttagtgatgctcagcctatacaaaaatgactcttatgcttgaaaatcttagtccgtctcttctggtttttaagtcatccaggaagtttatatgtggtggaaaatgcaactggccatgtcccagggcagacacctcctccagtgctcacagtggaggccactgaagtgttatgaccatgttctgtcagtgatgtgtacctttctttgggctcacaatggcatagaaagatgtaaccaaagtctagggaattgggtcctaattagagaactgccagtaaccaggagtaggaccataacacctgggactctgagcttcacctctccaggctccagtttcctcatctatgtaaatgaaaacattgaacaagaacaatacagcagttatcaggtctgttttgactcctacagtcctttattcacttgaaattttaagcaaatgttaaatatgtaaacctgagcctgagatgggactttgagtactctccccaaatcctcagagacatttcaagaagcactttggaacaactcagagaaatctttgtaaaaattagtggacaagatgaactctaagattaaattaattaaggagaaaattgagggtcccataatatgatcaccaggtttgaatcccagatcttccagttactagtcagtctgaatattgactaaattacttaactactctacaagcagtttactaaccttacaggattattgtgaatattaattaagataattcatgtgaagcacttagaaaagaatctagaacataaagaagaaatcaataaagtgatctgtgatcaatttaccatcaccatcatcatcatcatcattgttatataaatgtgatcaaatacatgagaaaaacctaacacttgtctggcacaagggagctgtgtataggtatatgtgtgtgtgtgagcctgtgactaattttttagcctccgtcatttttcctactttcctgtcaagatatctactctctatcaggcactagaaatataaaatgtgattagtttagattaaaagatactgaggaatgaagtaccaatctcagaacacggtgacgaaaaatattttctgcagattaaaatgaatattgaactaatagcatttttgttagaaactttctttcatccccagaagtttagtattcccttttctggacattttagtggttgaatcattcctggcttcgcaggatgtgaaatgttcattaaaagaagcatcatggttactgccttgtaaagatgatcctaacagcttagttctttgtgaactatttgtgtgttggcttgccgtgactttgcacaagttagccactgaagcagaaaaatcactgccggggttgtcaaatatcattggtgcaaggtgcctttctgtgtgcctggctgagcagcttccaatgacatgtgatgtggggttttctcccaaggctgttgcgtgctgtgtgcagcatatctaagctgaaaaactaatgcatggccgggtattcttggtaggcctccaggcatttcacattcatttataaaatgccttttttctacttcaaattaatcttatgttctttccaatcaccattgtaatactcttttgactttatattctgacaagcttgaaatagcctgataggattgaactaaagtataaaaaaccagagttacaacagtcagaaacaaatgaaaaactgaaaccgagtctgcagcgttaccttcacagctgtgttagtacacaattcgggccttttctagctttatgattctaaaatatgtctttgttttgaattaagttgctggcattatgtttgcagagcagttaatccatctccaaaatttgtaatagtcatggttattctgtgactttcattgcaaatggaacttcagtgtcaggtttatgggacagctattaaaaaagcagaaggagagttatcacaagtctcttatggaactcgttaacttatggtaattaatctaaataggacatttatttgaattctatctcaggaaaccaaatgaactttctcttcttgaatgtgcagtttaatgctcatttatgttaatattatatttctttaagttgttagtcacaatttgtgttgctgtctcatctattcatctaacaagcatgtatttggcacctcctgtatgtctgacttgtaattgagtgatgaataggactagttcctgtcctcagagagttcctagtctggtggaggggaagctttgcaggcaaagaatgagtaaggtgcatcaagcccagtggtgagtaacatacaccaggcagagggataacagaagagaatggcattaactcattctgggagttgaaggaacactttctgaagaaagtgatgtctcagctggatgaaaaggagtaaaatagtgacaatccatgatagaagctcaggtatagtaatttgttaaccaaaatattccaagtgaaagtaattgaaatagggcatctgaacaatttgcatggggctttatatttaacactttcctgctttcaactgttcattttttcctccctcttacagaaactccctgagatacacaaactgatattcctctgagttttcaagttggagaactggcccttagggtacactcagtgactattagttgaatgggataacacaaccaatatttattgagtgcctactgcctctctgtgccttaattctttatttgtaaaattagcataataaccaggcctctctcctatgattatggtaaggaaaaaatgagattaatatgttattaacatagactagcattggtctcaaaatcagggttatataagccagttattattactagtaactgctactggttattaattagttattattagtaactggctagttactagccagttattattactagtaattttctagataacaagaagttggtttaggggtgaagggaatcttccttacccccttcggaaggttcaataatttgagtctgtaaaacaaactgacaatagacaggttaacaggaaacaggcatacaaaacgatactagtaataataattagtagagacatgccacgcactgttttaggcactgaacgtcagcagagcaaaggctggctttcatgcagtttaaaccgtgtggccagagcggagtggctgaggaagggagtaaataaaaagaaacgaagttgaaagacttgctggaggagggaaaggcacagattacagagggatttataagccatggtgagacttcaaaattttaagccaagaaggaacctgatctaacttaggttttaaaagaattacttatgcactctgaatagattggaggagcgcaaacatggagagaacagaagaatcagaaggttattcagatcacagtggctttgggcctgtgtgtgtgtgtgtgtgtgtgtgtgtgtgtgtgtgtgtgtatgtgtgtgtgtgtgagggggcagagagaagtggtcaaaatctggatatattttggaggtttactaggcagaattcactaatggagtagatatgtggcattcaacaaagagaggttccagaattttggcctaagcagaaaaatagaagcttccatttcttgagatgggagaagatttatgaggaagaaaactggcttcaagaatgaaaatttccattttagacatgttaataataaatcagtgaatataatatggtattgcaaaagaccaaggaattaacctgggttaggaaagatggatagagataaaagagaaaagaatgtgagaaagatgttactatggcttcaagatccaaggtgagaaatgggagacaataaggctcataaaagagaaatctgtttggatctgaatcagaaagatcacacagtatagtaatgagaattaaaactgcacagaaacaatcagggtttagaaggctaaagtggacaatttgaactcatttactagtagcttggcaacagttaaaattttcaaaacaagctgatttgagctaagtctcttagcattcaccacattatactgagttatctatttctgtgttttgctatcccaccaaactgtaaattctgctgtgttttattcatcattttactgcctctgcctagcatggtacctggtacatgcttgccactcagtaatcacttgtggaagtcaactgaaaaaaaaaaaaagaaaagaaaaaaaaaaaggcttgtgcccaaacaaggacacaaattgaaataacaggctccattggttcaaattcaaactattcccttatgcaaaggattcaagtttgctgagaccccagatccaaggccctatatctgtcttaatatgataacaaggggtaacactcacctcacatatcccaaaaataattttcagtatcctgctactacctcattttgtctcataccagaattgagagcaaacactcaatgtttctttatctcttgcgtttaatttgctaaactccaaatcaaattgaaccctggtctatttgaagaaaatacactgtagtagtttctcctcccctgtgcaggttcatttatctgtaccctaattcactcaaaactcagaggaaaaacacatctgtattgaaacatttttgtggcattgattgctccccatgtgattattccaacaacaactatgtaacaacgtgagggtgaaaataatctctgtagcttgttttgtgtgggctaacaccctagtgagatggaaaaatagcctaaaactatgtctactttttcctgagacttgtcttttcaataagagcttatttactatacctcctgcttgcttttagtcagtaatatgttttgaagatagaacaaatgatcttttctacttgaaaacacaatttatttttattgtagtaaaactatcccattaaaaagtttttaagatgtggagaatagatctcattgtaagttggtacagcctgttcaaattttgatacaataaatcaaactgaaggtgttgaaggtgtaggatagcaaacttttttctccagtcccacttaacagccaaaactacatcactccaatatatctgcctccatttggtttcttgctctttcgtatcttccctcaattattatggtatctcaaaacacctctcacactttcctgttttgcccatccagccaatactccctcattcctgaagaattcgccccatcagagacccataagcagtgctggggttcatgtacatcataattttctagataataagttggtttaggagtgaagggaatttttcttaccccttctgaaggttagataatttgagcctataaaccaaacagacagattcacaggaaaaagcatacaaatttattacatgcacgtgcacagggagctacacaaaatacaggactcaaagaagggcctaaggtttttatatgatacagaaagaaaaagaggcctgaagctcctggaggctgtggtgacaggttatggaagggtaaggggaagaatgcactgtgaacaaaggctgttgtttcattgtgcagagaaggtctatcaggtaatagccctcaaaaagagtagatggtaacctgtggtaatagtttctctgtcagacctttaaaagtgtcaaacctgtctttagtcttcttttcctgtgagttaatctttcctagattcaaataaaaggacctcagagaaaccgtctgcctgcatcccttgtttgctttattaatatatacatgtaaatttattttacaaaaggataaattttcagagccatgctttgtgtctgcagaccctctgaatagccatctcaaaatatgccaaagaggcacgctttggatggcatattttggtttcccacagtcccctctttgaaatttattttcagaaagttttacatattaaaataggattgataactgtggaaaatttgctttagacattttgagataagacattagcaaagggaagaaaaacatatattggaataagtagaaaaatgtctcattttaggaagtggtgttgcagggttcccacagttaagtctctacatggtgtaagcaaacaagtttttaatatgaggcttctctaaagaaacaaaagaaagacaaaagttaataattgaagcagcatataaactagttctgagtctagcagttgaaaagatttctagatttggcctcaaaacatcttcagttgaagtgtggatagacagtgacaatctgacagattttaagttgttattgtgatttatctggagtcaaccagcttcagctttcagggcttcaagaaaaaggcacatttaatttcagtgattccaagtcagaaaaaaattggagaaaaaagtgaaaatgttattttggagagttgcagtcagacattagaggaaactaacaatttcagaatccagtctaaattgtaggtaaataataaaatctcaaaaaaatgaacagagctagaatctaataacagatacactgtagttttcttttaagtcataatttttctctctcgagttcccccctttttaccaaagttaatcacaataaaactaatttgtttgcaaaataagttttaggcttgttatactttgcctaataatttacagaagtacagcaaaatgatgattaatcatataagctcattttcaattttgctttgctggaacttttcacaaggaatctcagattaaacttttgaaagcctcttgaggctgggaagccaatccaaggaggagtcaccctcaaattgtgcctgtaatacctttaaacttgagtgaatacttctcttctcaaggttcccaaaaatatattcaggttccagggcctctcaggaagtgacattttttctcacctgtaaatcaaccatgttaattatttatccaagatatcaagatagattttccaaggggttttaattggctttataaagtcaactttaattccttagagcaatctggtcatatctcagaataggacatgtcaggcaaagccttggtaatatggccaatgtttccaattgtgtcctattagaaagagaatagattcttcttaaatgtaagcaaataactatattgttattgaaataagaatactcacaaatagtctccaaactctggagggatcaggtagggagaaaaaaaaatttcaattctgcacacaaaagtacaccttcccatattcccgtaaactgtagatagctgaaagaaaaaaaaaattaatgtggaaaatgaaacatgaaagaataagccatgtgccaaacaaaaaagtcataaaatcataatctttcattgctttagtcccatgtaataattcttattctgcttgatgttgggttagtagttttttgagttcagttttttcactgaagttcggaattcttacccagtcaaatactacgatctcaaaatcatcagaaaactatattcaatggtacttgtgagagtcttttctataaatttcattgaagaaaagcaatttggggctataactgactgcaagatgcttttagagaagaagcaaaaccactgtctgtcaatgacaaaaacttacaatagccatggttaaaaacctaatgagaattcataacaagtcattgacaaggaaatgtgttgtggcacacaacgctttaacataataaccataattattactgataatgtacactaggatataaatttctagaaatttcatacaattttggaatacatgtgaataacatatctataaaattataactcaaagaaggttaaacatacatgtgaataacacatgtataaaattgtaactcaaagaaggttaaacatcacttgctatttggagtgcttcccatataacttagcgtattaaataggcctaacttgtttaatatctctcttttgtactgctaggggtccttctggaatgcccaaaagttagtctgaggtcaaaaagacttaattttgatttggagaaggttgttaaaaaataaaggttcgaagcattcgatcaaaaataagatcacaggttactgttaaattcatttaaccagaatggcaatttaaagacttcaaaataaaatgcaggaagttacataattatagaaacagtttaattctttaacccagtttttctaagtaatcaaagacctaataaagacagtataaagcataggaaattattttgataaaatgcaaaatctatcaatactcttgtttttaaaagagaagaccaaagtttagttttttaccagtgcactttttctattaaagctcatttctgaaacctttataataattttattcaactttagtcagtttaaccttacaatattttctctcactctctttacccaactctcttgaactgtcattcagctttttatgtatcatttcttcattctgaaacaacctttaaactagaataattatttttcttcaacaacaaaaaatccttatgccttccttataactttcctcaccaaaaacacatcctagtttccttctacacttacatacagaattttttatcttatttctagtagttttaattacatatattaattagaatttcaattcttagtaatcttattttccagtgaaaatctaggaagtaaacaatcttgaactggcattgtaccaacatgttatcaatagatttcataatttctagaaacaaaagctttctcataaagtaattttacaatgtggatcaggacatatttaccagccaaaccaaatatatttagttctcttgtaacaagaagttaaaagtaaataagctaaaatgtatgattaacaattaatgttccagtattatatcttatttggaaatgatctaattatttaaagaatattcattatctaatttagtttagcaatactttaagggtgtagttacctgaaagatttgagaaacctttgaaagtatatattataaatcataattattgttaaaaattaaatttataaagttttatctcacttacatctatttaattactttaaaaccaacagcattaagctagtcctatttgtgaaagatttacccaagtcacatgaacttgaaaagcctttgagtttgttaccatatttctagcagttttaaaagtatttaattcataagaacaaatttttctttaagccaatttgaaattcttccaagaaattttatcccatgtagatacaacttgcaccatacatgcacacatgtataaacatatacaaacatacagataggacacaaacaaaaatattatagtttttattgtaaaactttagacagatacaataatataaaactcaccaatttatgaagtattaaccaagttaacactacctgtttacaatggtcaaaaccctttatcaatattaatagaaaagacctttaagatttttcatttgttttaaatttttaaatagctttttttccctgagtatatagttccattttagcttaggagagaaggcaaagaaattcttattatgctctgagtatgaaccacagccctaaaacaaaggtatatctacaagaaactcaacagcaaaaataattctcatgacctaaattaataagccttttaatggctttaaccaagtgtctaaagttagagcaaaaagatacaggctgctgaaaatccaaagccactcccaaaagaaaggcagtcaaaaagaaagaaaagctttgcttgccaaaaatggggtacaacccatatttctgtccagccatatttgtgggtctctcaaccttttggtaggccacccatacatgagggcctaataacctgtgtgccctcagtagacaaaatgtttaaaaaagacaacagttggtaagacaaacaggaaaacaaaagccattcatgagagggaagaggatcattatcaaacgagtaccccaaaagtcaagagttatacaaattcaaaacaaataattcaaataaattcttataaactaattcttacaagtatttatctcctgagctaaagaaatgtactgaaaaaaatggaggtggattcagagaagggaagttttaaactttggagcccagagatccaaaaacttttctcatttaaaaggattttaactttgttctaaaactgatttttattattttaatattgccaaaggagtctttaagggtaacagttatatttacgtgtgtctcttcttttttttaatttgatcttttcatagatagcaatagttaagatgagagtttttctacatataaccaatttatttattacaaaagtgattcaaatcaataaaagacttcatttatagacctgttttcaccagcaactccaaatttgaaggaaaaagagacaaggagtgactcttgccactcttactcaactgggctctaaaggcagagatctgggaatactgaccttggtaaaaattcttacctttcttggctggcttttttgttagttgtcccagggtcccatttacagcctctaaactgagcagagtgacttgttctcctgcctgggctcaccaaaactgttagggacaaaggcaactttcctccctcttccttctgaagattcaataatttgtgtctataaaaccaactgacaagagacagattaacagggtaaaaacacatacaaatttattatatgcacatgagcatgagagtcacacaaaatatgagactcaaaaaagagcctgatggctgacgttttcatattgtacaggaaggatagagtcttggcggtcctgagggctgtggtggcaggttatgggaggatgaggggaagaaatgcactgtgaacaaaggctgttgtttcattgtacagataaagtctctcaggcaatagcccacagaaagaatagatcataacctgtagtgataatttctctgtcagacctttaaaagtgtcagacctttctttaattcccttttcctgtgatttaatctttcctaggtttagaaaaaagggacctcagaaaaagcctctccctgcaacttttgtttgctttattaatatagatagatgtaaatttcttttacaaaaggatagatttttcagagctatgcttgtgtctgcagcccctctgaatagccgtctcaaaatatgccaaagaggtacactctgaggtgatgtattttggtttcctgcattggtcaggtggaacaatataccagctagcagggatcttttgatctcctgagagacactttgctaagtgtgattaatgctttaacagatgtagtccagaagatacgtttcttaacacttcctggggcagctgaggaatattacactgcagagatgttgtttagttgaaccttgaaggatgagacagagtttccccttgaaaggaggcattttaggtgaaataagcagtatgttaaaaggaacagaggaatgcaacaatatgacccatttggaggaaagaaactaggtgtgattggaaggaagaatcatgaaagatcagggtagatactggtggggcagctattaaaggagtttgagcaggggcatgacatcttcacattgaaagcaatatgggagtcgaattaaatttagtacccagttgagataaaagtccattgccatattcacagtgaggtgggacaaaagcagagtcagagagattaagaggctgggaaagattgaagtgatttttaggaatcagaatccacatcagttgatgacaagtacagaagggcacaatagcaagaagaagaagtaaatgataattcctagatgccattagtcacaatcaagtacggaagagacattattgactgaggttgaatcagggcagagaagataatatacctgattttggaagtgttgcatgtaagggggcttcgatttcagctacttacatacttgggaatctttacaaaagcaggaaggctgaagccacagatgtggatgtaattactaaaagtagaagaggtagagtgaaaagggacatgggatgaagcaaaagcaacatttgagactgtccaaagaatacaggtatattcccttactgcagtagtcaaagtccacaagaccctgaataggcctagtccgtcttaactagtctgagggctatcagccatacatccggtacataagcatatattccttggtttaaataattaaaataatatattgtcatcctctaagatgcatgagactgccagaatgacctgttagccagaggtcattgatatcatctatccacaagagattaaacctctgaggtattagaaagcagtttttggagggcctatagaaacacatgtttcccttttcttatgactccctatagcagctggtatcactataaaatactgtgtaatctttgaaagtccctctagaaaaaccaacacgctcacaaactaaagctaagattttgtcaaatgaggccttacccagctttattcaagaaataagcagtcctattgacctctggaaaatgacctatttgtcttctcctccaaggaatagtagtaaaactataacaactgtacatttatatttaataatgatagaaaatttaaactttcaagtatcctgcttagagatggaaagccaggactcccaaagcaacactgcttgttcctaactagggaaaagcttagtttcttcgccttctttagtgtgaaacaagagcccatttcgggtgtgtgcatgtgagcatgcatattactcacacatacacatttacctgaaatctaccagacattgcatggtcttttaaaaacttgttttgttctcctgaaatgttttctattttgttttctcctagtctctctgggcttatgttttatctcagccaccatttaatgagtttctatgctgttcaaaaccatagaagtttcacattcttcatttcattttatttttcaatatttatatgaatgagatgttaacatccacttttatacacgaatctccctctgcaaaaggctcaacaacttgcccaaagtaagtctttctgacactaaagccatcacttcttccacgacactgtcatctccaaatgagctggggagaaagtggcccctaataattctaagttaccttgaacctctttattccagaattcatcatctactaacaaaattttttgtatgtaaataataaaactagaaatgaaaaatctcaaagtattagcaacaagagcccaataagtatgaaacacccagcaacagaaactatttatattggctagatctaaatttgtctatgtcagttaatattatttatgttacctcatctcaaagggtatactagaatttcaagttataaagatgtggtttcaattaaatatattaaagtagttctcaaaacagttattttacagtgtccagttattcactaagaaaaaaacatttaatgttctggttagtggtgacttagtacgatgtttccatccttgggctcttggccccagtccaatcataaacatgttgtaccctgctgtggtacaacaggagaaaaccacgtgttagcagaggctcctatcaggacctttgaggaactgaatctctttgtgaataagcagctcctaagaaagatctgatctaagcataacatgatctgaaaatttttgcctctccacgtgccattttagaacctgtgaacagcacactacacagattggtagcagagcaacttcaactggtccaatgtatgagtatcgactttttatcctttagagctttactgctgccactcaagggcaaattgggaaataattccaaaaaatgcagccaatggtaattttctacattgtaagcacaggaaaggaggaaataaaagaaaagataaataggttaccttagtgctatccttagtaactctgttcaatcttggcaatgacaaacctatataaactttaactaaataaaggcaatgcagccagaaggtgaattttgctacttggcttacagtcctgatcctgagaaaactgttaattcccctgatgtcactaaatactccctacaattaattactccctcaactaatacattgagaaatgtattaattcaaaaaatccattttccacataaaagagaagctttagcacaataacgttttgtctaaacattatttattcattgccactgagagttttaaaacaatgcaatttggaataaacatatgcctggttaatgttatcctttagagagaaataaaaattaataatttaaaaccacatagttgtaaggcatctggtttgatagaaatgtactcttgaggtagaacagtgaacaattactcaaaaatcagaaatattggaggaatcacaacttctcagatggttaaagtagtctatctgtaaatacaaagtagggtttttaatccttaaatagcttgtcatttctaacaatgtgaagaatatattgataaatatctttaaaagaatgagttttttttttaacttctgtgtctgtgttaaaaacaaacactggtatactttgaaataaattgtcagtaatgtactgtgtgattttataaaaatagcatagacactaattcctaattatgacagtgactggcttactggattcaattggagattaatctagttcacatttttcaaagcacagcactaatactctgtactcctaatccggatcctctaaattagaatcccaggggaagcatttccattcaacattccaggtaatcgtaggcatgctaaagctttagaatcacagtaaacatattttgccatagaaatttctgaagatttgtcaaattatttaacacttgattaaataattgtacatgttctttgaactttaaagtaatagagtaatatattattcatacgttatatataagcatattcaaaaatagatgtatgttaaataataataacgaacatttggagtgcttctttggaggtattgttttaaggaggagttcgttaatattattttgttgagtactcacagcaactgtacgaagtattatgtttatcgcccattttatgatgaggaaaagaggtaactaatttgaataaattgcctgaggtcacacacctagcaagtggcagagccaactttggactcatgcaatctagctcccaaacctcgtcttaaccaccaggtcatactatatcttaaaggtttttcagtgaaaactggtctgctaagaagtcataataataggaaatgcttttaacacattattagttgaacaagaggaaccaaggtaaggaggagagaggagaggaaggaaaagaaggaaaggaggaggaggagagaaaggatcttacaaaacaatatagacacaactgttttgcagtgaaaatatacatagaaaaaaaagactaaaaaggtataaaccaaaatacttattatcagatgatggggtggcagtaatttactgtgttttctctattttccaaattccctataataagagaatgaatgatcatgtattgctcttatagtcagaaaacaataaatgagtcattttacaggctgattacatatgtcttagttgacctgtttcgtaaatataggaattgatttagatttttaattatacttattacttagctacctttagaacacataaatgtataataactgttttttaaaaactttgaagaatggtttaatccttatatgtaaattctatatttttatattatgtttaggtgctctgtgaagaaaaaaatgcaaaccacattgtggctttaaaataagtatgttatttctacctcactgcaatggaaaacattccaatcttattttgttctccaatattatatacataatgaaataaataagattatttatcaatacattttattttacatttgttttattattctgatcagaatttattttgttagaattcagaaaaactgtaccttaaaatgtaaggtaagaacagatatttgcacactggcgttcatagtaccactattcacaagcatcattcacaagccaaataattcatagcactattcacaagtaccacttatcagtggataagtgaataaacaaaatgtggtataaccgtacaatggaatatttttcagacttaaaaaggaacaaatttctgacacatgttacaaaatggatgaaccttggagacattatgctaagtgaaataatccagtcacaaaagaacaaatattgtatgatttcacttatatgaagtgactagagttgtcaaattcatagagacagaaagtagagtgctgaaggaagggaagaatggagagtcagagtatacaaggtacaaagttttagagaaggtgaaaagttctgaagatggagagtggtgttggttgtacaatgtgaatgtagttaatggcaaagaactgtccacttaaaatggttaaaatagtcaagtttgtgttatatataaatttcctcaataaataagcttggtgtggtggcttatacatgtaatcttagcactttgcaaagttgaggtgtagaaaccacttgagaagagcctgggcaacatggcaaaaccccatctctacaaaaagtaaaaaaattagccaggcatggtgatgcatgcctgtagtcccagctactcgagggctgaggccagaggatcacttgagcctgacaggtcgaggctgcaatgagctatgatcatgccactgcattccagcctaggtgacagagtgaaacacttcctcaaataataagtaaaattgaaataaattaattaataaaataaaagatattaaatagtatttttcatttgttattgcgttcaagacagatcacattctcaaaatcttaaaattacctattcataagggttgtactcctaaagatgctttaatagacatcttttttagaaaccttgcatttatcgcctcctaattggtctttgatcataatatatccctgcttattgaactcctcctgtgggtatcattcacattataaataaaatccaaattctgcaaaaaatgctttataatattgatttctgtgcatagaaatatacctacacatatgtcccctctccctctctttccttctctctctctctctttctctctctctctctctctgtccttcctacagctgcacaggcttcttgctgttcctggtacataccaactttttaactttgacaaagacatgacactcaatacttccacccctggaaagcttcccctagacttctgttgttccttttcagcaaggtcattcctaagggccccatccaaaacagtgctgcttctaagatgcagccactctacgctttagccttctctctgtgtttcctccttagcacttcaataactaaaatgctgtatggttcacttgtgtgttttctttctttctgtagtggaatgtgagcaccaggacagcacacatctcaactgtcttgttaccactgtatctccagtgtcacagcacttagcacagtgcctggtacaaagtaaatactcagcaaatactgcgtgtgcaactgtttgtataaacatattcgaaatacctcattggctgtcattgatatttgtggtatagataaaatgagattgaggtttgcagtagtaaggatgagccatttctgaatcaacaaattttaagtaggtggtcatttgttctctgagataatatcctgattttaggtaatagaatttcataaaatggacccaacttttttctccactgagaaataatttgaatatgagcatttgtcatgtattttcttaaatgctttacattcattgtagcatttcatcctcacaacactataaggtaaatattattattgccattttacagatacagaaactgaggtacacagagccatttaccccaggtcaagtaagtattcaaattggatttcattattagcaatgattcccaagctaatgcctttaagcagtattgactgtggctttccctaaacacagataagttttacttatcgtggcaattttttattacctattacatttaaaatgtgtgctcattcaaaaaagtgaagacatgaatattcaaataagaaaataatataaaaatcatccctaatcctttaattagacattaccacttttaaaataaattttccttatctttgggctttgcatagacaacttaaaataaataaaagtgaaagaggaatgaaaatagtgaaccagtaaaattccagaataagcaaagtcctaaaagatatttttttcatttaacatgttaaatgtttttttcaattgtatccattcatcttttactttatgatatggaatgaggagtgaaagtttccttactaaaaattttttttaaaaaactgacctggcagatagtaggtatattcttttatgtaagtaaatatgaaattatttaaagggtattcaaaaagttttaattgaataatatagcataatatttattccataaaataaaaatattttaagtagttataatattagattcatagtggcttctaatatttttagggaaataagaatgatgtgacctcttagtgtccaactcaacttccctggttaaactgtatctgtgataattaaccatattttgaacagatttactctgagcaggcatttttcatatgtgtgaaaatgagccataagagcttcaacagataatgccagaggatggggctctcttaagaatatgtacttacccacaccagcagtgcaaccttacccttgggtctgtaaatttcacttgatagatattccacatgcatactgtaagaacataaggcaggaaatatagaaaaattgaatgctcccacagtgacaaatagtaaaattatactaaaaatagctgcacagggattgttttacagtattattatatgctgttgtcactggaaaatagtgtttttcttgcaatacattgcaatgttatatgatatgttattataaaaaaattatgttgacatcattcaatggagtcaatttttttttttttgtaatttggtctactctatcagacaacactcatctcaatgtgtccttcaaaatacagagttcttttttcaaatttaatagagatttagtgaaaactgtagaaagtatataaataaggatttctgttgcttacaaaactgaataaaagatcatacctctctttagggaacttacaaattaggagggagagggatttttaaaaacacagtacatgatatatatatacaatacatatatagcatgttccctaatcgctacaaaatcctaaggcaatttagagaaaaaagtgaccataaaaattatgattaggaaataatggggagatgcataagtcctgatgtttcatcaggataatggctttaatttggatcctgaagtattagtaggctattaataggcaaggatctctttattccttacacacatattaatttagcatcatactatgaacttgtccaagggctagacagatcaattgaacagcactaagtaaaccctactctaaaggcttctggtaaacgaatactagataaattaggtaagttcagatactgataaattctattacaataataagataggataatagcaagttgcttgaaagagtaagttgcaagcaaacttgaaagttgtttgaaagaggagagaatggggcctttttgtgaggtagggctttctggaaacacagtatctgaataaatattaaaagccaatctcaaatagagcatttcagaaaaaggaaatagatttattagagattccgagattgaaacaatattggtcatgagttcaagaaacaataactagaacaaaacggcggtgggacagaatgaggtcagattagagaggtagacacagatcatactgtgcaggatcaaggagatattcaagacagaaagaacagctagagccaaaatacaattcaaaacacatagagcacaatggttgaacataggtggctattgggatcaaatggcttggcttcaaattctagctcttccacctcctgtttgtttagcgttgaccacattatctattttttcgagcttcagccttctcatttttaatgcaaaaataatgatgatgcccagcttcccatgtgtgatgagtacttcttggtatgatgcatgtacagggcttagcaacgtgtccagcactaacaaagtaaccattctagagtattttgaagaacagaattgagtccagtttaattgttacatataaggaagagtaatggaaaatgagtctacaaataaaacaggaactagagttaagcagaatatgaaacatcagactatttcataatcaggagaaaatccttgcactcctttaagcagggaagtgatgtgtcagcagtaaactttgggtagattaatatagcaattgttgacaaagtattttggatattggagataagaaaataagcagtttggccgggcgtggtggctcacgcctgtaatcccagcactttggtaggccgaggcagacagatcaggaggtcaggagatcgagaccatcctggctaacacggtgaaaccccgtctctactaaaaatacaaaaaattagctgggcctggtggcgggcgcctgtagtcccagctactcgggaggctgaggcaggagaatggcatgaacccgggaggcggagcttgcagtgagcctagattgcgccactgcactccagcctgggcaacagagctagactccgtctcaagaaaagaaaaaaaaaaaaaaggcaatttaatttgttctaagatagagaccaaagagaaggactggattgaagacattgtagaggttaacttggcaggactttgtgactaaatgaatgagtacaatctcaggagcctgagagaatatataattgaaatacagacggtggggaaggaaccagtttgagtcagaagaaattgagtgaactgtagacctgctgctctgagattcctgcagctatccagcaagcagttggaaatgcaaaagtaaactaaggggaaaagtactggctggaaatgtaggctaacattcagattttagctgcagctttcagattgccggttggattgtcaagagaaaagaatgaagataaaagagcagaatactaaggatataaccctaaggtccaagtatagttcactaacaagactagaagaatgagtttatgaatgagataggcgagtgatccacatggtcaaaggaaagccagaagaacagggatcatattctacatgtcaattgctggatataaatgatacctaaataatgaatttaaacattttaactcagatattcagtttatggcatggcaaacaactgatttaaaaattgtttataatgctttttttttttttgctcataatgaaaatgatgtaaaaattcctgaactctgtgtgtttttcctgtatatatctaatttacttacaaaactctcatagggaacttttttttaatgttccatttttaaagcctagaataacttcctaaggaaagtgtgaaatattcagacccataatagcttcctagaaagtagttcttactttccatatgaaaaaaaaaaaattctttgacataatagctaaaggtgatgaaattgtttcttctttaaatgactctagtcttatggtggcatttagaaatgcatcttaagtgaggggttatcacaaagtcttttttatctgctagtttttcctctactttacctttaatcatagtaggaacaaagtataaacaaaatcagcaaatataaataaaaattgtatacattgttctattttatttgttatccaacatatgtctcactttgcattgtgtagaccagaattcgggttcatagaaaaaattctttcttcaaatgagcatgcttatctatataaataaaattataaatggaattaagaaataataaaacttatgtaaggtatttaattactatgaccaactatatattaataaacttgcaaatatcagtgaaataaatatctcaaaagctagaaatgatcaaaattaactcaagacatttaaaacataaagagttcaataaaccaggaataaattttattttttatccaagaactttagggccagagagtttactaatgttattttgaaattcaagtaataacttgatatagtgtttgtataatataaagtgtaatggttatctattattgttcctgatgattacaaaatttgatcaacaatttgatcaacagcatgaaaaaatgtagtacaatgatgcaactattaacatagatgaatacaaaagtataaaatatataccaacaaggtatttccaataatacattaatgtattgatgacataagataggtttgttccagaagtttaaaaaatgttgtcaatgaatttgataaagtttaatattcacattaaaagtattaccgttaaaaccaaaatatagcatacttattctctccattattttggaataagaaaaaattattctttgcagagctcatgcttatatgcatagaataccccagagagttatctgaaaactgtcagacattattcttaaagactttagctacaagaatttagatacaatataaatagcctaaaaaccagtaacttgatgttgtatcactgatgactgcttacaagatggaaataatttattatcaattaagaaaaaagctaaaacatacccagaaacaatcctaacaaatctgtgggaactttaccaataaaactataaagcttcatttaaaaaacaaaaaactaaataaacagagagatgtactagatgggctactggatggaaacaaatattgtaaaaatataaattctaaatttagagatttaatgcaatcttcagcaaattactagaatattgttaagaacttaacataatcataaagtacatttggaacaatcaaagtagaaagacagctacaattaaatgacattacttttttttaatacaagaaaaaagagcaaagatgaagatatgcaccaagctgataacaatataatctcttgggggtggaattaaaagggtttgatggaggggtgaggctatttctttttttctatatttctttagtgggagtgatttttactttcttctgactgtatttttttaaaaagttgttaaagcaataaaagctgaaaatctagggaaatatttacatccaatataacaaatgtttaatatctttaatatgtaaacatatgtatcacttataataaaagtattctaatagaaaattttataaatattatcaggtaattggcactgaaaataagaaattaaaaattcaatataacaaaaacattttaaaaatagagaaagcttttttatctctgtaattttgtgatttaaatgttaagactgataaggatacagtgagagagaccctcccatgccccttggataggaatgcaaaaggggaaatgaaaatctctgattgctgaatcataatgcatttttactttccttctcatacatttgtggattttaaaaaattctataatactacacattatttctatattaaggaaaataaaaagtatttcaaattcaagaaagttatgttttatgtaaatgcagcaagctagaacttttaaatatagtacttctttaaaacactgctttttaaaatttatttatgagtactgaacatggttatggtctcaatttctctccccagtaagttcatgcctaacattttagtccttgaaatggaaatacacaatgtcttctcataaggatagtagatggtatatatagtaataactatcataacattagtaacgttgcgggaacttttccttagttcagctaaagatgggtgtccacaagaaattaggcttgcagacaatttgaagcatgaggagggcagggttcaaggaaaagagggaaaacagggactctccacaaggccaggggccctgctagggtgcttccagcctggcagattgaatcccaggttctactcaggaagaggagggccaggctcctccctgctgcaaacagcacaaacttttatggctccaacccagtgcgcactcctcccaatgttcaggccagttggaggctctgccagggagcccttcccacctgtctcagtaatagtcaaaatattgaactttatcatatgccggatactgtgttaagctcttcagaggcattagcccagttaatcatcaaaccctatgtgatggatgttactgctttcaccattttgtagataaaagaatcgagggtcagagaagttacatgaatgtccaggatggtgggacttggaggaggaatgccaacacctacgcccagctagatcacttatttatttgctatcttccctgagaggccatttaacttacttgagccaaaaggttctcaactcagctataaaatggaaataataatacttggcaatgttgtgaaacccaaatgatgtactatatgtgaacgcaccctgaatagcaaattctataaattcaaagcataatagagattaagtatttacagtttccttctttaaagtatctttcttattttaccacttatctttgccccaaactttaaaaattgtgatatttcataggagaaattatttttccttattgaatccaatatctgaagctttgtctacccagtgttgctagtcagtgttttattgcagactaacctattaatgacctctttaaaagtaaattccaaccacagaacctgtcttcctgtgtaagactttaggtgcagcaaatcatcatgcatctacagcaagttttccactctatattgctactgccaaagaatctcagatgagatatgagagaaaataaattagtctcatatgattcaaaatgtagtgaacactttgcaaacaagtattttttagcatcttaaataaattttggttgaattacgtctcatttacaatatcacatttcatcctaatttcagttgttttccatattgtctcctattgacttctactccatttctcaagaagagtaaaccttactttaatttatctccgaatagaagattgaaggaagaccctgctataagcatagcgtcctacacaaggaatagctagagatgtaggaaaatttttattgattggaaaaaaaaaagtgagctgacctccaatattttctgttaggttttctctgtaatatggcacaggaaaaaataaataataatttgaaaaaagaggcagctttttcatattgctatggagcaatttatgaataggacataagtccttttttcctcctaaaatagggactttatggggttttcatcttcttttttattagtggttggattatctgatcatttacattataagaaacacacgaaaatctagaaaacattttacattttgttacagatttacaaatagcatgttttcactttcattctaaaactaattattgatatcagaaatttgtatcttacctagatcattggttaacaagacagatttttaattcataaactttaattcttcatatggcagtctgattgaaccaatacattttttaaaaatttatagctaattgaagtataacatgaattaaacacacatagacttcaaaataaagcataaatagaagtgcatggaaagatgtaccgatgattggttcttaggaaattaataataaaggctaacatttgttgaactcttaccaagtacgacctgcagttataatatgcgttacttcttttaatattcacaataattttataattaagtaccattgctactttatagtcaaactattaagtgatttgcccaaggacatgccacaaaaaaagtgatgaagttggattatgcaggcactggtcgaactcaacaagcagtgttcctcacctctcacctacactctgggtaacatttatttttcaaaatcttaactatataaagtatagcaatgaaaaatgaaggatgttctaaatgtaaattgccctcacttaaaagcttaaaaagaaactagctacaatgaaaggagaattcgtatatgtcagcgtgatctagcgcagtatttgtaataaagctgaggtggggggcagtggaataaagaagggaaaatccctaggggaatatattagaattaaaaaggagcattttaatactatgcacacaccacctcccaactctagaatttcccaccagtttttctcctgccttacgtagcctttcaaatactctttctcttcctggaacaccctttctacctctccctcacttcagggctaagttctgcaagttgatctcttctagactatcagaacctttcaagcaaggaccatgagtttttttattcatcttaacataataataagttgtaataattataataaattataataagttataacaacttttaaaactatcacgatgcctcccacagactcaacactcaagaagtatttgttgaatagacaaatatgatatatttcaaagtatctcacagtttgcaacgcattttcttataatacctcattctattttcatgataagcccctatggtgagtatttaaataagaagaaacctgagacacagagaagctaagaaacttgtctagattcacaaatcctgcaaaaaaaaaaactgagactcaaactcatgcctttcagttctgcatccagtgttgtttccctcacagctcagacaagaaattggtcttctggtaaattataaggccttcctgtcatgtacctaatttcatgttctaaaaaattttactacaccgaagtgtttacattccacagaaattttttaacttttcatttcaacttaactgtttattgcagagcgcagtggtagtaaataatagatacaatctttgcccttgagagaacttaaagtttagttagaaaggatcaggaaaaaaaaaaaaacacaaagaactgcaattcaaagcaagaaagacatggtataagagagtcaacagttagttggacaaattttattaggtaattaatctatgcaccagccttaatacaatatgctagtacatgaggaatttaaaagaggggattgtggactcaaaagaaagagatactaacagactcatgggtatggtagaatctgagacaaaacttgaagaactggtttacttttagaagacaaatataaaggtagtcattctgagataataatgagacgttgagtaaaagctacgatgtggagacgtgtggggcatgttttggagagagccagtttagtaagagtgatacaaaaaaaagttctatttcttagaatataagagtgaaatattaggaccttaaatgccagactaaggaattcattcataatttgataagccatgtggagccattgagagttttgagcaggggaatgacattattggaggtggggtttataaagattgacctaccagtgaatacaggatgctgtaagaagctcaaagtagggacactagtcaagttttcaaagataaaaatgataaagtagcatcacttaattacaccattgtatctcagaaaatatttaggtgatctaaaataaacatattcttttagtttattccctcaaatagataaaatgagtttaagagagtccctgatgatgagtttttatactaaacaaaatgcttatttgggtgagagattgcaactcagtatggttaaattagatttgttatttcttagaactacattccctttggtacttgtagagaacttctatttctgatttaaaaagaacacaaggcatatggcaatttttcatagttattacaggtgacatctaaactggcagagtgcagacaaaggaaaggcatataaattagacaaataaaagtttctttagactcatacacaaacaccaacagaagtgtacaaagagataatgaacttgcctaggatcactgcaactgaatgaacaagcccagatatctatcaattccaaaatgtattcgacataaaagtcaagttatgttttttattgctgttttcaaaagcagccatttttaggatatttgtgtttctgatatgttaaccaaaatgttttatgtatggtgtccattttaatggtgtcaatactgagtatattgtgctaataatgaccataacaattggcatctctaaacaacatagaaggtcaacttcattgatttaacttgaagtttttagcaaataaaataggaaagtattttccttgatgctggctattgagtctggcacttactggcactgaataagcagttttttaatgataactatcttatactagagagatatgactttgaaactacgttgtattcgttgaccaaaaaaattcttagagttataaattctgtgaaatgatctagaaaaaattatattgtcaattgaattttggaaatttgtgtatttttttcttttggagatacatactgtgtagtagcatattaaagtctaacatgtgctacctaaaaataaaacctatttaactttctttaacccagtgctttccaaacttatttgaccatgaaattgattaatcttccttgaacatatattcagattccatgctgactttaggaaattttgccagagaacaaggaaagcagcattatataccagagaaatgtgaagttttaataaaagatctgctcaccactaatcccagttcccacaaaaactgctatagtgtcctgtaacctcacccaacacctcaacccaataggtgttcaaatttaacctaagtgtttacaggattttcatagtcctatctaattctgcctcaaaaatagaaaattatctctgattattttatctccccatctctgctgcctccatccgttcattcaaccaaggctttctatgttctgactccacaacaggaagcatgacatatgttgaaatgaactcatgagcagacctcatggtcctcaccttcactaaacaagcagggtagtagaagaaaaagacaaggaaagagcctgatatgtctttgctaaggaaaataccttgggttgtgggaactgccttggtggataaaggtagttctgtgaataaaccaaaatctgaaggatgagtaggtaagagggaaggaagagtttcaaacaaggtctttgtgtgggagagcacggctttatggggaaaaataagtgcagtaattcattccattcatgcagtacagagcctaagggaaaatattttttactgttggatttcccttgtcaggaaagcttagaaacactaagcaaaccctggtacatgtaggataatctggaggcagaatgagtggcatcacacctcttacaagctttacctttggctctttaatcaggtagctacaggtattgggaggtaagggggctgatgctcaattcctccaacccctaactcccatgtcttaagcccagagttgcaaagggtgacccacctacatcataactcctacagtgctttacctctggggttttatccaactttggagaaattccttcatgcagactctgggtcttgattgcaatcatatcttcaggccagagcacttctttattgagatagaacacagctctttgaagtatattcccaaaatacaatatatgttagaatacttctggccaggcctatattgatgtgtttacttcttgtcaaaatattcatttgtctttgaggagaagaccccccagattttgaaatcaatgtgtaagccatatagaagcaaaattagagtttctacaattgaaaatttcagcatttttcacataatctcaaaaataccaaactggcaacattccagtaaaatgaagattaaaatgttttaaaaaatgaaaaactggaatatgttagtatatgcaattattctacatttttgaaaggaaacattcacaggacaatgtgctcatttatcatcctgaccagacctctcccactcttttctctttaaagttgaaaatgctgcaattattctgttatgcctcataaaatagtaaattatctccaattactgtacagtcacagtagcagtaaaaagcttgtgtagaacaacatactccccatagtcatcttgaaatttattagaatatcataaaattataactcagaaaggagtttcaaaaacatgtctagtccatttttattacctctgggcaggactgagttgcacataattccaggaaactatctaaagagaagattcaacaattattcttgttagctagagggttcaatcacacttacatagtgagaaatatttttcctatatgatacatttcttaaatgtttcctcatgttcatatgcagctaaattctcaaaattcacttctaccacctcaacccaagtgaatggcatctgagcaatacataaacaacaaattttacccttatgaacttaggaaaaacctttcatttatttgccacaatattttcattttcatctgaaagacagcactacctagacaaatttttaacccccttaagtgaaatatcaaaaatagtgttttaagagcaggaggtaaccttgcctctgcacaaaaacatcttgttctttccacagaaaccataaagtaagcacagctttcaccactgatattgtagaatattaagtaatttttttaaattataattactaatttttgttgggaatcagggcaatgccagatatcctttgtaaaattttaacacagtcaactgttcctttattgctcagcatgccatccaggctccattccagggcatgcccttccacagtttagggttgctttgaatatttctacaggatttttcagacattagcctgtcaatcaaatatgcagtaagttctcataaaatttctcacttccccacaccctgaaagctataatgagcaaacagagtagattctaatgatgtgaacaagatagcatacaacctttgaacttagatatttgtttgatacctggttctgtcactaactagctggatgaccttggaattatcatttgtcttctctaaatttcaggtaccttgtcattaaaatgggaatcatgatggttgcctcataggttagagtaggattagttgagataattaatggaaaacaaataataggtggtaaagaaaactggccctcagcccatgtttgtagttactatggctgatatttttgttgttcttagtactactatgtctattgggagtgccagaggatgatggcccaaaaagcctaacgaagacatttaggattggtattagtgttcagtaggagaagtgcttggggttttacactggcagggatgtacacaatattcaatggaggaaaagataggtgaaaattaggaaggcaaagtatttcctgcacgtgttggtgaggtgttgacttaggatccacacaaatcaagcaaaacactctcttatttgtgtcttatttcataagtgaggaactcacagcatagggtattaatataacatgcccaacgtgggtgaactaaggattcaaacttcagatttcaaagtccaaagtgaatgctttgttcacttttaccaggcttgccctctgccatttacaagagcagtctttcccatattcttccctaagcagacaacaatttagcccttacctatattgaattctcatagtatgctatactcactttattataggataactatttgctgtattctgtcactttctgctaaattgtgagctctgggaggtcaaggagaattttccattcagctacatatctcagagcctacaccaaaatcctgagtttcacctctgaaggcctgagtaggcaagttgctcctctccccctccagtgaggagggcaagtaagattctatctgggctcctctgaaatccacgagcagctctccaaatagagaagcactgatgtagagattgttgggtaataaaattaatgaggaagccatggtacaaaattttaacacctttcttttctgaactaaagttaaattcttgagtgtaggcgttccttcttgaaagtcctgttactggagagattaatctaccagcaatatacaaagacagattagtgagagatggtggtcccaataaaatcatttataggctaattacattccttcttcactcagttttactacaattaaaatgtaaaaggtctgtttacatttttggtgcctcaatatgtattgagaaatacaatattgttaagcaggttttcactttgcatttctctgctttaatataatgaagtcattatccatgcggacccacaatgctccgtgttaaattcgccaactgctgttctgtacattccctcagccaatttatttcaatttcagaaggagcaaccaactccacagtggatgactgctgactgcagttccacaccatcactcttcaagagtaaactcaaatcaaggaaaaagcttccacatgtgagcatgggtgtgctcaatctcctgttagctgcagccacagtttcaggcctgatagaccccagcttctgcccatggggtgcagagctacagacagctcacctgcctctaccacaggacagatcacaggacaggctgtgtgtgtgtgtgtgtgtattacatcatatatatatatatatatatatatatatatatatatatatatatatatatataaaataaataggttgcatacagaagattttcaaaccaatcattaacacatgtaagagctaggtcatattatttatggcactgttggtggtagccagatatcataaatgcagtgtcataaatacttttgtatgaaattatataattcttagggtaacaccttaaaactcataatttgcagagttccagggttagagcctaaatgttcagaaattttccacaaatggctatcatcaatttaaaatagctatgtttaccaaataaatttgtactgagctagacacgtggattagcaaatctgtagcacagagccgagaaaggaaccccttggtccttttgacctccctgctcttgtctcttattttctctgtttgctgattccatcaaataatttgatctttttagagctgatctagcctgttgtttgacaagacccttttttcttgaactacattatcacttaacccattaccttgtacttgtgaacagcatattagaatgaatcattttgccatttaacatgtgtggttaaaaattattggttatgtattgaactccactaaaactatgattttaatatagaagctgatgtttcaagaaatcagcagtctctactgggttaggtttttcaaagtttgggttgtgcatgatcataaggttaaacatttttcaagtgtaacattaagaacaaatttttcatgtaatttggatagataagtcatttcattcaagtctatatacaattttcttgtgctaatcttgatgtaaaaactaatggtagactgtctttttctgcttttgttgtttaaaatgacagtaatcaagtttaccatctccaccatttaataaagcaaacagcactagtatagaaattagaaaggaaataaaaggagcatttagtgaatgtcagtgttgatctagtcaatcattgtacatgtgttagctcctctagtttccacaaagccaaaatgaagtcgttattatctgagttttacaggtgttaagaaattcaccaaatgtgccctggtagctctttaaatgttgtgttccacaggctccctatcctgagcactctaattttctatggtacataatttacctgggtgatctcatctctttacttggtttcaattgctacttatatactctgattactctcaaatccattattttccactgttacctttcttctcaacttcagatccagatatccaactgcctactaaacatctcttccttgtccctagacatataatccttcacttacccacttttgaattccctattctctatgtttcctgtggttgctggtaccatccagccaaagtaggaaagggctggtcgttttcttcttctccattacccctaatatattcctacaaattttatctcctctataatgtacaaaagcaactagagaatctgtgcctgtcctctccactctcactaacttcttattgtgtctatcatcatatcctgcctgaacttttaacaggtcctcctgccttcagttttagcctcctgaactttgtcctccatactactgctggagaagtcaatagtaaacaatgcaagtatgccattttgctttttaaaaacctttaatggttctccatttcctggagaaaacaggccaagcttcctaacaagtccctccttgatctggttcacgctttcttctataaaactttaccgctcttcagttttttgacccctgacttttttctccagacacacaactccttacatattttctcacataaggtgttttttttttagtcataacttttcttcagctgagaaggtccttcttatctaccctttcactttttctatctaactcctcctcaccctttaagattcagtaaatgtcactatcaccagaaatccttttctgacccagtcttacaaaaatttgtaagggtcttatattttggaatttgttaactaaatgtctagagagttgacgtgacagcaagaaagatattcttgtaaatgaactcaagaaacccaggactcactgaaacaaagaggaacatttcaaatcattttggaagattcctttacttcctgaattaattcataagttgttttttttttctaagctaaattacttaaatagctttattctccccttgagtaaggacagaagctaattaggcattctccaaggcacagatgggaaaaatatcatctcccttcctcttttcttaatccccagtatagccagatgtagtgaaggtcccagctgcctcctaaagacctgctgtggaacaacaggatccaagagactgagggagccaatcaagcttaacatttgcatgcgaaggcctcccagaagcaaggaattcagctccctggctccctatctgttctgctgcttgtgggcaatagcaccacacaaagaaatgggcctgtgcttaggaaaaaatatatatatatttacccaagtcagaatgttcgtatgcggcgatgagaacccaatcaattcaagaggacagagcaattaatttatatatcagttataaaaatacaaattgatataaacatgggaacaataagacactgtggactactagaagggggagagagaaagggaggcatggattgaaaaactacctattgggcactaggctcactacctaggtgtaatattcccatgtaacaaatctgcacccgtacctactgtatctaaaatcaaagttaaaatttaaaaaaaatatataaaaatgcaaaatttgagagggagagctgcttaaaacagcttcaaggatttttatctttcttgaatttctatttagcagtcaatgtttcacactcttagtatataagttatcaaaactaacacattttcagtaaaactggacttcaatgatgtaacttatgcaaagtatcctctaaaacatggtttttcccttatgtagatcagctgagtgaactgtaagcatcaaagaaatctatatgaaaatgtatgtttatcaaaaagttatatgatgtttcatgtgattaaattctaagaagatgttcctaaatgtctcattcttacagctgcaaagcagtgttgacatcatccgatccaaattccctgctttacagctgaaaatccaatgcatgtagcagttcagtgactttaatgatggcacagccagtgttagcctagaaacccaaggtgcctgaccttgaaggaagttcatatgtatacacatatttgtgtatgtatatatatctatatatatatatagatatatatacacacacacatttgtatatatatatacacacacacatattcgtgtacatatatacacacatatttgtatatgtatatatatgcatatgttcatacatctatcaccaatcacatacatatatgtaacctgaatatatatatccaggttaggaatctgtttgtcttccttcagattactcctaacccctgccttctgtcttccttctcctctggcaaacccattttccaatcacgagcatcccattgcccacttacacactgctcaccacccagaatgtagggactgagtcttactcccaagagactcacttcaagccacctccttcccagccattgctggacttggcatctgaatatgttttgttctgcaggagtagatagcctcatatactaatcaagggtgaaagttttctttgtctgtcaggtttcctctaacatcttatgaataatcttaaataaaatgtagggaaagctttcagtaacatcaaatagatctcaaaagaaaggcagactgctattcaacattgctagcctctctctgattctagaagcaaagcctctgaataaagggttcaattttacacttttgttctatccccactcaggacttgctaaccacaatcaccccctcaccccataacctgctcccatgcccatttcttagtgtgggtataaagtcaggccagagacagctaacgagcaatgagtcggctgcacttgcgtactgagccaccagaggtgctaatagacaggaaattttcttattagatgctttcaaaaaataaaattctggagcccaagtattgtctttaatgtcctaagggcagatcttgtatagagaactcaagccttgtatttgtttaaatatcaagaacctgtcaatgtattgaataatatacaaatagtagatgtaattcaatttgactagtgtttattaagttcctaatacaagatagcctgatatatacaaaaaagtgaaaagccctgcttctgtggtaaaggggaactaagaaaagctgaatttaaccacacagattaatgaaaatattctgctcttgtcattgctttcagcactttttgaagtagatgtcttctgtttatcatatttcctggcaagatttataagagtcttcaaattataaatctttagcacatcttgagtaaactctcatttcttcaaactcttcatcactcgtataattagaaataaaagactgtagaaaaatatgaaattcctttgaaagaagtcaataaagagattcatatttcaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaagagattcatatttcaaatgcacatgaacatttaactagttattaaaaatttccaataaattgagctattactaaactggaatatacctaattcagattccaaatgtgatgagtaagacacatttttctggtcaaaagtaagttccattcattttattgcctataaattgagtctggtaagtttgagtgagagatatttgagcattatgatttttaaggtaatgctttgtttccatcaagttcttagtaaataataaattctcagttatttggagaaagatggcttttattttccccatattgcctaagcctccaagttataattctaactgttcatccaacttgctctattttttatataaatgatgacaccttctaagtaaagtgatcattaacatccatcatttttaaaagcagtttcactgaaaatgaagaatgataatgagaagagagcctagttttacaaaagggaattttaccttttctgtggagacaatttctacagtcacccacagaaacttgtatgtttaattcagttatgatggaaagaataaaatatctcttaaaagcttcaaactaatttaccattttatccgcaagtttctagtaggctctaacactaagcaaaccagaagccagtggatttctagacagaacctacctaagtgcccatctatctaaaaatgtgctttaagttgggtgcctcagcattacaattcctatcaatgggtccagtactcggtaacactctgttacatgtatctctaaaaatgcaatgtgtgtgtgtgtgtgtgtgtgtgtgtgtgtgtgtgtgtgtgtttagctatcatctcagaaatcaggtaagcaagtcacccaggaaacaaaataggtaactatgttaaaaataaacacctaatgtttatttcatttggtcctctaggtactaacatcatctccattctaaagatgaggaatctgaggctcatagggattgagtaacttgttcaaggctatgctcttaaccacagcgctgcattcttgtattgaaagcagtttgttaacttacaattcagaaacacatttactgcataaatccaatactgttgtgcatagaaccttattatacttttttcctctggctaaaataaaattgaagcattttacatttccttaattgccagcaggtgtctaaaggttctgttttccattttctggtgttaaacctgaatgagctcaaattaatgattcctgataaatatggaataaacagaaatgctttttaaaaattaacaaatattagttctttatttcattgaccagtaaatcagcaaaaaagaaaaaaaaagtcttaaagagctttactcttccccttaagtgaagaggaggctaattaaagactctttaatgccaataggagaaatatatttcccaccctgcttctgttttgttattgctcttgtgtttttggctaacatttatcaagcacatactatgcgccaggcactgtgacaaaaacctgcatctaactattcaatgtttgtcacaaccccatgaggttttcctgaaataagccacattaaaattgtcaaaaagaaaaacctcttgcaaatagctgatcaaaattcatcctctaaaagctatcctgtaacttacacattttgactctgccctaaacatagccagaagtaggttgcctttcaaaattatgtggcctgccatgggaaaaaattctccagcaccaacatgatgtaattggaagaacatagatgcctagtgttttaatatacccttcgcaactttcttgctgtatgatcttggagacaataccaccaaagctctcagaatcagaatatcacatattatcctatctgaaaagggactatgataccaaactcataatcttctgagattacaacttacgactcttctttggcttgtcgtgaggtagaatatagataatatatggataatctggaaaaaagcgtgcccaataaataacagggtattactctcaccatcatcatcatcatcaccattgccatcatcatcatcaccatcaccattatcatcatcatcatcatcatcaccattatcatcatcaccatcgccattatcatcatcctcatcgtcatcatcacctgatacattcttagattctttgggagaaaaatggtaggaaatgagtagaaaataagactcttccatgtggtagttgtgtgtattgtacatatacaacaatatatgaagtcatttcatgtttggtaactagacaattgtatctctactcttttttttaatattattagtcagatgtccagtccataaaggtttaaaaagtcaagtatggactaatttgagtataactgaagagcttcatttgtttcaaatgaaatgaaggggaaaaaagactggaggaaaccaggaaagaaaggagggaaattgagagatggggaaaaaattggaatgtcaaattttttttttccattctctgctcttgtgggttttgtttggtttggtttggtttggtttgatttggtttggtttggtaggactacagtataacatatgcatccttgcgtctttttatttctcatgacgaataatccatccattttttggtaagcatcttagggctcagcagattgctttatcacagaaggttaaatcatagaatcctcaaaagaatgggtagaatccattaaaaactgtgcaaatggaaaataacgtacctatttatttttctgttttcttcttgctacttcagaactttacttttctttggcaaacattgtaaagaaagaaaaatgttcagaggctgggcgcagtagcacgtgcctataatcccagcaatttgagaggccaaggcaggaggatcactttaacccaggagttcaagaccagcctgggaaacatagtgcgaccctcactgtctctacaaaaaaaaaaaaaaaattagctgtgtgtagaggctcgtgcctgtgatcccagccacatgggaggtggctgaggtgggaggattgcttgatcctgggaggtggagactgcactgagctgtgattgcaccactgcaccccagcctgggcaacagaacaagcccctgtcaaaaaaaaaaagaaaaaaagaaaaaaaaagaaaagagctcagagttctcagcatatttacacaaaatttaaaatataaaaactatatttttcctttgactgctctaatatcaatatgcagcttgctaataggcatatcacattcctgaataaataacattcactcttcctggaacaggtagcccccaagtttcttcatgtctttgcacaaaggcctccttatcaaagaagactttcctaacctctgcaggaagtaagttccccggctcatcaatcactactttccttatttgtttttttctttattttcttcagagcacttcttgcaatgtaacatctgtttatttagtgtcgttctcagtccattagaaagtaagctccatgagaccatggattttctttgcttcactactgtatgtcatggcagaaaacttcagcaataattatttcaatggtaatgcagtgattactgaaaagtgaatattaaagacttatcttctggaagagcaaagtcctaattattaggtatcagaaactgataaaaattaatatcagcacatttaaaatacatagctgatatcttgagtatgtaacccatatatatggccattaataaaagtggtttttgttttgttttgttttgttttgtttttgtttttgtttgagacggagtctcgctctgttgccaggctggagtgcagtagcacgatcttggctcactgcaacctctgcctcccgggttcaaacaattctcctgcctcagcctccagagtagctgggattgcaggcatgtgccaccacacctagctaatttttgtatttttagtagagacgggatttcaccatgttggccaggatggtctcgatctcttgacctcatgatccacccacctcagcctcccaaagtgctgagattataggcgtgagccaccatacccggccaaaagtgtttaataatatgctagaattgtcccttaaataactccagtgaaatagcgactttggaggatttatatatgcagtgtcaaataaccccatttaaagtatctatctggacacctcaaaatggtgttagtaagaattattttcagacctacaataagacagtgtcctagatgtcctggattagtaagtgagcaggtttaaggggtactagagagtagggactcccttattatgtcttggactcaagattgaaattagggtagggtttaccagtgacgtgaattctgtgcttatttgtcaaccctatggtgtctatactgaattcagtaaaactctggctttcaacttgagaattaacacatcatgcttgtttccaattttatgtcattgacattggtgagagactcctatgtaggaccatagcccaccaggaagagacacttgggagtctctggcagcatctctcagcatctagtctattgtctcacactgttaaaatgtgtctccaaagtttcatattttattccacaaaatgaaaacccaggaattatctggactgatcttccactgaaagcagacaagtggcatttgttacttaagcataattttagagcttcactctcttcaaccaggttgctcatcagagtgttcctcccagaggcataaacaagctctagtagatgcaattttctccatcttctaacattccaaaaataaattttagtgcccttcacacattggctttctggcaaatgcctgactggcccacacttaatctgactttgacttaacatagcactggttgcaaaagatgtgaaaaacatgggcagttcttacgaaacagattgtggttctagagcttagtcatatttaagagcaagagttttgaagccagtgtaggtggtaacagccatctgaatgtgggaaacttacttaatgtttctaaagctcagattcctcagttgtaagataggaataatgatagtacctagctcagaggagtgatgtgagaatatgagtaagcactgaacaacgttgtcttaaggcctgagcagaatagtgaacatgaaaatgactatcacatagcagttcaacatgtctgttgttttcatgtgctgccaacatcctgcatttgtgtgactgtttctgtttccagctgtctttatccagccacacagaagacgaaaagctcataggagtcctagaaaacaatggttactttgtctttatttcaagcaatagaaggggaccttctttaggaatgcatgttggatcaagttggagaagttgattaatattgtttaatgttgtttaaattcagctgtttaggaaatggaatgcctgtgctgataataaaaaagatcatagatagatagatgggtagataggtaaataaatgcatgatggatgaattaggtagacagaaaaacagaaacagtcataatatagatgagtggataagtaggtgggtggatggacacagagataaaaacatataagggtgcatagatggataattagatagagagattagatagatagaaagatagcctgggcagagtggctcacacctataatcccagaactttgggaggccaagacggggaggatctcttgagcccagtagttcaagaccagcctgggcaacataaggagaccgtgtctctctaaaaatgaaaaaattagtcaggtgtactggctcacatttgtagtcccagctacttaggaggctgaggtgggagcacctgtttgagccaggaggttgtggctgcagtgagccacagcactccagcctgggtgacagaatgagattcagtctcaaacaaacaaacaaaaaaagatacacagatagatagatgatagatagatacatagatagatagacagacacgtagatagaaagaacaaatcttggaactcccttcctcttctgagttacagctgaacacacttatgtttaaagtctatgcttttcaggcatggtgcactcaagttgcaaggaaaacctggcagattttcctagaacttctgattttgttgataccctattaaaatcatcaacatgcccctgcaaaatttgataaaatcccaatttctttatagaacataaaaacccattactgagttgatgggtgcaacaaaccaccatggcacgtgtatacctatgtaataaacctgcacgttctgcacatgtatccctgaacttgaagtataataaaaaataaattaattttaaaaatccattattatcatacttaccttactaacttctcttcctgtcagttcttcctactccttgagccaagctggacttactggtaattccctgaacacttttgatttctacatgatttctatatgctattcttactagaattttgtgtttgtgtttcaaaaagtgtagatataagacaaaacaaaaaatatatatttatattttatagaacaaaaccttaaagaatcagtgtcattttatgttagaggagcatggccttgggttacagtcccctagaccctcctgatggtatcccttccctctcctttagctttatgtgtactttggtgaaaatttttaaaaatgcgtggttaaccaaaggactgcaataattggtgtggcatgactcataaagcctttgcaatttttgttttattatgcttttattttagcaatgtataaattcatttttgctaatactaaatacacatgctattaaggtgatgctcatcagatgatattttcagcagaaaggctatgagatgcaatggaaaacagaacacagtttgctatgagcagaagataaaaggcatagatgcatgctaagccaaagaaagatcaaatgctcaatagacccataaaactttccctcatgggtctatgaaagagcacagtcaagctgataaaagttatactgaaaggaagagtcactgttgaaagaagatcaattgagtagtgtattgaccatggatgcaattttctaaagctttgtagaaatattgatgtaatctaggagggattactttgcaaaatttgctgtctaattcaccatatttgagtattttaaccccactaagtatgagtgtcagcaaagacttagtacttgaaagtgtgctaagagttcaaaatggttaagaatctctgagttaaattttgcattttaaatcaagagacttaccagtaccttttatcatcaaaccagaaccagaaaatcagggttggggaggaggcggtggcttttaatatagtaaatctaagtataaatgtataaaattccatttaagtcatagtgcttccatggaatgtaaagttgtaacaaagatgattcaaatatgggtatattataaacatttacagagatgtattattttgaaaatggtaaagacctctgcaaatggccagatggagagaattacacatatacaaaaaaagtaacatttttagattaaaagtttgcagatctttatcagaaacctttataaaagcaagtaaacttttttcattgtacataaaaacatggaaaatttgctaagtttcagcaggtatttggggtatacagttatagccaccaaagaataatttttatgctcatctggaaagaatattttttcaggaataaagtgttttttcacagtgagctgtaactgagtgattatatatgtattcatatgagacacttttgagagaggaggtgctaaaacaaatttaaaagtattagttgatctatagcaggctttgtccaggcttttctatgagcaaactggaacacacagttaatcgaggaataataactaccttcttaatatcatttgccatcctatgcattatattgtccaccatctctaaactctctgagtctcaccatcgtattgttcataagcagttctccatggatgtctgtttccaaacatcttgagagcacaggaattgtctgccttgattccagataatatattcaagaaattttgtatggcaaagagctttggaagctagaaatttggagcaaagatcaagtttatttgtttgcatcttttgtaagatttggattttctaagactaggatttctcagttctaacttcaacccattatgtgaacatcatctgcttgggccatgccataattacccgcatgggatttgggacttggggtgtcaaggggaacttgcacaaatataaagctcatgctgcttgttatgtcataaataatttggtcctttgtctttgaaccaggagtctcatgtcttctgctagcctccatgaatttatagcaggctaacttgttagcttacaagtaggtcagaacctcagtcccttcatagttcttaacacacatctacagggcaaaagcaaaacaaataaacactataatagtgatattcaatccagttgagcatgagacagggcattgaacagggatttggaagtaaattgtaatcccactgcattacaaccattttttgagttactctgtgcaaattatttcacttctttctgctactcaatttcttttttttaataaaggaacttctgctaacatgcaaatgtgtgcatgtgtgttttctttttttttttttctttgcccattgttttattatactttaagttctgggatacatgtgcagaatgtgcaggtttgttacataggtatacatgtgccatggtggtttgctgcacccaccaaccagtcatctacattaggtatttcccttaatctataaagtttttttagagagggtggtggccctataaggtctaactctaaattcttaaaacttgttaaatttttttcagtgtttttcataactctgtcccttattccttcaacaagggtttttttgtttgtttgtttgtttgttttgtgtgtgtgtgttgtgataacttaaaaatcagaaaatattacatatgggaagctccttagagatgatgtactttagggacttccacaattatgttctgatcaatcctaggtttcttcagagaaaattttgggtctctgaaatgcttgattgaactttaattttcatatacaatttaattaagttttaagctaataagacagcatgtataatcagatgtgttataagccaagtgctaacacatagaagaccatcaatgagtcaacttatatattcactgacattaaaaatgcaaatgccataaaattcaatttctaaaacaaatctatactgataatatatttattttgactgtttttctatggaaagttaagaacaataaatcactttgaacagcccattttacaaatcagaaatatgaaaaactaataggaatatgagtatgatgaaagaatgtggttaattcgagtaaagagaagacagaggaggcaggaagttagctatacatgtatggagctatgataatttagttgaagttttttattccttttgagttaaggatcacgttttgtttcttttgagtttctatagttaaatgctgcaataccatggagtgtggttaaccagagtgagttttcttcctattagaaattgttattaaagactttgttacaactaaacagaaaaaataaaggaataatcccattaaaaagtatgcaaaggactaaataaacatttctcaaaagaagacatacaggccgagagtggtggctcacacctctaatcccagcactttgggaggccaaggtgggtggatcacgaggtcagaaatttgaggcaaacctgaccaacaaggtgaaaccccgtctgtactaaacatacaaaaattagcctggtatggtggcacgtgcctgtcgtcccagctactcaggaggctgaggcaggagaatcgtttgaacctgcgaaatggaggttgcagtgagccaagatcgcaccactgcactccagcctgagcgacagagcaagattccgtctcaaaaaaaaaaaaaatgcaaatggccaagtatatgaaaaaatgctaaccgtcactaatcatcagacaaatgcaagtaaaagccgcaataaaatcatcttaacccggttaggatgtctgttatcaaaaagacaataacaagggctggtgaggatgtggaactctcatacattgtttatgggaatgtaaataagaatagccctcatggtcaacaatatggagttttctcaaaaaaaaaaaaaaaaaaaaaaaaaaaccctgaaaatagagctaccatgagatccagcaatctcaatactgggtagctatcgaaatgaaaggaaatcagtatatcaaagggatacctggattcccatatttattgcagtactattcacaatagccaagatattgaatcaacctaagtgttcatcattgaatgaataaagaatatgtggtatatatacacaatgaaatactatatagccataaaaaataataaaatcctgtcatttgcagcaacatggatggagctgaaggtcattgtcaagtgaaataaaccagaagcagaaagataaatatcacatgttctcactcatatgtggaagctaaaaagtttctctcatggaggaagagaatagaatgatagttactagaggcttggaatgtggtggtcagggtgggatgaagagagggtagttaatgagatagatagatagaaggagtaagttcttgtgtttgatagcacactaaggtaaccatagtcaagaactgtatattgtgtgttgtatatttcaaaattgctagaagagggtcaggtgcagtggctcacacctgtaatccctgcactttgggaggccgaggtgggagaatcacttaagcccaggaggtcaaggctgcagtgagcctagatggtgccactgcactccagcctgggtgtcagagtgagaccctgtctcaaaaaacaaaaaaactacaagagaagatttaaaatgcaaagaaaagataaatgcttaaggtaatggatatcctaaataccctgtttggataattataccttgtatgcatgtatcaaaatatcacctataccctgtagatatttacaaatattatgtatccaaaaaaattaaaaggctttaaaatgtacatttcttccttggcattgctacctctaatgatgagatgacagacctaaacttgggagaaaccaaccagaatgaaaaagagatatgtataaaagacaatatggaagaaaaaccacagaacttaatggcaggtacaagtacaaaaaaaattaaactttgctcttgcatcctggtgactgggaaatgattatattgttgacagaaatatgaaagttgaacagagcaaccggtttgggaaggaaaaaattatcaacacaatttcagaaagttaggagtttgaagagatagcagaactcctgctctaaatctccagtgaacaggtcagaattgaggagaaaggcctagatagaattagagatttggcagtcatctgtgtccatagattgcaggcttcatatatcagattttatctgttattcttgaatcttgaagtgctggtcatgtggcaattttctgccactctttccaataaaaagtccatattctgatttccctgtgactcagtaaattgcctcaaatctcatacactgtttttcttgttactgggtgtcaaaccaaatctgcctttactttaagtgtaaaagttttaaaactatgttgtgtatatgcaaactggataattacatattcatttactgagaatatggaagcatggaaaaaaactaataaatcattttcctcaatcaatgtaaggaatctaggtttacaaaggcatatttgaattactataaaagaaaaggagacctgacaatttctgtttgattgtgagatgtatagcatcatcaaaattacaaggtaaaagctgaggaacatttttctgaatgcttgaagaattgactgggtattcagcagaagctgaatgaaaatgtcaggctaacaatgaagattttgtactttatcacaccctgatgactggtacatagcaagatttgatcagtttcataaaagtaggaaattgaactttcaaagacatcgctagtactagaatatactagaatgctcctttagtatgcattcaagttttttaatagtatgttacttggttaatatttatgtctgtctcatcccttaagtctacctacatttaaattttatttcttggtaagtataaaattattctaagcttacctcagacactaacaaataagtaacaagggctcgatgggtatcaattccatgcctaacacagggctgggcattatgagaagtttaagacattctaatagagtagaatggtggtctccaggggccacctggagatggagaaaataaggagatgttggtctaagggtgcaaactttccattataagatgaataagttctggggatctaatgtatagcatggtaactatagataataatattgtattgtacacttgaaatttgcaaagaaagtagatcttaaatgttctcaccacacacacacacacacacacacaaatggtaacaatgtgttaactaacttgattgtggtaattatttcactatatatgtgtactaaaatatcatgttgtacacattaagtgcatatacttttttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccccatcccacaacagtccccagtgtgtgatgttccccttcctgtgtccatgtgttctcattgttcaattcccacctatgagtgagaacagtgcatacacttttatttgtcaattatatctcaataagggtagggtgggaaagtgagccaggacttctaatatcctgctagtcaatgcatttataaaatgttatttaattaccatgttcctattgtaaagactcagtttcaatagttcataaattatttattcattattggtgtccctgacaagataaataaatatgaaacaggcttgcacttaagaggggaaaagcctatgaaaaaattacaagctacttgggaagccttttggatacttgtaaagtaggttactccagatttattctgtgatgaggaagaatgacagacttggatggtttacaggagcatcttgctttcgatagtaaaaggcactcattggaacatcagcttattcaactccatgcctttacttttagggccacaggaaacaggggtcaatgatggtgaatgcgtgctttttctcttgacagaagtaggaggattgaaagattctggtgcccttaagtgtggttgaatttctgaacaaatatgatccttgcaagagtaattaaaataagctgctaattaaaagcttttgttgtttaaacttggagaagcaaatcaaagtggcaagctttcactccaagtcaactcagtgctctttgactcccagaagggcagcttgagacaacattgcctaaaaatttcttgaatgcctgaaaggagttgggttgagttcagcttagaagtttagattggaaaagatgtctatgttagaataaatcgtggatttttagatttaacatttagatagaaaattacttaattttgattattctaaaaataaatctaccattccagttagtagaatagacatcctttcagctaccatctattgaactcttattaacagtctggcacctggtaactgcataagcttagttaaatctcacagtagtattatgaggttgataatttagttatcccatttttataaagaagggaaaaataatgaagatgttaagtaacattcaagattcattagctcacaagagtgaggctggaattggaacccaatgtactgaccccaaagccatcttctttactaccatattttgccaaccttgaccagctgtaaacttgaggaatcccatacgcatgtgctgggtaaaatagtttccaattacaaaaagacttctaatctccatttttttgtactacatattactattatactattttctgtagcttctaacaatatataatactctaataacgacattgtaattattaataaaaatgactaatgcaactctgtaattttcacttttaacatgttacctaaagcactttttgcttaaatgtttcttcttggtcaataatttattgctcttgctaaactgaaaaacaatatgtttgatgaagttatttcatgtaaatggtaaatcctttacatttagaaaaaaatcatttctcttgtgtttttcattaattataatggcagtgatcaattttaaatatggccttacttgcatattaaaattgatttccttcccagtttagttctgcaagtattacttatttaggaaacaagaaaaattataaaatgtttttactattccatgtttgcaaggtatgggtagttatttctatgggtcagatatttgttccaaaatactattcctttgcttccacaaacacaataataaaaacagttaggtctaacatttattattcaataaattgatatgttccaaatactatacttggaactttttttttttttcctccccaagatggagtttcactcttattgcccagcctggagtgcaatggtgcaatctcggctcactgcaacctccacctccctggttcaggcaattctcctgtctcagccttccgagtagctgggattacaggcgtgcaccaccacgcccagctaatttttgcatttttaatagagacagggtttcaccatgttggtcaagctggtctcgaactcctggcctcaggtgatccatccaccccaacctcccaaagtgctgggattacaggcatgagccaccccacccggccagaacttttttatacttggaactttatatctattatctcattaatactcacaaccatcctataaagcagctgacattatacacaataatacaagagcaatggggcttagataagttaaataactctcccaagtcataaattagaagagacaaatgattttctaaaaccaagactgcctgcttcctagtactaattttttaccctatcaacttgctgcattcaaaatacctttgaaaatattaaaaattaaactataagtataaaataagaccttgagttcatttaatatttggtttattcataaacattttaatgcatatttttaaattttagatgaatagaatttgatttagctgtaattctataatgcatttctttacataattggtatcatgttaactctttgttagccttgttgacctttcctagcactggtattcatgtatatgagcctgcttttgtattgacagtggatatttcttcctttcctctttctctgcacaaatttctttgctgtcatgttgttagcaaatatttattccattcctgcaagcagtcatgcataaaaatatgataatagatattcatgtcctttcttaaaccccagcacatacctacttaaccatcacgtcattcaataatacttatttcaccatgacaagaagggcaacataaataattaatattgatttccctgatcttgcctctaacccatacagctttctcaagtactgattgatagaaaaatactttacctctgaagctgtctgacatttaaatatttaactcccatctcatagttcatgaaatattactaaaatacacagaaaaaactacttaaaaagcagtaattcaaactaaaaacttgagaaagcaactgaaaccaatgaaatcatgtatgatttttaaaagatacctctagaaacttaaattcagggcatcaaatttatatttttaatctccatgaaagaggcaagaacattattgctatttagtaatgcaatattaaatgatattttgctgcatttcccaaaggcagtaataactattactagtagtttattggtttataaaaaagtactatcttaattcataaatagattactttctctcacttctattcacctcctgcctttgacccgtcagctctgcaactttgggtaaattacctctttgagctttcctcactttatctataaaatgtaatgcaattcacaggattaaatacaaatacacatacatattatttgtgtgtgtgtgcatgtgtgtgtgtgcatgcatgcatatgcataaacaaacgatgcctggcatacatgtagtaggttctcaaaaactgtgagtcccatcctttttttccctttttgtatatttacatgacctacctgtgtacacacctagttaaataccttatattttgcaaggctttcacatatggtggggccagggtgaggcaagtgtgccacttgccttatgcacaaaatttaaggtggtaagaaaaaaactcagtaattaaggtgaaataaaaatttaggcagtatttttaaaaatcagaatttatccaaaatttcctgatgaacaaaacctcaaaatattaaataaaggcaaggtccacaggactggcatttccttcgcctcagcctccagtgtggcttagcccagctctgctttcaccagcgttgcctacacatgtcccgtagctctggcccccacacagaaacaacatccaagatgtctgcgtccttagtcgcaggcctcctacataaggcagctcacagcctcattccttattctcggtttgaggttgaaaggtttaaatcttgaatttggagataggaatgaaggcaaaactcaagctgagaatttgagagaaagcaagaatgagagagtatagaacgtcacaaagatctagcaatgagggagcttcattctgaactcaccatgcttgaaaggctatagatgagcactgtctgttccctcagtctgcatcagcttcatccaagaatgatttttgatgatgacattgaataagtatccatgtttctgtaatagttttaggaagcacaaaatgaacttctggttcctcttaggcttataaatataaaggagtattccatagttattttatcttcctattggccttgaaaaaaataccctattagttatctaaatcctcatcatgtgtaggtgtagagtcaatgttaatggtactttttgataaataaaaatgatgacatcctccttctataatacctattcccaaatatttaaatacgcttctactaaaaccaaatcatagactaagttggagtgcttggtgttacttggttttgatttgttctctcctgagacaggacacatttttgtctttgatttaccccaagagaaagaattgtcaccactggataacccagtgagcagaataatcaggccactgagcagaatgagtgagtcatggtgtttctagtcctccattaccaaattgtgcacaaaatatatcgcagctggtgctgccacgtatgcagcattttaggtgggctatggactgctgggaaaagaccatacaaacctatagaaagtccctgatttatttaacaagtatcctgaaattaatggaacaggggctctccacagcaggaaaagataggtagtatatggcctcccctttgcccctgggctcccagaggggcacacagctgccagaaactcgcttcatctgagaagaccatgctaatgttgaaaatatagccaagttcttgctatgccacagtcgcttaaaatatgaggcatataataaccatataatattccagtggcatttaggctaaaaatctgcatgcttccattatagaagcatttacaaacttcagactctacaggttcttctgcacacaagaatcccatatcctcttctggtagataacgcagaatcatgtttccctttactgcgtatctgcctttagaattcttgtgtctataaaaaactcttttctaacagaacactccttgatacagatttagtatgcctttacctaggtgctttccgtatatagtgtgatcttaatagtcacttctctgaaatatattgtctttactgtgtgcaaacttaagtatttgttggggtcttagatcaaatgaatgtgttttaatccaggcctaactgactataaaagaccgtgtgcttcgttaccatgcagggttctacagattgcatacatcagaatcatctggaatgcttatcagcacctcattgcatctggtactgaatctttgtctttgggtatggggcctaggaattgttagttttacaagctcctcatacatgctgaagtttggaaatcattgctttaatattatactgcatcctggttgcactgattccttcacaatttgaagttcttgttgtcttaggaagagaagcctataggctaacagattgccagcacccctgtgaccattactgtttgcttccctcaaaaaaaccacattgttgattggcataagtcctctagtcactacctcaccctgagctcagcttgccgacatctgaatgaactggcagtcaaagccatacagtgccaagagagttagcttcctaagagttcctcatgaaaaatggaagccaggttttgccccttgctttctatcttgaattttgttaaaacaaaaactatttttatctgtggaaacaagcatgtatgccatctgttttctttgagatatcaaagttcagtattgtttttaattcagcaacaaatatttattttgcccttccatatgatgtttattcatactcgtctccttcaccctaccagctttatctgattaaattcagtctatacattggtacattaatattgtctgttaatttttttcctaattaaacctaaggaattgtatattttaatatactgtgacactctatgtattctttatttcttcaaaattatactcctttggaaatgtacaaataatgcgtatttgtatctctgccatttcttaagcttattatttaggcacataatatatataatattagacatgctggtttaactaaaataagctattcattttgttttcttccatttatattattgtggttatataggttaatatatttgaaaaacatgagaaatatattataattaaattattttgaatttcatagtccaaacaagtaaaactaatgttgttctagcactgacaatgagacaaagaggagtcattgaataattaggaaaaagataaaaaatatctagattagcaatgattatttagacatgaaaaacaagatgatatctactaaaatgtatataaactgatattcagacatattccacttgtcataattaatttgagccttgtgtatgatattcattgcttctaatgctcccacaatttttttctgtcttatggagcccatattttctaagaaacgtcatagggccataaggacaccttgccttcagatgcataattcattaggttaaacagtgtatgtcattggcttgggtttctttcttcagggtgctgcccaagtgcatcagaaccctgtttaactggcagcaatttgagatgcagaattagcatattgtttcttggggaatgcccttgaatgtgcttgagtagcttgttgtgtaaggcatgaacagaattgccaagagccagggaagaaatgggttccaagcatcatgcagtaatcctgtgtgcctgtgcatatctcaagaaagctcctcaggaaatgtcagatcattgctgaatgattaacgcacagacattgcagaccagagttatacctggggactcacagctcactcatattacagcacacctgtgcaaaattccaaagcgagggatccctgtggtgccaggtaagcgtctcaccttcactactaatgctctaaagttacagctgagaaattattgagaagttaagctacaactttgctacaacttgaaaacttacatttttcacctttgtggggatggagcttaatatatttgtgtcctgggagagacaaaatgtagaaataaatagagggctggcttggataaagtatactaaaaatgtgaccataaaaagatgtaaagaaaaacaaatcaacttccatgtggaccaatcatgagagcttagaaatacgactttttattaatctcacatgccaagaaaccatcccttactaaaatgatggaatggaatatttccatttggcaaaatgcttgcaggtgaagcaaaatttaatcaatcaaattcaaatattagtaaaatgaggagaaataaactctaggcaattcataatttcataagaactctcatttgtcttttgagcaaagaataaaatagctatcattgcttttaatcactggagaaccagaattctttttagacttccatcacttactgttgaatatgcttgtgtatgagtcctccagtgttctgaaccagagaatagtttctttatgggatttgtgtctgctgcagaatgcttggaggaatatcatttttgcttgcagaaaattgaaataggcatggtctatgtctcaagtgcattttaaagtaggaggtcaagtacaactccttggcaagtgagaagcagacataataacaaaacttcaaaccctagattgtcttcatgtaaccttgtgggtctatgattctaagaaaatcctacatttaaaaaaaagatgggtgattaggtatagagagcaatatacagttttctctgatgatactccaaaaatggattcttaagaacagaccctgttaagatctttccatgttgctaggagcaattgttaccataggaacaatggtactagtaagcatcatttatacacacataacatccaacccagaaagtgatttaattaaattacctttacaattatatactgttgtcttttgcagcgttttcatgtgtatagtacaacttattaggccctcttttaggtaagcttatgtaaatttgctcactggtaactttcactggtttatatcctcaaccattttgttacattgaagtttagtctttctttggcatagaagaaaaaaagattcaatattctgagctcaattgtcatttttgtagggaactttgagtcacagcagtgatgggtgctcagccctgatggggctgctataatcaaataagaaaatcaaagaaaatgttgacactgctgcagatttagattgtgcttcacccacaacccagtcattttatgttgagtattattttgaaaacataaaatcagaacaagtagtcatcctcaaattccttaaaacattctttttttaatttttcattaaaaatcacattctctgatgaaactgaaaagaattcagctcgagcaacgttggaaaatgctcctctacttccccccttaaaagaatagttaattagactatattacagatactgattacaggcctgtggtttgctgttgaaagaatatgctagctcaggttacagatctttctaaagccgaaagaaagaagtatgaattcaggttgtaaattgttaacatattgccagaaaacaaattgggagatgcggtcctctgctgtgatgtggatttgtgccatgattgtggatttcctgaaatactcttaagtagagagtcttaggtactggggaagataaagcacaccacacttgactgcaacaggcttcagctaatggcacatccatcctcacctccttgatctgtcatttcctccaaaattagctcatttagtttacaatgcatcaaattacttttcagtctctatcaataaagtgtgccatctattattacaactgtggaatatactggcaggcaccagacttatttctcctgaatctcaaaagtggacaggaaaagcagagtcaataacacctattagcaaggattatgcattcagcagtgtatataaaatactgggttctttaaaatataatagagaacagagctatcagtcccagggctcaaatcccttccctgacatttttcagtaagacgcttccttttttaccccaccgcccagaagggcatgtctcagcagtttcctcagcccacattgggataagggaaagaggcttctgattttctgtgcaaggaccctttccaagagcatccagatgccaggcatccatggcccaggatgtacaattcccatttacaaacaaactgggctagacagcaccaggaggtagatggctcttgcaacaagacccatcatctgggtcagccagtgcaactattgacccgacactaggaagaccagaatacctctcaaacctcttcacaccctggctcatttcgtttaagagacttatttcccaagaaattggcgtgggataagcttctaataagctttcactttaaattaccaataattctgttttaccttttcaggggagaaatactcttgaatccatctgcactgtcaaaatcaaaacactgtttcatcctatttagctatagcctgaaggcactttctaaattttgtgtcatgttagtgtttaacacattcagagcttggtaccctcagtaacgaagagtttcagagtctgaccttgccctggacaatttgtttttttcctacaaacatcatagaaagagcaagaaccttggtattagcaactttctaagcttcagtttacctgtatagaaaataaagaacatcactttactccataatattggaatattaatgaggatcaagctagataatgcatataaaagtacacaggacagcatccaaattactactcttgttcatttctactcttcccttaaatgctttagatggtaacaaatccacttaatattctggaatgtgtactatacatgcttaataatatattatctaattttataaatctctatagctttgactcatcttgattaaaaacatatttttctaattttatttagaatattaacatttttaaaaaatatgaattaacaacctttgtcattttgttatatgtgaattttaaagatcataatcttcataactcatcagaaatatttaaattaatatttatttttatctgattctttctatgactttaataattttttatctaattctttacatgcaataattagtaatagctaacaagtgtatggtatgtatgcttacaatgtccaaaacaccatgaccatttttaatgattttacatattaaaatttactactcatgacaacaacccaatgagattgacatcattaccaacagcctagttttgcaaatgtgtaaattgtggcacaaatgttttatataacttccccaatataacacagctaatttttcaaacccaaatagttggaccccagaacccaagatttaaacatagtggtttttttttttttttgtttgtttgtttgtttgttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaaacatagtgttttaagtcctgtggaggagagggaaaagcaaaaagctaacagcacaacaacaaaacaaaaaccacttcagacttcaaggagtttttaatcatgagaatgtacagcctgtgtcctaaccatctttcagccctaaacatattcccacagacaggcagcacattcatacaccctcagacaacacactactccgtcctcacactttagagtagaacgcaagttacaagacaatgtcaattaatgttgttgtaggaaacagtccattggaaggactggaactgtcagctgtatgtcaggctctttccctgtactgtctcattcaatcttcgtcactttagagaaaactgaggcctaagaaagttcattacctttctgaagaccacacagataattatgaaagttttagaattcaaccctcattctgacttcaaagcctacaacaccaccacaccacagtacagaggccttaacccaaacttccagtttgagaagacaatgctttgagtagtgtgaaatgctaatcttctccagacattcacctcagaagccaggagacattaataattaaacaaaaaggagtgtctgtacttcaacaattctggaaaataataaactttaaaacatgaccttatgaaatgatatggtagaagaataaacagaggccattgaagttcatcaaaggatgttttctgaacgtttttagatctgacctgggttttaaaaaaattgtgtaaagtgtctacaaagtaaaggagataaaaggctaaacagcatatatctactacttttttttgagatggagtctcactctgtcgcccaggctagagcacaatggcacgatctcagctcactgcaagctctgcttcccgggttcaggccattctcctgcctcagcctcctgattagctgggattacaggcgcccaccaccatgtccggctaatttttgtatttttagtagagaaggggtttcaccatattggccaggctggtctcgaactcctcaccttatgatttgcctgccttggcctcccaaagtgctgggattacaggtgtgagccaccgtgcccggccagcatatatctactttaaaaaataaataaatcttcagaatgtacacattgtttgtaaactgaatctttgtaatcattaccaaaaattaagctgtctactcttcatatttgctctcttcctccacctcttagctaatataatatttattcttagctattatctcctttattttctaagtatatgaaaaggaaagacaggcctttagaaaatatattcttagtgttcccctaatcacaaactttcttgaaaattaaaagacaaagaaaggagctgaagtatgtttaaggtgtacagcctattttttttctagacttacactgatttttaaaatatttttgtgaattttgaaactgggggaaaaagagtgttacaatgttcgttacaataattgtaacttaaatttggacaattttaagtaggctttgtgaggttaaacagtattaacagatcttaaactcaaaagtttgataactataactacatttcttacaatacattcagtaccaaatgcaagtagctaataattaacttgaacagtcccatcacaatgattaaaaatatgtcaactgacacaaaggaactgttatacctaatgagttcataaaagtctgagattacctacaggaagaaatatgaaatatcaatcctgaatattttaatgttttagtatttgtaagtcagggtgagggtcaaacgtaaaatttttcaaggatgtataagggaatttgtatttggtgaaatagtaatgaatttcagcactaacatataattggtttgaaataggaagttttgatgccacatctggagaacagaataatataatccacaacaggtagtaattacttactgaaggtaattgtaatgcagcttgagttgtaaacattaatgaaaaaaaagatttctaagcaaataaaatctcacgcatcaaaaagacaaaaagtttgtgataaatggttcatttaggcatgcagtgctgtgtgggcaaaattggattgcaatcataggcatttcaaaaaatgaaaacattaggagaaaagaaaattggacagaaatggcagggaaattacagcctttgatccattccgaagaacttttttttgaagcatcattatgagtgggcagcaaactccttccaatcttctgttaaaacttttatgaaaccctggagaccacaaggtaaaaataatcaatttaggacagaccatggaaatatttttcagtgataatctttttttcccgtaaaattgtacaaaactaattccaatgttaaattgctatctggtcttgaaattgacacttttaatttcaggagaaggtctttcctgaatcatttttgacctcttcaactaacgatcagttattagacacatgcttcacggtaaattatatggagatggcacaatttcacaaaaataaagagtattgtaatgctcttactgatatatcattgagaatatcatgggtccaagaatcatacctttaataatcacaccttgaaacataaatgggcactatgctatggaaacagatctttggctattgtaaataatgcactatagtttccaaagggctgaggtgctatatctgtatgtgcaaaaacttaaattaatccctacagctttgaaacaatgatgatgatagacttgttcaattgctattaaaatgtctgtaatttgattgtaaaccattaatattcgagattaccgattggctttccttattaaacactggtaattagtcatttcatgaggatttttgacctttattgttaaatctaggtttttaaattagcgtctcaatatcgtttaaattagttcttgtatataagattattttaagttattatctttggaagaatgttacatcctaaagttaaaaaggagaattactggcaaataagtataagaacattactttatatttgagtaaatagtagctttattcttctgagagggctgtttaaatcagatttacaatgcctgaagcaaaatctagatttatttttttactttatttgacttgactacattctgttttcattaacattttctatttgaccttttgaattatagaccccttctaacctaaaaagatgttattatgaaagaagaatgtgtttgttttgtatctttgaaagtgaatactggttttattgctatttgaaaatattacttaaaatatagggaggtgaaatttcaaatgaaatgactgaaatatgttttttctgtcaagatttttaactcaactatgggtaaagtagtttctaggatttattaatctgcaagttctataactaaaatgaatcatttgcatgacacttttaaggttgtaatggtaatttttctaaattatccctaacaatgtttagcatcataaaatagtttcctaaatagcctttttcttaggtcattgtaacatataacatatttttttaatctgaaagagatgaaaatccttgcctttgcccttgaagaatccatactttatggaaaagattgataagtgataaatttaaaaatagggtgatgagtgctgtaagggaggtgcttaaacatcactgcctcagggactgctagactagattatatcccctgtgatagactgccttagcacactgaacttcccctgttaaaatgatccacattctacatggcaattacgtttttcaaatctgtattcataatagaccataaactctacactggccccacaccttctctcttgctcactatagtatcttcaatgccaagcatcatttctgacacatagtagctgacttatacatactcactgaagaaataagtaaatgagggtgaatgaatgaaaggtctgaaacggtgttttgttatgtaacccagattagactagttttgaattttttatttttaatttataaatagtaattgtatatgttgatggggtccagtgagatgttttgatatttgtatacaacatggtataattaaatcaagtaattaacatatccatcagttcatattctagtgtttcatggtgagagcatttaaaatctactcttttaacaattttgaaccgtacattattactaactgtagtctccaacagatgaataaagaaaatgtggtatatacacacaatagaatactattcagccattaaaagggaaattctgtcatttgcaacaacatgaatgaacctagaagactttattctaagtaaaataagcaggcaccaagagataaatattgcatggtctcacttatatatggactcttaaaagtcaaactcacagaagtagagtaaaatggtgtttaccaaaaggtgtattggagaagaggggtagtgggactttggtcaaaggatacaaattacaattagacaggaggaataagtttttgagatgtagtggacagcatggagacagaccatagttaataataatgtatatttcagatcagaccatttttaaatgggcactgaactgtcataaaagaaattccaagtgaacatgatgaggagggcacaaaaacaagatgatagtcatgccaaggtgcagaggtgagaaagagcacagagcaagttaaatcaactgcaaggaatctggaatgattgggcattcatagaatagtattgcagaataattgcttaagatattatattgtattttgttgttgccctcctccatttcgagcaagtaacccattacttgtctaaaggcattttcttttcagagaagaaaggagaaacagccaggagtcattagcagttcttgttttttatgagagtttaaatgtattgaagagatacgttaagtgcctagaaaaaaggaaaataaaggggagcatgattttgaggacaaggagggaataagaagagcgactcctcgagataagaaaggggagctagtttgtcaggaccgtaagacaatggtaatgactgtgccacagacccagaggctgctggcttcacctcagagtcctgtgtcccaatgacagaatgaagaaaagggaagatggggtgataaacctattgaagaaaccacactggctgagaaattgggcatgtcagaggtgtcaagggttggcagaggaattatgaccagaggaacttccattcctgcttggcattcagtaaattcctgggacttcggaacaacctggagattataaagttccatatttactaagattgacattcccacctgccaggaagaatgggaacttggagtcagttttaagatgatttatgaaaataaataaatgcagtagttttgtcatttgaatttgcaacttgaaattcatatgtgctacctaacctagaaagacaggttagaggcacatcactgaagggatcatatatcaagctaatacatttgaaattgattctgaagagagtcggccattaatggtttttaatcaggagaataataaaaaacatcaccctaatgatgacaaaaggttggactggacagcaacaagactagtgggaagttgaccaggtacagccaatattgcagtcgagttgatgagctggaccaaagattatgagtatagaaaggagctgatggtttgagagctatttaggctgtagaatcaccttgattagatgtctgtggtgaagtaaaaacaaacctcagagcactcccaagttcctggttcacagcagggcagtacagaggagatgtaatattatcatttgtcccaaaaagtacgagggatgtgctgacgagagaagggagaaaatgatatggagttcaggagagagaaattgggggcttatcagcaaagttgaatgtcaaaccacataaaagagacatggcccagaaatgtatagatagtaaaagggctgagaaaagaactgtgtgtattcaggaagtttcaaagaagactgaggaagagtgagcacaaagctagaagaacagtagagaatgatgtcacaggagaagtgagaggagaaattttctggaaggagagattagtcaactgtgacagatactactaaagggagagaaattaaaataaacttaggaaatttgaacgataagactttagatgacctgcgagaaaagaatgtgcagatgtagggggataatgtggaaaccagacttcaatgggtcaaaaaggcagttctaagtgatgatgtagatatgttacagaatttgatcaggaggagagagggagatgcaggactctgaatggtttttaggacataggaagttggcagtggaaaggagtgagatacaaacagacatacctcttctattggcatggaagggtggttggaatccttatgaagtgagaatcgttttgcactttgtatagggcagttagaagtggaagaaaagtgccagctatcacggagattgttgtttgtttgcctctattttctgaagggaaatgtatgagagaggaattatctgttatatgaggaatattatgtgaggaattatatattcctcatataatctcatattacctaaatatttatccattatatctattctatgagaaattgtgtggaggtatctctataaaatgagaaaggaattgtatgctgagagtgaggacacagcttggaatattaatggtttagaagtaagcatagtaagtatttgaagaatagaatggaaagggaagcttgactagggacaggtgaaaggggtattatagaaatttttgctaggagcaaagctttcattttgggtccaaactatggaaactaattaactgatgatgcttcataaaaagcaagaaaaatgtaaaaaaaaaaaaaaaagtaagagaaattaagacctaggagaaaccttaggttttacccattattattatccttctcatttatataagaaaattattacccttctcattatatataagaatattcaagaccctttaatttaaggtaagctacattaatcttgacaataagctataagtgcctatttcccaagttgtcatcgatgaccaaaaaacaaccccaaaaaaggcattaaactcaaaaggaaccctcactgggagaggttgagggaaacggggctgagttctagcccaagacataggtatttccaaaattatttaatttcacaggtttctcagcttttgtcatctggaaaataaaaaccttaaatttaatagtacttatgatctctataatcaattggatgccaatcagatcaaattcacctggtttcaaatttaacaataaacctatgcccctagctagctatctggaaaattgtaggtcggaagaagagccattgaacatgttagaaaactctgttctgtttcactacctaaaagaaaaatcgagttacaattttgatggtttattggctaccctaatgcaatctatgttataggatggctgtggttaaaaactcagttgatgaacaatacagacacattaattatgactggaaaaaataaacataagcacagaggatataatgcattttgtatgtaaattatcctgccttatgataatcaaactatgcagcaatggtaacccttcttactataatggttattttcaaatgcttttacttcgttaagtggacttcatagatgataatctctgacataaaaatcattcaattgtcatcactatttcttcagaaaatttgaaagttcataggtctttacttaaaatgagtcattacgatggtgctatttttctttctactgtttgtctgcccatgtattcaattagacatttgaggttcagaaataaaatcaagttgaatgtttatcagttggatataaaacatgtacccacatggaaatcactgttgctaataatgttgtctctattttacagtcagagaaattgacattcagaaagattaaagaactatgaaaaccaagcagattttagttgacaaatctgagaatcaagcccctgactttataaacttaaagtccattgatgtccactctatagcttagacttcagatacattctgccaatcattagtgtgaagttaggctgagacctactagctcatgttactactaacctgattcttggttaaatttctgtggtgtatatcagagttaaatattcacaggtatgttaaagagccactgaagagctcttcagaagctcttcaatttcagaagctctaaaatttcagaaatcacaagaaaactattattttagtttagttaaatgttaccttaaaatattggttaacatgtattgagtacttaccccattgttatgagaacattatgggtaggaatttatttaatcctgaaacaactctatgacataggtacgtttttttctccttttttttttttaataaatgagggatctgagggacagagaagttaaataccttgacaaggtcatacagcttgtaagttttggagctagattaggaagcagtctgaccccagaatctatgctttacaccactgtcaggtagagataatggggggaaaaagagcaaaacattgaattcaatgattacttacattttgatgagaagcaggaaaatccctgtagagtgaagcatttagaaaataatggtgttggggcatgtgataactaaatgaggaccacatagtaacaaacggagagaacttcaaacacttcgtgaaagggtcactgaggacatattgcttcatagtttcacctggaatgtgtgaagataagtttagagggaaaagcatatggacttgaggccttggaatcaacatgacaactaaggttttgggggaaaaaaatgctgtttcactccactgaaggcatattgcaccacttagaggtgcttattactgaatacatctaccaagaaacatatgaaagagccaggaaattatctctactcccacatgaaacagccatatggccatggcaccacaatttcactcttctaagctcttaagctcaggatctgatgagcaagaaaacataaaaataaatatttagctaaatttatgagccaagtgtagaaattaaaagtatatcaacatcaagttaatggaaacaatgaaaatatattataaaaacagaaaaatacatcttgctaaaggacaagctaaagaactatgttcattgccatgaaagaccaaacaaatgtaagagagataaaaataaagcaagagattataaagagatataagaaaaatcattttattgaagagctaatcaaatattagaatgggctgccaagagggattatagaggctctgtctctgaatatcagaagggatgctgttcatcctcattagttaaaaattcagatgttggaaggcagggactccctaggatcccagtgttaatatagaaatccatactcagctgtaatcattgtctctgaggcattaacaatccaaacatgcctgagtttctctgttgacattatattcttttaaaatagggtaaaactttcttctcatctaggcatcaaatcaactgtaaagattttgtttaaaatctgtgagtaatttagtagtgtcctagattcacagtgatgtccctaaataacacaaaatatgttttaatgtactttatatatcagaaaagacagcctattacagttatgtttccatcaatgcattctttatcacaattacaaatatctagtttcacttttaaaatgtgcattaaaatggaacaaacttctctgacagacttttagtgatgactccatttcagaagggaaaaagccaaagggaattcttctgttgccttccggcctctcttgtgtatttcctcttcacagagtagaacttgaatactttcaaccaaccaacgtgagatgggaatttgttaacaattacataacctcagtggataacttgattgcctaatcagccattgttacatgtgtggagcaaattactaaatcatgtactcagtctctaaccaatcttcctagaggaaaaacatattaaaatctacttaggtctaacatctggtcattgtatatctatcaagtaccgtatgccaagtgtgttacatatacgacttcatactaagaacaaccttggacaagatgagtattattattattcattttacaagtgacaaaaccggaactcaatagggtttgacagaatgaactgacagaattgtgaagctaatccagagaggtttatctgacttagaaagcccaccatcagtgagcgaggccgtatgacctcattttaatcagggaagctcactggtgttccttgtatacacagatggcttgtacgggtaaattatctgtgtatgtgtgtaaccctttaaggttgtttgccttcagagactattcttacccccaaactgcctgaaaactgtaggctgttcagttaattgttgtggttgttgctgctgttgttgttgttgttgttgttgttgttcttgttgttgttgttgttatggagtctcgctctgtctcccaggctggagtgcagtggcatgatctcagctcactgcaacctctgcctcccaagttcaagcaattctcctgcctcagcttcccaagtagctgggactacaggcacatgccaccatgcctggctaattttttgtatttttagtagagacagggtttcaccgtgttagccaggatggtcttgatctcctgaccttgtgatctgcccgcctcagcctcccaaagtactgggattacaggcgtgagccaccgcacctggcctgttcagttaatttttaattcaattatttaatcaaaaatcatcaaaatttaacacaacttaaaggttctgattagatgtactcagtgacttcactcagagaagggtcctacttggcgagcatgactgtcacttgtcacaagcaaacacttccaggtcacctttcccctcaccaatacaggcaggaagtgtccagagcttcacctctagaattggcttaggcaagagagagacagactgatggggaggaaaagaggaggagggaaaggcggtgtcagggtgaggtgcagagaagaggaacttgtagagttcaagtagactgcctagactgatcctgggtctgggtcacccatccctgctcctgccacctctgcacctgctgcagttagtaccctctcctttccactgtcaggcaagcttgtcacgcaagacaaagtgaactgcttgccgtttattgcaagggaactttttagcagtgacctttaaaagcaccacatcctataggcatgactatcattcaccctttgcattgatgcaggtggctgaagtatgacaccaggttatgcaccttgggcaattaaaaattgcaaaagacagactgacactaggtgaaaaaaccaaaatagctacttcagaatcaacctccatcccgtcgctatttagagacttcttttttgaaatagaaagtgacaaaaagtcccccactttaaatgaaacctaaacatgtttaactctgtctgtacaaagaacctgacaaaaataatgtactcatttgaccttatatgataaatatgtgcttccattccatgttggtttgatggtactgttcatctaataaatacttatggagtattggacaaatgtcaggaactagattgggtattaagaatataaggaaaaaacaggatattgtcactgccagtgaaagactggctttataattggaaaggcaaacaattataggactttgtactaagagctttaaccttactatgccctggaattcttctaagtgatttaagtatattaacccaataattctcccaacaacttttcacatggttgctattattatcccccattttactaatagagaaaataaagcacagagaggttaagtgacttactaatttatttattaatacctctgaaactaggactcaaactcaggcagctgactccagagtccacatttacatccaccatggtataaaggagcagtccccaattttggcattggggaccagtttcatggaagacgatttttccatggaccagtggggaatgaacggggtggtttcggggtgattcaagcacactacatttatcatgcactttatttctattattattacattgtaacatatatacatatgttacaagtaactacatatgtacaagtaactacataactcactatcatgtagaatcagtgcgatccctgagcttattgtcctacaactagatggtcccatctgggggtgatgggagacaatgacagatcatcaggcattaaattctcatagggagcacacaacccagattcctcacatgcacagttcacaatagggttggccctcctggaagtatctaatgtcactgctgatctgacaagaggtggagctcaggtagtaatgtgagcgatgaagaggggctgtaaatacaaatgaagctttgctgcttacctgccactcacctcctgctgtgtggccttggtcctgagaggccacacaccagtactggtccatggcctgtagtttggggacccctgctataatcacctaaaataagagagtgaccctttcaggggaaccaggaaatatttctgagtaataataatagatgataaaaggccaggcatggtggctcatacctgtaatcccagcactttaggaggctgagtcaggtggatcgcttgagctcaggagttcaagaccagcctgggcaacatggtgaaaacccatctctacaaaaaatacaaaaatatctggctgtagtggagcacacctgtagtcccagctattttggaggctgatgcaggagaatcacttgagcccaggaagtcgaggctgcagtgagctgtgatcacgccactgaactccagcctgggtgacaagtgaaaccttgtctcaaaaaaaaaaaattgataaaagataggttgaatttatagtcaaagaaaagtatttcaaggcaaaacatgtagcatgtcctgaggcaacacagtttgttcaaggaaccttgatgaagtctgtaaaaaatggcatttaaagtatgtcagagaaatgaagaaaggcggggaaattacattaggaccagattggaaaaggcctcttatgctttgctgaagagtttgcactttatcctgcaaacaatagagagacagcaaaggtttccaaagcaaggaaagagaggtgaacagtaaggtggagcataggctggtggattctctccaaattatagaaaacgcaaaatgtagaaattaggtaggtttagagatgatgcatacatatcatattcagcattttgttttctaagacttatcctgaggactgacaaagagagtactggggagtgaagacagaaagaggaaacagaagacagaatggctgggaaggttgagtagtccccccttatctgtggattgctttccaaggtttcagttacctgtggtcaaccacagattgaaaatattacagtattttgagacagagagagacagagagatagaccatgttcatgtaacttttattacagtatattattataattgttctatcttattatggtaattgttgttactctctcactgtgcctaatttatacgttaaactttatcataggtatgtatatgtaggaaaaaaatagtatatctagggttcagtactatctaaggcttcaggcctccactggggaaattggaacgtaacccccatggagaaagggagattactgtacacagaaaaccattagcatgtttcatcaaatctaaggcaccatcgactgtagagcacattaattttaagaaatcctaagaaagaaaaatacttccagttaaacaccgtctgttattagatacattccaatttctcggagttaaaatgtagcagggaatgcatctcagaatctatgaaatattgtataataacttaggcaaaagtagaattgatcactggttccagccactgagtaaatgagaacataaattaattgcaaaaatacttattgagtgttgcaaaaatacttactgagtattacatggaaatataatggagatgttgagaataaatggcggttgtgattgaagggaagaaatgatcatgttttaagatatttagaaaatagaactattaggctttgttgtgctactgaatgcagatggtgagggagagacatttaagtgatgtctaagatggctgatgaggtaatgtctttaagaccaaaagggcaaaaagaagatcatgttgggctatgacatcaagtttggctttggacatgctgaggttgaaatataagtaggacttacatgtgggatccccagcaggcagttggaatattggccctagctcagaaaagaagatagaactagaggtattgattttggatgcatctaagtgatgtggtcaatgaaaccatggaagtggatgaagccacttacaaaataaaaagtctggctaagaagttatgttcacgtgaactaagggaaagcattagaaataaatgaaaggagacagattcaagacatactgtgaagatgtcatttctaggtcttgataactgatgatctttaggtattgagagaaaaatggtcccaataagagatacagagaagttaagaaatatagcagtttagttggagaagagtaaaaatttcagttctagatatgctatgttgaaagtgctgccaagacatcaagtgaaaatgacccaagaatagttgaaaatgtggtctatatttctggagatggggcaaatctagagatgtaaatttgcaaatcatctattcatagtgagaattggtgctgtggcataaaagattgccaagagaaaaaatataaagaaatagtaaaggtttcaagcatagaaccttagagtaagctatacttagcagaagtcatgtggtgcataatgaccttttgatcaatgacagactgcatttatgatagtggtccataaaattataagactgggccaggcgcagtggctcacacctggagtctcaacattttgggagttccaggcaggtggatcgtttgagcccaagagctcgagaccatcctaggcaatatagcaaaaacccatatctattttttaaaaaacacaaaaaatattagccaggtatggtgggtgcacctgtagtcccaggtactcaggatgctaaggcagaaggatcacttgagcccaggaggcaaaggttgtagtgagccaagattgtgccactgcaatccagcctgggcaacagagtgagatcctgtctcaaaaaagtgggggattataagactgtatttttactttaccttttctatgtttaaatacatttaaagtacaaatacttaccattgtgttacagttttgcctagagtattcagtacagtcacatgctaggtttgtagcctaggagaaaaaggctacaccatataacctagcagtgtaaaaggccataccatctagatttgtgtaagtacactctataatgtttgctcagtgacaaaatcacctaacaatgcatttttcagactgtattccatcgttgttaagtgatgcatgccttatgccaaataatactatttaataaaatactaaaactactactatataatggatgctgacatgtgtaagacattttacatctgatttaaaatacttataactgcataacagataatcaactgtctattttacaactgaagaacatctgaggtttagtaacattcccagggtcacagagctagtaagtgactgagtagggatttgagcctgaggctctttcttggaagccctcatgtttcatactgcacccagcctacacaaagcctatcctcctttaatttttatacattgctcttacttctttatagagtataatatcaaacccaaatgcttacagaagacacaagtaagtaacatatgagagaccctagctgggtctttccctaaggatatctggaattgtatgcttctgacactggcatgcttcttttaactatgaagacatattgttcgattccacacacaaagaaaaggttttcttgaaatatgtgatcttcttactctattctcatttttctgtattttgactgaaacatggaaacaagtatttctctaccataagaaagcaacaatgtaagatgatgttaagagcaccagatacttgaattcagttttgtgtacaataaggaatggtgagaactattgcaaaatggagagtaaaactccatctaaaaaggtggcaaacccccaaagctctgtgttgctcaaatttcagattttgtaagggaaggtggaaacttaaaatattaggtgaagcctcccattgataatgtgactcattattttaaatactatgcaagctaaagaaaaaatccctgtgggcaaaatgcacttcaaaagatgacaccacactgccttatattctcgaaatttaatatttccaattccttcaacggtttatgttgcttgatttacaaaactttatactctcctttgaacagagaccattctattcactgttcctcttaaaatatgacatctagagctaaacaaaatcatgcagcttctctctggccttctcagaattcagtgaaactgctactatttttgtgctgagcactatatgctaatgtaacctagtattgcattagctttttctttttttagcatttacaacattttactggtgcctaatgagttttagtccataaaaacccttagttattttttcacattaactgccgaggtaaatcttaactcatccaatacttacaaagaagcagcaattttgttttgaaattaaatgcaagactttacattttctctattaattttttatggtgtagatagagttgaataaactttattttatttatgtgggcccattattctagatttcaggcagagttttcaatcatctgtctctttccacagcttcaagtataaggatctacaattcattatatgtactgtgcacagatacaatgaatgttcctgagaaatctcatccaccaaggtgcacacaattttaaaaggttcaaatcagaattgatccataattagaatattacattagcctttaagaactatccccacagcaccctgcaaataaccacagcattatctgtatttgcctgccttatgtatatgcacccagagacgtcacactgagtgggacacctactgcacacagggtgtcatttcagtaatttcatctatttggctgcttctgctatcatccagaactccagccttaagtcctcttcagtgttcatggtaattaggaaattcctttctggcaactgtaaacatatgtttgatcatagagaacattctcttcctgttcctctgtttaaaagaactaacccataaacatcaatttatctggctcatgggggccttgcactccacatggcttcctttcagggaactgtgtaggctacagtatcaataatgaaagtagctcatgcatcctaaggggtcactatgtgccaagcactatgctgtgcactttatgtaagtcgtctcctatattccttgataacacggtctaaagaaggacttcacagccaaggaactaagatgtaaagaacttgagtagcctcacaaggtcagtaattgtcagggtcaattttccaaaaagcctgtctacactgaaaactctgctctttctattgccgttctcgttcctctgcaggtcagctgacccttcctttggtgtagtcaaataaattaccagttggacagcagcacccgccatcaccaatgaataccctgtgttctgtgttctaaagagctaatttggcaggcatgtatcaaaccctaaagcagagttccctcatagtccactactaagtctatactttttagcctttttaaatcaaggggagtatttttcaaacatttttctcattgtttgttaagtaggtgctttagagctcaacatacaccttcatttcttcaatcaggctgttggtaggatattgaatgagaaagaattctgggctgtgccattgttgtatgactttctatcttttttccaccatgacacagataattgacatacatatctgtatcatgttcacaatacccattgcactcctaattctgaagcttcttttccattaaaaaaataagatcacaagcataaaataaagtaagcatggtattatcgtagggacaacatcaaatcagttttactttttaaaggaagtaattaagaaatgttggtgctttaccatcggggataaattactggtgtcccaagacactactgcggaggaccacttagcttgaagcattcacagagaatttagtgggcatcttttctttaaaacttccattgttccaccaactattaattcatctaaactagattgccctctcattcttcatttttccatttgcttttacaaaaaatgttgcaagaagttgtgcggatgcctcactaaattaaaaagtatgtgagtacgaataaatatttattactttttcatccacatcaggctttgctgtcatgagatgagaataaagagaaagacctatgtccctttacctgccttagagcatgcccagaaaaaaacaatatagagagaaatccttagtaattgcttctctcagtggctgcaatctctgttgagcctcttgttttgtctttggaaatttaatgtttaattatttttaatatgtcaaaatattagtttctcaagagagaggctgtgcagtaacaggcatttggagatcattggttgctttgcaaagtggatagattagatttaaatttattttttaatgaatcaagaaatatccagcttttacatttaataaataagaaatggcaaatgaacaaagggaaatggtgatgtagacagaacccggcggatacctaaatttctgttgagggagatttatccctgtagtttaagactttgatataaagtaaaaggcaaatatctagagaggtaaccttttggctatcattggtcttttgtgaaggagttggacacaaattttgataagaccgtagaaagagaggaatcttatactggaatccctgtggaagtgagaggaaagcaataatagggttgttggttttttttcattatcttcaaaatttttgctgactagtgtcccattattgtttagaaacgtaatttttcttagacaagtatcagctaagctcatttaagagaagcttgctctgggtgacatttttgctgcatttatctttagaaacaatttttaactctgtttttctatgtcatttatggctgaaaattataattgaacagttagaaaaaatctctgttgattaattacatagcttatgtggtatttaaatagccaaatttattacatatttgtagcttgagagtattcttcacaaataaaagcttttttctgggctaggcaccatcccaaatcagatttagaacagtgttgcaaaggttttgttcactaaatgtattccaaaattataatgttctttaaggacggtatggttgctgattttatttgatggtttactgtgaagactcttcgattaaaatgtgtttcactgaaaatttattcttcaagcagacgccttagaaatttatcttgattgcaatggaagatggcaatttagaacaattatttatccttataataactcaagagcttttatcatcaagcacttgctatttgaagacctgactcccattgctaaataagtgaatattaatctgattgtttttagtccttataacataacttaatcttttgctaccctattgcatgaactgagtaaatattaaatgggagctgaattgtccaccttctccactgtttataaagatacatattaggtatgttacaatagaatgagtgctaaagcacattttcttttgaagaataatattctaggaaacttaaatttcattacttgctaaagatcacccatggaattcaattttttcttactttttctcattttgactacctgccttattgcacaaaaacatattactgtttacaagaaatcattatcctttattttcaaatggaaaaggcaaaccaaagacaataatcaaaattggatattatgtcagattcgtcaacttggaattctgagatttgattattcaaaacgtggaacagtacctataaaatttgtttttacctttgtaagccatctggaactcaagagccattagacctgcttttgcaaatcactgttttatacaaataaaacaatttttcagaaggcaatttagaattttgaaacacataccaattgtcagagtcagtctgtcaggttctgctcatcattaattttttaaaacatcaattatggtaaactctatcataattgcaatagaatacaattcaataatgaatataaacatttaatgcaatgcatagaatagaattcataagctgacaataatattggtctcttcatattctattcagggaagcccaagctctaaactgatatatacactgcagagactaggagacaaaggtaatattctgaagaagaatattttagggagaaaaaatgagaaaatgaatagccatctaggtcatttttagaccaaaattttatttaattttatttttatggtgtgatgcccaagtaatggttcaatagcatcacaaatagtcctaaaccctgggggataacatgctctccttctatttttagaaatgcaattgacatcaaaataggtataaaaatacctacctccctgggtcttgtgaggatcaaatgagatgatgtgtatgaaagactccagatgctatacaaatgttggttggattatacgggaagctttagagatgcctttgcacagtggaaggatccttggacttggtagttgaaaaaactcagttttgctagccatgttattttgagtaaatcatttaaatttaattcctctgtgtcatactttttacatgtaaaacgaggatataatttctaccacagtgctgttttgtaaatcacctcaaacaaaatgagatctataatgaaagtgctttataaacaatgaagcataatgctaatagtgtaacagattgttaatagagtacttattaaatatggcataagtaaaggaatgacatttacaacaaaataaatacaattgtttaagtgaaaaatctatgtagaaaggattgagaattgaactgagttcttctgttgaatacttaccatattgcgatctcagattccctatgaaaaggacaaagtcctgcccttgaaaatgttaggatttcaagaagacgtagggcatactttgggtatctacaagatataaaggaaataaacccaaaactaaaatttgcattataagccacttttatggttaaatctcattcctagcctgaataatactttttattgagaatcagttgtatagaaagcattgtcttatgtcctgatttctgggagaatgtgtgtgtttgtgtgtgcttgtgtgtagtggaaatggatttgaaaggtatactacaaaagaatgtaaatgtttacttctattccctcaagcttatatacttgagaaacataaaatttgataatacgaagaatcacagaataaatatcaaatgacttaccctagaatgtattactgaaacttattaagcctactatgtggaaaatggtctttaattatttttaccaaagaaacaagaaggtgaaatgtcagggactgaatatttgtggctatactttcccccaaaatctaataaattgcaattaaaacattaagaattaagaataattatgcttatagtgtaatacagcggtccccaacatttttggcaccaggggcttgtttcatggaagacaatttttccctgggggatgcagcgggctgggaatggggtggtttgggaatgaagctgttgcatgtcaggtcatcaggcattagattctcataaggagcgtaacaacctagatccctcacatgtgcagtctacaatagggttcactcaccacagggttcacaatcctatgagaatctaatgcctctgctgatctgacaagaggcagaactcaggcagtaatgctcattctccatctgccactcacctcctgctgtgcggtccagttcctaacaggccatggactggtacccatccctggcaggagtttggggacctctggtctaatacatatgtatgtacttaacttctttgtcttctagttattcctttagaaatgtaaagagacagggagcttaagagagacaactagatctggttagagccttatttgagtgaaagttgtcagattacctccctaagcctcagtttcctcatctgtgagggaagtcctaactcaatgggttgttgtaaagattcagcattataatcaacacaagtgaaccaaaaccgtgtcaggcaaatgcttgggtctcaaaaaagtgagagtttattaagtgtctcagtaatctttattcttaataaacccaccaagtgatagtttgatctggcaaagatgggacggcacacccagcactaaacttaactattctctttcacacagaatattgctagtttttactggtgacattttaattttaaatttacattttaaatttttctgatatagtcactgggaagacaaaggacagagtttgttacagtgagaaaataacacaattttctgaggtctttttcatgaaatgttttaaactggagctttgtctttggaaattcttgctcttggacatagttatcatgttgtttgaggttagcaaggatgtgattttgaggtcacaaccagacattgtttactgaatgtgtataagataaaatgagatgagagggtaattatctataggtttgccttaattagcagataacattttctaatttaacgaggcctcagtgataataatcaacagtcaagtttctaaatagctttcccatatctttgtggccattaattccctcatctttaagttttcgacattcttttcaaggcatctggaacacttgagcagcaattttccctgtttgcagcaatcaccagttgaatgcttttgtgaatgagaaattaaatgggttttcaacaatgtagatagttttaagtgagagtcccattgaaattatggatgaatcaagggacagcaggaagtctgtgattttctccatttgcaaatgtttttctaaaaaatgccatcctaagaacactttacagatattaacccattaattccagtgcctcatttttttgaagtaattcttattctttctttatggctccaaaaattcacagaagaatagttagcaaagcagcagtcaactatccacaccaaattttataaactgcattaaatgtactactattcactggaaaactcttataaaatatatacatgcatgacttacaaaagtataaattataaatggtatgaaaaatgcttcaaaatctagaaagaatgtaagaacttaggcagggaaaaaagaaatatatacaatcttatttagcgatctgcttattatcacatgaatttgtgagcagaatgatctagagaaggcctatgacatgtagtgaggcaaacaacattttaaaaactcctctggaagaagatggaatcaatgaagtttcaaattcacctgcaaaagttacaagcagatttgaactatgtgaccaaatctagctgcacctagatttgaaaggacaccatttggatttgccatatgcgcttctgagaaggagagaggtatgagtagagctttttttttaacttttaaatttaggggtacaagtgcatgtttgtttcataggtaaacttgtgttatgtgggtttgttgtacagattatttcatcattcaggtattaatcctggtacccattagttatttttcctgatcctctccctccttcacctacctggctccaaaaggccccaggatgtgttgttcccctctatgtgtccatgtgtcctcatcgtttagcccctatttagaagtgagaacatgtggtattcggttttctgttcctgtattagtttgctaaggttaatggccttcagctccatccatgtctctgcaaaggacatgatctcattcttttttatggctacatagtattccgtggtgtatatgtaccacattttctttagccagtctatcattgatgggcatttaggttgattccatatctttgctattgtgaatagggctgcaatgaacatacacatgcatgagtctttataatagaatgatttctattcctttgagtatatacccagtaatgggattgctgggtcaaatggtagttctgtctttaggtctttgaggcattgccacactgtcttctacaatggctgaactaatttacactcccaccaacaatgtaaaatcattcctttttctccacaaccttgccagcatccattattttttgactttttgatactagccattctaactggtgttaggtagtatctcactgtggttttgatttgcatttctctaatgatcagtaatgtcgaactttttttatatgatttttggccacatgtatgtcttcttttgaaaagggtctgttcttgacctttgcccacttttttatgggattgtttgtggggttttttgtacatttgtttaagttccttatggatgctggatattagacctttgttagatgcatagtttgcaaaaacttcctcccattctgtagattgtctgtttactctgttgatagtttcttttgctgtgcagaagctctttagtttaattaggtcctatttgtcaatttttacatttgttgcaattgcttttggtatcttcatcatgaaatctttgcccatacctatgtcctgaatggtattgcctaggttgtcttccagagtttttatagtttgaggttttacacttaagactttaatctattttatgttgattttatatatggcaggggtccagcttcaatctttttcatatgcctagccaattatcccagcaccattgattgaatagggagtcctttccccattgcttgtttttgtcaggtttgttgaagatcagagagttgtaggtgtgcagttttatttccggattctctattctgttccattggtctatgtgtctcttttggtaccaataccatgctgtttggattactgtagccctacaatatagtttgaagttgggtagtgtgacgcctccagctttgttcttttgcttagggttgcattggctatttggggtctttatttggttccacatgaattttaaaatagttttctctagttctgtaaagaatgtcaagagtagtttaataggaatagcattgaatctacgaattactttggatagtatagccattttcatgatattgattcttcctctccatgagcatggaatgtttttccatttgtttgtgtcatctctgatttctttgagcagtggtttgcagttctccttgtagagatctttcacctccctagttagctgtattcctaggtattttattctttatgtggcaagagtagaaatatttttaaggaagatgattcttgctcctactaaataactatagaagaggaagaatcatttggctttcacatgacttgtgtattataaataaaaaagttctttcaaattaattccatttactatgttttatatattccttccataattcacttattctattcagtaaaggcttagtctgccaaaaccactgcatgattttccaaaggaggtacacagtaaaaaaaaaatgattagaaccataagttctggagttggaccacatgggtttagatcttggctatactccttgctagctgtgtaacatggatgaactagttaatctctccaaacctcagtctcctcagctctcctattattaataaaatcggtttaataataatgtattcctccttattttaatgagaggattaaatgatagcatgttgagaaagcacttacacagtatctggcatattataaatgtccaataagtactagttattgttagaatttctggatttaaagagatcacttattttttaaaggtatcttgattgttactactatatcatgcaaatctttatctcttttaattatttatttaatgacagaaaaatactgtaaaaactgaaaaattcaaaattaattttccaagtgcctaagtaatttctaaatagagatataaacacatttaagttcacaataataattgcatttcattggagttttacaactactgcttggttctaaatgctttgaactagacagttaaacttctcatattttaaatttttttccaaacataaaatgcatacattgaataacctaactttaggtatactgagacttcattttataatgaacagttacatgaagagtgcctgctcccaaaaaaaggagttataatgcttcaattttaagtggtaagacatttactgggacacagagtaaaattatagtgaaaaatgtgaagatgctatctgaatagtgataagataattttattgtctatttaaagacaggccttggcaattggaaaatattagttaaatcttttttgagctttttgctgttattgttgtttttattatgttactagttttgctttctttcttctatcttataatattttccctaaagaatggggttagttatgtggggcaatctaatatgatggtatttataatgctctaaattaaatttttgagctaagaaaatcagtcacaacacttgagatttgtcaattttctagtgaattatagttatctgtaaacagttttgattatgaaacttctatgaaatctctcattattttgtaacttctttcccttatttattttacagactaagccattttctcttaagcctatgttagcagcatctccccttggaaatactatgatcatttgataatactgggtttcaaactctagatgcctttctcacattggcttcatagttcaattccataagtttgtgtcaagatactactacatgtaattcaggttactagagttcctgctctcaaaaaaaaaaaaaaaaaaaaaaaaaaaaaaaaaaaaagggagtttggcctgtccagaaataaaataatgtggcagaaaaggtatataaaacctcttgagattttagggaactgattaatagcatctctaccttttcacatcagagtcctgaaccaactaagaggtagaacaaagtatcaagctgctacagatcaggatagtagctttttgcattatgggcttaaatgtgtatccccaatttggttccttgaattgagcttacaattcagatcagcaatgctcccctgcaagttccctgtaagctcactatgcatctgatagagcagcatgcagcctcttaggaggtaggcagatggacagtaagaaccctaaatgtcctggactaagcgtgcttaatttcttcccccaaatttgtcagttaggccaagcatcctccccactgccccacctgggcaagatggatgaaggaaaggatcccaaaagatgtaaatgttgctccttttttcccctttagtgcatgcagtggaaattccccatcactcggttggaatatgaagagtaaaaataagtgttcccatcctaaaagagacaacatgaatttcaattcaaagaagaaagattccagatggttggaatgatcaggaaataattcagagagaagatagtatctgagaaaggcttaaaagaggaatacaaattaaacaggcaagatgaaagaaaagggctaccataaggagccttgtaaaacgtccagaagaaataactagaagaatttccaggcttcaaaaaggacccagttaacattggagtgaatttttaatgaatttagtcagtacgatttgagactttctttattaatatttaggaggcaaggataaggcagacatcataaagtgtttacagttagcaagtgccgtaatgtatatttaacttaatgtggcattctatgaaagtagtgtatcattacaatagatgttgtggagttcaggctctgttgctggacaaatgaaaccagtatctgtgtcagtctaggaggagtaaagaagggaaaataatgaacagatttatggggaaaagcagaagacagacgtctataatgaaagagaagttttggaaaatggattaatgcccagagataaaacccacactataattatgaaaatcattagaattttaacaaaaggaattttgagggccaaatagcagagggtcatcactggatgctgaaatcactaaggatgcttctaaaaatgttggcacaatgtggtgtaagctagtggagaaagatggatacccatcacagaagttgttggtgacattgatgaagaattaaatagcataaatacagaaaaaataagtggcttcagaacatgctgttggttaataatctggaagtggtattggctgataaataatatggtgacgtattctcctgtccttatagaaaaaataggctagaaggcatcagggagaaatcgggtttcaattaataaaaagtgtaacgagccttgaaaaagatttgagaatttattacaatgtgcaataaaatgtagctagtcagtaacatatgatttatgagacactagcaaggaaatgggccagagtatatatgtggcctgggaaacaagagagatctaggtaagaaaagggagttgggaactatcaatagcaaggattaagaaaatgggttgagagagaagctccaggaaactgttgacagtacagaaggtgtcataatttaatcacttcagtcctttggaatggtattgccaagtcactttgggatgttaaaaaattatattccttcaacactttataattaggaacaggaattggcatcatcctattggagcttgctgctaacaacgtgggagtttttagagacagatacaaggtcttgccaacacattctaatgtagtcacaatgccatccagtggttactttggttactttacaggtactttccattgctctttaagaatatattttattttatagttaatattcatcaaagtttcagaaagcttgtatggaaagtgttttattatatcttcaaaaatggcatagcagggatttgatttgctatgtacttctaagctaatggagttatatccagcttgttttctatatgtgttatgctctgggaaacatgatttagcctgtcctctatcaaaattaatgcaataaggaaccatgaaataatgggacttacactgtattcaattttagttctaatagaaacacaatggaaaataacatctgcgacataggcctggttgatcagaggaaagtaatggacatttgttgctgtgattttattggtgctatgggttttttccttcacggtatgctcatcagtatagggataatgtaataaatacttttgacttcactcgtatttagtctcagtttgtctgtaaggtcataatgagcaaacttaaatgggaaacattaatttggcagctgacaacataaaataaatctagctgccattagcaaggacccttcttaaaatttttataaaagcacagctttcaagtttattgcacatctctttaaaaatgtatttcaaagtaacttcagagacatctatttggcacactcaaacttttggtgatgaaattcccttttgccactaaaattcattatttgaatctccatggtaaattagctttatgagttagctattgtaattatttttctgtgaagcaaaggcaggagtagagacaatttcatcatcttatcatcatttgtatgtggaatcactaaagagtttacccatgtggaaccatgaaagtccctgatttacccctctatcagtaggcataaacatatctaaaccacccaagaaactgtacattaatattgcttctaagacctgggggttggggggtagcatccccacagtcaacaatgttaaagtgatgaaacattttaaataattttaatgttaaaataattggagccatttcttgtttgattattttcacactattggtccttaaactgtttaaatttggttcagaaagtacagagcgggccgggtgtggagggtcacacctgtaatcccagcactttggaaggccgaggagggtggatcacctgatgttcagagttcaaaaccagcctggccaacatggtgaaacctcatctctactaaaaatacaaaattagccaggtatggtggtgcatgcctggaatcccagctacttgggaggctgaggcaggagaatcacttgaacctgggaggctgaggtttcagtgagccaagatcactccattcactccagcctgggcaacaagagcgaaattctgtctcaaaaaaaaaaaaaaataccaaagtgatttggaaaagaaagtgatattgatgtaaatgatggcagtgtctgcagattttcaggggtgtaggagcaagagatctaatgttacccagaccgagtggcaaaactgaagataatgaccacaatagaaacacttcacagttcacaagagttatggtgttttatcttcactcatgtagctaaatactccatgttgatattcatttgtcaatactaaattaagctgagtaattcttttaactaaacactgatactctacaacctgcttcgtacagtacatttattgggggctttgttcttgttgttgagttctatatttttttaactttacatttgaaaaagttttagacttacaaaaaaagttgaaatagtacaatgaacacacatatacctttgcttacaccaaatggtaacctctttgccacatttgctttgactatcaatttattttttttggagtaaactagataaaaataagttgaagacacttcaacctataaccctgtaaaccttagggtttacaaccctacgtagtttacaatactactacatacttcagtagtatctcctaagaacaaaaatactttcctgtataaccacaatgtcaatcacacatccaaaaattgaacattcgtccaataatattatccaatataatctctaaatttaaattcccccaattctccaaaatttcactgataactccattgtaaaagcatatttctttttttttttatgtttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattcaccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtatacagtcccaccaacagtgtaaaagtgttcctatttctccacatcctctccagcacctgttgttccctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtagtttgcgaaaattttctcccatgttgtaggttgcctgttcactctgatggtagtttcttttgctgtgcagaagctctttagtttaattagatcccatttgtcaattttggcttttgttgccattgctgtaaaagcatatttctattcttatcattaatattctcttcccaggataccttctacccagtgtttttagcatagttggcccttgcctgaatcacttattatattgactattacaaaaaggtgattttctaattctatcatttcctttacattttgagatttttttattctgtgaagactgttctcttccttttacttaatagtatcactcagccacatagattcctttttatttcaatttttttgtagtccatcaccattatttttctttttcatgctcgtattgtctgaaatttagctgatgagagccaccagaaaccacccctgtgtctttctgacatgtctccaacagatttggggcatgttcttacttacaaaataaggtattctaggcccactttgtaccttgcctgttccagacatttgttttttgttttgttttgttttgttttttgtttttttcctatgggcaatgatatttggaaacctgcatatgctcatttttactgcaatattatttttctaggctcatttggtggacagggctatatttttcttaataatgagtacatagttatacctccaagtcaaatccaataccatagaatgtttcctcacttttctccatttcatatgtttatatcacatctcccactgtcaaaacagtaatttgtttatttatttatatttatttatttatttttgagatggaatttcgctcttatagcccaggctggagtgcgatggcgtgatctcggctcactgcaatctcctcagcctcctgagtagctgggatttcatgcatgcgccaccacacccagatatagatatagatatatctatatagatatagatatagatatagatatagatatagatatatagatatagatatatctatatagatatagatatagatatatagatatagatatagatatatagatatagatatagatatatagatatagatatagatatatagatatagatatagatatatagatatagatatatagatatagatatagatatagatatatagatatagatatagatatatagatatatagatatagatatagatatatagatatagatatagatatatagatatagatatagatatatagatatagatatagatatatagatatagatatagatatagatatatagatatagatatagatatatagatacagatttagatatatctatatagatatagatatagatatagatatatcgatatgtctatatcgatatagatatagatatagatatagatatatcgatatagatatccatatagatatagatatagatatatctatatagatatatccatatagatatagatataatctatatagatatagatatagagatatagatatatctatatagatatagatatagatatatctatatagatatagatatagatatagagatatagatatagatttagatatatagatatggatatagatatagattttttttaatagagacgggatttctccatgtgggtcaggctggtctcaaactcccgacctcaggtgatcagcccacttccgcctcccaaagtattgggattacaggcgggagccaccatgcctggctgaaaacagtagtttctaacgtccttgatctatttgccatttgctctagcctaagtttcagatttttaattattcatttttgtccttggacaatgtaccactaagggtgtctcacttaacaatgtatattgaaactaactttacacttgaaaaagttttagacttacagattatagagatacactttattcttttttatggctccatagttcttcattttatggatctatcagaatttactcaaccaatccctataatttgatatttgggattttccccaatattatgctataatgatgtactttgtgcatgttattttatattcttcaagacgtatcttcagggtgaatttctagaagtgggattgcaaagagaagagttactaaagataaatacttttgtcagatattgccaaatttccctctattagaaattgtaccattttgcatttccaccattgtccttcctaaaataaccaaaccattatttctttgaaaatatgaacaatattaattaactaatattaaaaaataaagagcttttctagaacaagcataagaattccttacacactatcctcacttcctgattccaaactcaaatttagattttataggtagaatatgccactgcagaagcagagaagactataattctagacaagcctcaacatatgtaatcatttaaagctttagtattggtattagtccattctcacattgttataaagaagtatctgagactggtaatttattttcttttttttttttaaaaaaaggagttttaattggctcggggttctgcaggctgtacagatagcataatgctggcatcttcttagcttctgaggaggcctcaggaaacttataatcatggctgaagtggaaggaggagcaggcgtctcacatggcaggagcaggagcaagagagagtgaagggggaggtgccacacacttttaaatgagcagatctcaagaaaatgaactcactatcatgaggacagtatcaagagaatggtgctaaaccattcatgagaaatcacccctatgatccaatcacctcccagcaggccccacctccaacgttgggtgatatggtttggctgtgtcccccagcccaatctcatcttgaactgtagttcccataatccctatatttcatgggagggacccagtgggagataactgaatcatgggggcagttacctccatgctgtcctcatgatagcgagtgagttctctcgagagctgatggttttataaggtgattttcccctcttcactctgcattctccttgctgccgccacatgaagaaggacgtatatgcgtcctctctgccatgattgtaagtttcctgaggcctcccagccctgcagaactgcgagtcaattacacctctttcctttagaaattacccagtcttgggtatgtctttattaacactgtgagaatggactaatccatcgtccattgtaatccattgtaaactaatccacgtttacaattgaacgtgagatttggatgaggacacaggttcaaatgatatcagtatttatgattgcatttttcttgagctaattaaaaatattaaataaaacaaagtcattcataacatagaaatttggagtggaaagaaatcttagggatttacttttatggatcatattagcagaaggtgaagtactgacaatataaaaatgattgaatgcatatcacattgtttcttagagtatggatcaatacatatagcatttttgccactttctactcaaaatacaatcttctctcccttttttttcttccagggcccccactcttctccatatcaaccgtatacctttctagatgtctaatatatttaaatagttcctgagaccctatgatctgatttctcagtttccattcccaagtagctaagtgtggcagaccaggtcatgtgactggaaccactgtggattctcctcatgagacaccaatgggctttcactgctactcagtactcctgctgctccaggcttcaaatgtctgaaattcccacaatgcccctaatcccttctctttcagttgataaccttagtttttagttcacatgaagaccaacaacatcccattgtgttcctatcaattctatcatcccttttccagaacatctttattttcactcttttttctctttctcctagacaaccccacccctacctcatcctccatgctcttcctctggagcactataagtcatctccgttttaatttataatgttttaaatctttctcacttctggtaacttctctttgtctacacacatgtataggtctgtaacattctaaagacagcttttcaccatgttaccctgagttattactttgtctttgtcctttcaactgcaaaattgtgcactgttttaaaatcacagctttttactcacttgtcaagcccttgtaatccagcttccacttcataatgctgttctcttaaaagtttctagtgacctctaaactctaatttcaatagtcttttactggtcttcatcctccttaaactcactttaatgtttggtactactgattggtctttttttaactccctttctgtgattttttgggacactttggtgtcatggttttcttcctaaatgctcttattctctcttgttcattagtttgtcccaactcctaaaattaagcatttcctgaaacatcttcataaagtctacttgagtaattgaccagatgaacaacaagttgaggaccatccatgagaatatacctcctggactgtgaaaatagcataatgcatcctggggactcaatcaacaaagcctgagagtaaaaggagaaaaaactatagatatgggtaggtccagatgatatgcgtatagttcaagaactttattttttagaccaacacatattgcagttaattgcatcaatagtttttaactgactgaaagcagagatctgaactataatttaaaagcataaatgtttacccttcttctagcatctctgctgaaaagattttctttcaatctgataacctaaagcaaattgcataatattagtgtgtctaaactgtgcttagttacttctcattagaaatcagttctgttacttctgttacttctcattagaaatcagttctgtttccccatttttaaaggcctaacaattttaaaaagttaaatattgtgtacagataataatattgttatagcttcatttgatgtaggtcaaattctgatgcaaactggtccttgtaataatcgttcagagtaagaaccaaatgtgttatattctttttaattaagaatttaagaaatatttcatcatacattcattgcctaagtcagcaaatgtttattgtgcactgactatgtggaattcacttttctgagcattagagattcaagctagacaaacttttgtcccctggagcatgcacattccatctgaatgaattaaactggctgagatattatggtatatgtagcttacacatgcagcaccactcacttcgggaagagacaagtcttctgcagtgagtggtgctgcataggatgtaccagcttttagtgaacacagtaagttgcgcagacaggaagatatttgtcttctgtagagaggaactggttcatctttgccagtggttctcaaccagggatgatactgcccccaggggacatgggcaatatctggagatatttttaattgccacaactcagggaaaagggtgctactggcatttagtaatgctgctaaacatcccacaatgcacaggagagctacccccaaccaccaaagaattatgtagtccaaaatgtcaacagtgtcaaggccaagaaacccttctctaggctaaagggtctatgtggcttaattactgggttctttcttagaagaacatacaccatgctgttcccacagcccctctcctccctcttaccgtatagatggtcctttcaagctaatttttctggctgttttttgttccatgggtaaacagagaatgttcaggttagatatgtaccttctatttgtttttcaagctgttctcaagggtcaatcaatgcttactaaagttttcgagcaagcactaaggtagtgagttctgtgcctgctgggcataattacaggaaacaactttgtttttaaaatctcataacaagaagcacaagcacaatccacaaattacaattcctttgcagtgtgtttgtacccttagcagctcacagcagggccacatcatcgtctccgccagccaccatttttctagctaccttcctaaaatatcagaaacaacaaacttcccagggtgaggaaacatcctgtagttttgcccacatggatcagtatttttcccattctgtcattatgttgctatgaagtagacaataaattattatgaaaatatgaatagaaagaggaagtgagtcatgtaaatcattattagtattctatttcacgtgatggaaaactcacagggatcttggtgttagtccagaattcactcatgttttccctttattttaaatgctgaaaaaaacataggttgtaatgttatcattgtacttgtagaactatatgactagatatgaactaagttacttggcaacagttgagctccaaatggaacttatgcctttattagttatgtaacattagatacctcacttaacctttcaagggctcaatttggtaatatgttaaataaataaattgagctagtatctggcatgagaatcctgggtttgaatttggcatcatcagtttctggccatgtgaccatcagcaagccacccactgtgcagagagattataatgagatgagattagcatgggcattacaaagatttttgccattgctgttgtcaccaacagataattatcttgcatgtgtcttctatagcacaactgaaaatcactgtaaactatattaagagataatatccagcattcagaatatctaagatggtcagaattaggtaggttttaaaactcttatgtttcagctctttccaagtcaaatatgaataactataatccacatctaggagtagaagtaaaagaatggaaatctaatttgcaccccagtggtttgtgacatcatctttattaacatgcacgctctgagtattttagattcactgggaaactgttgatatttagaaagggaatatttctctttaaactggtaaagcttaagcatctcctctgaaaattcttctatcccaggatctctttcctgacataaaactgcatgagctgtgttcttaccgcaagagcatcttcattagcaaacagaaatgtcacctagcaaaaggaagtatcaagaagccggctctctccactatgaattgccatcttggtctgtactactgatcctcaggagcactagttatgctcagaaattgacctaagacattatttacagattctgtgaatttctaattacctttgttcacaagaagtcaatcatcagtgcttatgaagagtcacctatttgaatgacaaataactaagtgctggagatttattaaaatgaaattaaatgctacttaaattatctttcacctatccatttgcatttctatttttccgactgtttttctagcagttctattgagcctggtaaggtcttcacctccatcaggcacttttagggttgaatgcacattggagtgatctagtgtgagattttacagaacaactattccacctttccaatatcccttctgtgttagatttctccagagtacacagataataagtggccacattatatcttgttatataagtttgcactgcagaaggaatggtctgagtcttcaaggagctgacatctttattagagacaaaagacaaatatatgttaaaaaaagagtagcccattcaaaaaaagaaatcagtccattacagcaaatcttcattatatcagctaactactagcagtatggactgaaaatatggatcagtagtatgtatatagaagtgacttgaaaatatccataattacataccagttccactgaaccaagtaatgtatcatgtaatgattattttatagcaaagttaactatacaggctttttctataaaatatgtcctatatttccactaatgtccattagaaaatgagagatactctccattttttaaatcttcaacatttttggccaaaaaaatatttaaatgcaatcctgcagcatgttaagaatttaactgttttactttctgacattttaattctcaaaaatagttcatttggtgtcatagcattttttatatctttctttgttcaagaagctgcttctgtcaccttttcccctgacaccaaaggattttctttatattcaaggatcccctcaaatttacatcttctaaaactttcctctcatctttctttgcatgtgattttctggtatcttctggattttacttatttcataagtataaaatttttatgagtaatatgacataaagttcaattactttatcaattctagacattcaaattcctcttatatattctacctcacttgcatgatacctatgttagtttgtattttatttatatttgttgcacaaagccattactttgtaaaaagtattcttatactatactggaaaaagtgtagaaaacctgggttctagtcttacattgcttgacattttctttcatcaatattagaatgggaatattgtacttgattgtgttcctttgcccataactttttaattgtgtgtgttttttatattcatgggcatttcaatttattatcctccccaggtctagaaagcaaattgaacttttgaaactttttctttgagagaaaggaagtaattttattcatgatatccatttcagttagtaaaaatgtctttaagcagctaagtggctccccaaagattaaatgtccaataagtgaaaaaatcggaagtagactcctggccccctggtttcccacatcaaagactagctgccagatacatttcctcctaccagatttctcttgaaattgtaatttgtcatcttctgagtagtagacaatgaaggcctaagatttattttccttgcaagtgaataattagtgaatgtcaatttcatgtttttttcaatctgtgtgaaagtcaaaaatagtcacgttaattatacttagcaggcacttttctgtgataatacaccaattcctggagatgacaaatgtaaataatatttactccttaaaaggtaatctaatctggtattatttataagttcatttaacattgtcttccttatagataacttcaatagtgttttactaattagatataagaaagacagtcccctcatctaaacattattttatttacacttgcttttaggtttttattgtttctttattttcttctacacccccttacagcacaaggtatctcaaacctcaagcagctaccatctggcttgttttatataactctctcagcccattcaagtggcaatacaccagcgaagaataaaaagatatatattggatggagcccaagaactgcacccaaaatagctttttaaaagtcattgagcataacagtgggaataataggaaggtcttaagcggcagctgctcagagagcactggaataattctctcatcatcttgccacaggtatcgtccagaaagcaacgctcctagcacctccactttctttttcactttggtttttatgtctatctttagtttttatgtctatcactcaaattgcaacagctgacaagcacctgggatttaattcctgccggatttcatacattcacattaattttggtaatttcccaattgtaacagtgagaaccttccccaatttgggtgagcagctttaatatttcattgcatattcatgtatcacctcacgttatttttagtttctaaaagagatagcagacgaggcttcataaaagattagtaggagccctagaaatagctttatcactattccagtatatttcttttttcttttcctgagagggcagaaaaggattcccttcaaagaaggcatatttggtagtgaacaaaagggaaccttcccaagaccactagcaatctcgctgatatgttggaatgtctaattttgattctctcaagacagcctaccacaatgcccctgttcagctattgtagggcacaagctaatctttacattctgtttccttcctcccaattcttctcatttgaattatttaaggaatatgtcatgtttcattatttctacatttctttcactgaactatcaagacttgggaaagaaacacgtctttttaaaaaacacacacatgtacagcacaggttattccttttccatttcaaataatttattcgcattatattggtgtcttgtaaatttcatatttattgtgctgctttttaaaataattttttaaagtgaaatttcctattccagttccctttttcatccagagatttttataagatcatatagcatgtaatacagtaaaaaactcaacataccagaatatatttttagaatagagacattctacaaatggcaggagattttttccattttatgccttatgaaaaatggatttggaacttataaaaaatgtatctggaacatctgagtgcaagatttttgattggattttagaattcagatctatgatttaaaagcaatttcttcctttctgaaagtgtccatgtcaaattgatttttaaggagaaagaaatggtgtaatttggattttgaacccttttctcaggacttagattgttttcatttatcttgacttcctttatctttattgcatcctcatggagttggaaaagcatgtgttttcacaacttttttttacaagggttgaccacaggcaaagccataaataaggctttattctttgttccatttcacctttctagcttcacatctattcaatgccaatgtggctttctagctaatactctttttttctatcttgagggaaaagtcttaatattttgtagcatcactccaaaaaataatttgcttttttccccccacaaagagtaaggagagaaaatagttaacacaaatgaattaatcactaatggctgactttcaagtaaaaatccaatgaatgtggagtagttgtctaggagatgtaactggaaatttttcaagtccttgaaaatgcatagaagaatacagagtcccactttattattcttataaaaaccaaagatctgagtatcaaatcactaacctatttttttttatcttgatgctcaagctctgaaagtagctctttctcagtcaggcttctaacttctatgatggttgcatcaactttaatgttctaatttttagcacagctaatggagtaaactgtaactgagtaaaaagatgactagaccactatctagctttctgacttttggaagcaaccatccctttctgaatgttatttgcctcctctaaaattaggaggctcaagctatttcttaaaaaagagttctgcaataagcttcttgggtttgaattcagattctatcactttactagctctgtggtcttgtacaaactatttagtctgtctacactttaatttccttactgtaacatggagatcattgcagtatctactatagaaggaattctatcaaatgatgttggcctagttgactttcaataacttttagctattgtttgattcagaggtatgttcaagtcattatagctatgtaaaacaattaaaataactgaaaaatgtgaacaattcccaaatatttgtataatagctgacattttattaagtgtttattatatgagaaacactaagttcttgatttgtatatttcaattattcctctcagtaacacagtatagaagatataattatccctggtttacccatgaaaaaattaacctaggaaaagcatggtgactcacacctgtaatcccagcactttgggaagccaaggcaggcagatcacctgaggtcaagagtttgagactagcctggctaacatgacaaaacctcgtctctactaaaaatacaaaaattagccagacatggtggttcattcctgtagacccagttactctggaggctgaggaaggagaatcacttgaacccaggaggcggaggttgcagtgagctgagatcgtgccactgcactccagcctgggtgacagaacaagactgtgtctcaaaaaaataaatataaataacttaaataagcacacagtcacacaagtgaaaaagtgctggaagtggcatataaaggggagcgtgttttcccccagagttcactcttttaatcactggactgtattttgccttccactctggtggaagacctctgccttcagtctagatgactaatgcataattaactgcagcactacatcctgaagaaaatcaacctgtccatgtttcttgaatcatttttacaattaatatctgatttatatttcttcttttccgaacttgccagagaattttagaacatgatgcatatatatttttcaagcatgcaaatccataaagtcaaagagagtttttgaaccacagcttgttactcccctaccttctttcctgtcaaaatcacctgtgaagaatcaactttctcagaaagctcagcaacttattgagatttggcctggaattcacataaaactagataaaattagtgctaaaaggcctataagagcaccataaaataattgacatcaaaacacccacacacacacatacattttcatttcaaatgtaagaagccagagctctgaccccattgctttccatagctggcgaaaagtatgacttttgaaatcgatacattgcaatctccatgttaccatcctagtgcagtactccacagcaccggcgccaggaagaaacatcagtgtttcattctccagattaatgatctcctttcagagaaatgactttcagctattttagactatatgcccttcatttgagaagcagtttgtattcattcacttacagtcaatattcactaatatcatggattgatggagttaaaaagcttttcattagttctgttagcaaggctaatttttatagcatttgatcattttacttctagttgcccctctttttttcagaactttgtgtcccccaatcattcttttgatagagtaatatattacatgttttgtatctacaaagatgtgtccatgtccccaataatgagagcagctactcacaaaacaaggttcctgtttcttgaactaattatgcacagaaatttctacctctcacttaccaatgagataattaaaatgtgagtcttggagcagagaggattagaggtttagatgcttgtataatacatatattactggctagtaatttgtactgaaaaaaacataaatataaatatatatatatgtataaactctttgctccatttctcatgtatcttattatttgtttatttttgcagatgttattattcctaaattcaaattggtcacaggttcattcaagaaaaacactataccaacgtaactacataccaattataaaaataaggaatgtcttgatgaaacatagatatggggatagaatagatattcctgatctctaagtgtacatcaacagtagggttctttcctcattaagtttaacttaccaagaacatgtgtaaaaactctattttgctgttcaaagacattcacatgaaatttttttagtgaagtagcagatccaagtacatgaagagccttgggaataaaaataggcaaagccttataataatgattcctgctaatagaaatatttataattacactatgacatcctgtttttagttgctatgcaattaacattttctcttttcttctacttcctcttacacttatacacatgaggatatgtgggtttcattatgccaggatgactaggtagagacatttgttgatattttaagaattttaagacatttctagacttcaaaaatgcatggttagttgtttcttttttattgtcaaaaacttgtagtggacattgctatgcttcagggacttcacacatacataacatctcctttaatcctcatgtaacctctgaggacttgctggtctagtatggaatatgggacatatacctgaataaccacaacttaagacacaaaatggtgacggccatgagcaaggtacagagatcagtagccataaccgtgcagaagaaaaatgttgcttctacctgaaaaaaataaaaaaggttcctttaagtggtgacattaggagctgacctgaggggaaaacaatggtacttttaatatcaatccacccctataacttccccttaactttagatgtgtatcattagcattattcttgtgttaaaacattagggggatgctttggcaagaacctgaaatgaagacaagcgtgcaagtaaaaaggaaagagattgaaggtctaagaatgtcagaaatacctagcaaggactaggagtgagaaggaacaggagtgtgtgttttagtgaaaagagatcacataggatgaaaggaaccaaaatctattcctaaggagttaaaaataaaaggatgcagagtaggaaaatcattgtttgattctcctttgatagaattaccagttgatatcattaagacagtctagtttatttgttgcctgaattgacctatgcagatgccaaaggagaccttttgtcttcaggatgggtagggataaagtgagaagagtttaatttctgaccccatgtacaggacattggaggctcagatgctcattactcggggaatactgatgaggatgaaacaagaagtgcatcatctactgagggtctggaagtttactatcgttaatatctacaatgtggagggtggggaaaggatgcaaaggaggaagagacacttgttttgaaggtgaccaagatgacctttaccctatagctaagctgaatgaccttgctggtaggtgaagtattttgcgaaaccattctggctcacttaggggccagccttgtggattgtcattattcatagaaagacacagtgtctgctcccaacattgacctcacagtatgagagttgagtaatatgaatgaattatttattacttattcaaattttaagactcactggcctctaatagaaccaaaataagaaatttttttcttccttcttttccaataagttgatacctctatctatgcttctcacaaatggattctctacaatcaagtgattcctttcaatactgtggactcacaaactggctaattatacctgaattaagggcagttccattcaggtgattctacatttcattttacacaatgccatagccaggaatgacccaaaacaatttcttaatagcctgaaagagttccttaactttccaacaaacttcaggaaaaacacataggataattaaataaatccaggaaacaattttttaaacattttctttatactagggttgagctagacactacctaactctcaaggagtttacagtatgactttttgaagccttattttttacaaaaatgaaatagatgtataaataataaatataatgctaggcaataagacataagagatgtactagggaaataaataaattttgactgggctggctcagagaagaagaaaacagttgacttagaacttaaaccattacaaggattaggatagtaaataattaagtgggagtggaatttgggtagaaagtttgccaggactgaggaaaattgagctcctatcaatatggtgagttaattaatagagttaaaattcaggtgtgtaacccaataatttactttcatttcctggcttatcattacttatttccatactttcattttttactattattaagattcatcaaagctgggtattgtgcctcaaaccagtaatcccagctattcaagaggctgtggcaaaagaatcgttcatgcccagcagttcaaggctgcagtgagctatgatcatgccactgcactccagcctgggtagtgagaaccccatctctaagatccatcaagtcagcatggccaaaatatcttttgttcaatacatgaaaaatggatgaagctaacattaaatatcattcttatatatttcttcatcaaattccacattttttatttttaaaatgattcactttgtattgttttattttttcttacttcttaggtatttctaaatcccaatatgctctgataaataattatcatagagcatatgattttaagcagagatgctaattggctttaaaaaatacagactcatgattgtaatcatctaactgttgttgaaccccaaatttcaaattcctgctaagcactgcaactcgtataaaattattcagaaaagcagtgttttatgcagagtgagcctctgaggaaaaaattatctatagtctaaataacttttgcaaataggcctactataaaatttggtaggctgatttttcctgtctctcagtaaatctagtataacattgaaaaagatcaccacacttggtttgaagtctaaatgaaataataggcttgatttaagagccatattgtatgaaaaatataattgttttttactatttttttcctgagtgggtatgattggtgtcacctatgtttaataatgtaactactgcagtgggtctcaaagacaagccacatcagattcacctggagggcttgttaaactcagttgcaaaattctacactcagaaagtctgaagtggggcttaataattttgttattattattattattattattgtagagacgggtctcactatgttgcccaggctagtcttgaactcctgtcctcaagcaatccccctgcctcgacctcccaaaattagaattacagacatgaaaggatttttatttttaatgagtaaccagtgatgccaacgctgctggtccaggggacccactttgagaaccactgtgtacacacacacacttgaaacacataaatatatatatcttaaattaatttgtgatcatgaagggtatgtgtgtgtgtgtttaaatgcctgtgtgattgtacatcattcaaccagctacattttttaatcattagtcatttcttattatgtggcagtgaatataaccacttctaacctatagaactgttttgatgttcaaaaccagttctcagctgctgggaatgccttaaacgctaaggtcaaattgtcaatagaatcctgcctgcgtagacttaataccagtaagatagatctaaaattggcatttcaataagctattttgctaaactttaataacacaaattctgttaaccttgaagccctgattaaaacacaaataagcgagaaaatccctattgttaactgagcccattttgcatatttattgctacatcttttaatttgtaaggccatggcagactgtataatgaaatctgctctctagttgctaggtctttctttttgtcttttccacattatattacacgtaggtgctggatgtcagtgtagtagcagcttacctacatttggagaaaatataaaaacctttgaaaaatgtttgctatcattctgtcattcctttcttaactctttttcctatatttgtccatcatctgttttcagagtccaaaaattttaactagttttttcactccaccaaaatgaaaattctaactatatttatttagctatttattttttaaagaaatgctgcattttgttgggttgagtggtatatagagtctaccaggtgctttgattaattcagagttatcctttgcacaatcatatatttgaaaaaagagaggtaaccctgaaaaaaaaaaaaaaaaagagaatacagtatgaatgagctggggttggagagtttgagaataccgaagttcagaaacatggggactatttggcacccaagaaaataaccacatagtcatcatcaggttttgggactgcttatggggaggaaagaggatgcccaaagtagtttaatgaaacactgaaagtaatgatttaggaacagattaaaagatgccagattcatcacttcatcacatgatctgcctttctttgcagtctaacttgggataaactaaggaagaaagtatgacaatcaaattacctgcttttcctgtttttataaaattatgtaaaattatagaagacaaagttaaaactacatgtcgcatttcaactactgtatctatggatttcttactgagaactgtctccagtgacacaaataattttaaattgcatgcattgtttatatttaaagactacaaattctctttatttcttcattcaacaaatatttattatgcagcttctgtgtgccaagtgttagctgaaggaaatatagttgcgaacagacatctcttgcccagccaggtagttaagacatactaagaaacactaatagcaataaaatgtacatggagctatgtacatttctaattctgttgttgttgttgttgttgttgttgttgttgttgttgagatggaacctccctctgtcaccaggctggagtgcagtgtcacgatctcggctcactgcaacctccacctcccgggttcaagtcattctcctgcctcagcctcccaagtagctgggactacaggcacctgccaccatgcccagcaaatttttgtgtttttactagagatggggtttcaccatgttggccaggatggtctcgatttcttgacctcgtgatccgccctcctcagcctcccaaagtactgagattacaggcatgagccatcgcacccggctgtacatttctaattctatatctgggtactcctctcaaactcgaagaaccttaatttggaatttaatttcaattatatggaggaaaaggaattagtccaacctctataccttttcttttagtaacaactacagagcagaaatgtgtccctttaacctttgaaggggctattttccctttcaacacaacggaagaaagcttcagatcagaactaattgttctgtgattgattgatagtttccctcttgttgctacatacagcccaatgacatgcattgtacacacaacaggaggtaagagagtcaatcaattagggaaacaattagttccagtttctacaattcatttgatgttgtagatgaaattgcctgaaaatattaagagcattaaagatcagtggtgaaagctaagtaaatacatttatattcaaattttagaggcagatgcttagttgatgctgctcttctgcagataggcgatgttaatgcaataacaattacagtttggcagcaattaataaatggactgtcaaaatcagtcaagttgtgttcatggttttggaaggctgctgattttagctttgacaagatgtggctgaagtgttgctgaaaaactcaaagtgattaattaatttagaagatataattctgtgactccccttctatgggtagtagttggaaatgggggaacccaaacattcaatgcaacctgatgccttctttggggtccacatttaattagtatttatgtctagtaaatgcaatgtgtaggaatattctaagatttatgagattgatgaagttgtaaccaagaaaatatgacgcaacttggagtaatataattgatgagatcttcaagtcatacggaattctagatttagagcttttgttgcgatattagggtacaaaattcagggtggggaggaaattaggatggactaagagtgatgggctagctctaagtgagctcaaagctatgtctcatgcagagcaatgtgagagacaggtccctctcctcctccgggtaagaaagcaaaaagaaagttaataaaaataatcaagaacatttcatccaaaacagtagaaaagagaaaatgcttaagaattttactatatttcctcaaaagcaaaatataggaacaagtttaaagccataattccatcaaattttgagtttatatgttagcctattcttaataatgatcaaagctgcttaaacccagaaagtaaatcctgatcagtttcacattatcttttagtttgttcagcaaaagaataaagagaatactgatgttaacatgtgtatgtctgtagtatttaaaatccaacacactctggcagaaatgttctagagtgactcaaatttgatccctcagagaaaaagtatattttttaacaaggtaacactgttactttgatgaataaatttttttctaaaaaactctggatacaactaagacagctaagaaacatggaaagcaaataaaacatcactatcacccagaaaaaataagataatactaatagagaaaattaattctaaatattaaatccatttctagaccaaaacagaaaagaattcacattaccttattcaggtttttctaacctttcaataaaaatcttgtagaaatttgttataaaatttcattttgtaatttaatattaggaattaattaggagggaaaacaaattgatattctcagctccttatctttggcgttttagtacttacattgtctttcgtgttctaattaattttactaatccctttagctaatgaataagtaaatgaggaccaggggaaaaattcatcaattgcaagaaaagtgtagaaaattattaattcagaagtaacccataacaaccacagtgaacttgtcagtattgctttgctctcttgctaatattctaatttctgttttattattcttcatagagcaaaatgtttcacagttaatcttaacagtacttttgtttctaagccttctaaaaggcattgatttgggaatagccaaatatttgaatataaattgattttatgcaatacacagaaaacaagtattttattgatataagtggtttctttatttgtagaattacacttaaaattattttgaagcagcatgaactctctctggacggttttggaatttcatgcccaaatcaacttgaacattacttttatatgagctttttgtcttctgcagtagcataaatgcctatggatggaagtgtcaggggagtagagatggagataaaagcttcaggaaacaagatgtaagtgtgaaaatgacagaatgttcatgtgggaagaaattgctataaagcttttctttccttcattcctcttcctaaaagaaatacttaaattttaggacttcagtcattttctttcaatctggttgataatagcaggagactaaggcctactttatatattaagacagaaaatgctcagacattacagagacaggcatgaagaaggggaagcccgcatgaatttttggaatgacaaaccttctgtgctgatattctgatgtcagttgacattctgatattgattttcagacttccttcactgaggaagtagttataatctttaaccagcatggccaagaaagaaatctcaagggcagtagagacttttgctgttgtctaagttctttttatcctctttaatgccataccattcttacctctttggaaggctgtttgtcattcacaaccaattcaattcaattcagtgtctgatgatggacttctacaaagtgcatcttaatcagcagatttccacagagacttttcctctctctaacaccctctgcaaaatgctggctgaaatttttacttgttaccatgaataacagcatgattttgcagctacatgttcccctctttcaaaattgaatgctctatatccgtttttccctaccagctgccttccctctctccactgtcagcattttgtgatgaaaaagattcagttacaatatgtgccccatattgtgtaggctttattttcactcaggctttgagtcaggcctccattctcaccatagaaatgccctatcacctctccaaacaccaattctctctaaaattaaatttattctgctataacatgcaaaacctagaaatgcatccaaagcctgcttctgacaccagagaaaaatgaaaaatcacgagcaaattcacctaagtttactcacatttatgttttactcccttataacagagtaatgcaaaattaggtttatatcaatataaatacgtatcataagcactatcaaattttatactgtggtagggattgagacattgtgctgagtattgcaaatacaaatgttaataaaatcctatcccaaaactcagggagctcagagctgattgatgaaatagatacataagaagataatcatgatataattctagaaatgcattaattcctaaaagtcttgatcctttccctttcccaatataatggtgaggaactttgtttaagaaaatatgtttaagaataggtagcataaatttttttttattagaattataaagagggcttctcttcctggtgacatcttaaccacaagagattatttatgcttcctaccaaaagctactgaaatggtagaatagaagagagatgaaaagggtgaaggacataaaattctgtgcaacaagaaagtaccttaacaaatcagaaattctgaaccgtttccaagacatagaaagcattttataataattgataaagataccagatctgagaaaactgcaacccagaagtgcttggaagaaatgtgctgcagagagaggagccattttccccagctggcccttgatagtctaacaaattgccaaaggatttctgcttggagggtaattacagtggagtaatttattaaaggagaattgcctcctcacagctggacaactggctccagttcacatagaggtacttagagccactatgagggctctctgagtaatgtggacagggtgtaggagcaaacaagaagcaaagcacagtcctctgaaactcaaaagggtatgaaagagtaagaatagcccctctgccagacagaaaatgctgtccgctcccagaaaaattcctcctttaccttgaaaaatgagggaactcctagcttatctactggtacctgcccaggcacttagaaggaaagtctgtgtcaccatgtgtaatactctctcagtcaacactttcattcagagaagaagtaactggggaaagagatttgcccagtttagacaaaatctataccagtcataagattaatcaatattagattccaacatagagtttctagcttcagagtccatgctgttatccagataataactgaaccaatctacataattcagaaacataatctgtccaccctccctgtcatatatatcttgattaaaggggattttttgtaagccagataaatatctaattggtgaatcatcaacctgtacaaatagtgaaatggtaaggaaatgtattttggaatcagagggttatcacatgggtcagcccatcatttcatggagccatcctttgatcatttcccagctgtttccaattcccagagctttttacttccttcattgttgatgccatggagcctctaaaaggcttatagtaacgttcctaggatctgtagtggaacacccatgctaggcaagggtgatttccccatacgtattttttggaagttggggcttgtaaatagttgactaccttgactacctctaagtgtcatgcaaagctgagccagagccaatgagagattctagccagtttcacaaataatcctgaataatttatttggcagcagctatgattttatttaaaagttgataaatctgaaaatatctttagatcctattctataaagaaaggcaaacaggcttcatcaagaaattgacaaaaatactttcagttctgtgtaagtcaaatcgatgttgctataaggccaaaggatagtgaagtagggacgcaaaaagttagccatattccaggatctgaccttcaaaattataggctcaaaaatttgtttaaagtcatctttcggtgtgactgacactacccaattcacaaggggctaatatataagccagaattttaataattgtttagtactgcgtatctaaatacaaacatgttttcttccaacgatgcatcatagtttataactagactgatgaaataaacttggagtcctagtcatcaacaatcttgagctacacaataggaaaaggtgcagatcttccatatatctgttgctttgcagtaaggtagaaatgacttctacttaagaatcttaaaaaattataatagggcttttgataataaaagacatccaacaacttttaaagtggaagtttggcacactcagtataagcactttagatcatgttttagttttcttttaatgtcataatatcaaattattgatcagtaagtatgaaaaaagtctaaagaaatgagccaactgcctgtagaatgacttcatatcagtgaaattatagtatctataattactgaataaaacatgaaaaggcaatttagctccatgtattgctcttgtcagtaagccagcatgcctgtttatcatgtaaataggatagtagttacagatcatgctccaaatcagaaactatattctttctaaactctttatttgaagatctgagatgcaaactgtggtatattcatcagtcttattaagccactcagatggcaatggcattaagtccaggcattggccaaaatgaaaataaaagttaaagagccagagataatgaccttttattacagttacttacttcacaatgttcaatgtcatgttccaatgtgagatggtgactcaatggtattttataggaaatctgttcttaaccccgctttcttaaagtggtgtgttctgggtttgtcaagacgaaggaaagatgtgaaaattcgccatggacatatccctaactttattaaagcgtgacttgttgaagaaacagaaaataaattgtttcttactaagaaacaaaagcaaagaagaaagagaaggagtcagggaagaagcaaaagaaaaggaactcactaagaaacacatggagattatgccatgtaagaatcacaatagggcacctgcctttcaaatattctttccagtcctccaagtcccccggatttatttgtagagtactcctagtagatcaaggtgtacttgtccactgcttcctcacttgcagactttgatcaatgatggacacactaaaaggtagaacattcaattggaatgcaatatataaaactgaacccttacctaaacgtttcaaatcttttaaagcagcttaaaccaatcgcaaaactaattttcttataattcacatcaattcaattcatatttatccagctccacaggatgcagggtgctgaacttcaccataatttacagaatgtagggaagacacaaccctgttttgaataggaaaaaaatgtaatgaaaatctcttagacctattgggaatcaaaagctaggagtcagaggcacatgtaggtaaagagtattagcaacaaggcaagttagcttcgcctagtagataataagcctatggaaaaaaaaatttttttattgtgaaaatgagattgttaagtatttgtgtatgctcgtttttggcagatgtaatacaaactgaatcaaaccgtaagggaaatgtattattttccattacaagaagtcccaaggtatggttgtcgtaggttgattaacacagctgctcaacggcattgtgaggttatggttactttcagtttatagctcgctgtccatagagtatctatctgccttccctttcaccagattctctcatacttacgacatggctgcaagcagttccaggtaccacaggcaaacacatcaccacccagcaaaggagatactgcttcctctgtacgtctttttaaaggttagaaaaacatttccagaaatcacccaacagaattcctcttatattgctacacttccaaattgactcatatgcccttgcctaaaccaaccatcggcaaaaagaataggatttccatgatcaacatatagactaataagattttcttatgaaacagggataaggtaatctccccaaagcagtacttgtcagaaaaaaaaagtggggttttatcttaaattgaaaggaaggaatagctgttaggtaaaaaaccaacacactgttaggtaaacggccaacaatcttgcttgttattttttcgtagattgtagatactgttcattcttgtctcatgtccccaaattaattcattggcacacaacagaaggtagaatttggggagaagtctcctgtaattatttatactagagtatattttggattttaaccatctgcgtacatggctgtatccccagccattcaaatagtgaatgaattacttgagaattattcaaagcacctagtataatgttggacacattgtagacacacagtttattcattcgatcaacatttatctattcatttattagtaaggcagacttccatggactcagagctggcctgtttcaatttaaatcctggctccaccacttactagctgtgcaaactttggcaaattctctcatctataatagagagacactgtaataatattgcctgactcatgaggtttattttgtgagcattatatgagcttagatgtttaaagcacttataataatgtctaggtaatagtatagcttaataaatgttagatatttttatttattgatatattatttctaactggtaggttgcaacattttccatcatcctatttacctcagtctgaactgtgtatagatggattttaaagttttgcttcactgtgtgacaaaacaatgactgtttgaacacagtgtgataaaagagggctgtgagctgcaagctcagattttctgtcaagtgcctgcagctcagaaacagcaagagttcagagttgagtttcagcaaagcaacggagaaaggaaattccaaattatttatctgtaacttctataaaaaacactgagagccgattggcttgcttcaactaagctatatctcttcataactaccaaaagcatctagtaccatcttactatacaaaagttagagatcacttcaattaatattctatacaatgagtacagtcactaaaaaaagctatgtcaaattgatccatggaagatttcagttccatctctaggcctttacatctccctcttctatcaaaaataaattaaaaagaaaaaagagagactttgctcctgttgtaactttttttttttttttttttttttgagacggagtctctctttgtcgcccaggctggagtgcagtggtgcaatctcggctcactgcaagctccgcctcagttccatctctaggcctttacatctccctcttctatcaaaaataaattaaaaagaaaaaagagagactttgctcctgttgtaactttttttttttttttttttttttgagacggagtctctctttgtcgcccaggctggagtgcagtggtgcaatctcggctcactgcaagctccgcctcccgagttcacgccattctcctgcctcagcctcccgagtagctgggactacaggcgcccaccaccacgactggctaattttttgtaattttaagagatggggtttcaccgtgttagccaggatggtctcaatctcctgacctcgtgatctgcccgcctcggcctcccaaagtgctaggattacaggcgtgagccaccgcacccggcctcctgttgcaacattttttaaaacactgtaaaatacacctgaagtttttataatgcatttgaaaaaactcatatcttttcttgattatgaacctgccattcctactaaaatcttgggaggctttttagagccagaaaaattctacattattcagtggcacttttaaaataaatatggtttttgaaactgcaatgatattttatttatagagaaatgaatgcgtaataagtggattatcagcaaaacaatgttaaacttgtgaattcattaatgaatacgtttttagttacaattctgatgtaccatatttttaagattcacatccctattgtaggtggaaaatgttcaggtttgtataaaaccttctgattttctgtatatcactttagtaattcagtacttgaattttctcttggatatgttttgccagtttgtttccattcttttattctcaataatataggtccaaaggggaaaataacatagcaatgaatatagttttcacttggctcatggatttatttttattttggctagttcttctgaaattcatgttgactacaattgctaaatataattgtaattgatcttctgagaacgagaaacacagtttgtttaaattttttttaagttttccctttccaatacattatttataaacaatactcatattttctcctcattctttaggaaatacgtatttcatgtactctaagagaccattaactacaagatgcaccattattttatatagcactaaggaagcatgttgaaaacagtttcaaaaatggtttcatataatttgaattttattttgtattaaaagattatttagacttatttagacagatttcattttgtcactcttgtgcacacaaaaaaaacaaaaataaaagcaaaataaattggttaatgaatttctaaaatttctaaatctgttctcaatactcagatttgataatgctctttttttcagataccatttctgcaaatattgctttactgttgcctccaaaatcttccaaattgcttgactctcattctgctagttttgatggtaaagccaatattaaaaggtttcagacgacaacccagatgcagatcccttctttaagtcacctttgagtgatttgttgactggaacatcagcaggaataataactgtgttgagcgtacgttgagcaaataacaactgggcctggcagacagtgatagtaagataccacagattttaagaaaaatccccatttcaaagatgtaaaaaatgtgaaaaaaaatattgtgaaagaatgtattcagttgagtgtttaatccatcactcaaccatcagtctccatggcattttccttagcttccatgatgggatcccacatcactcaatgctctcagttctaacagtcttccatgtgcagttaggaatgcacagtgaagagttactgacaaaattcattacttctggctataaattcaaatgatccagaaactaacaagactagtgactccacacagtaggttttgtttctcataatactttcttgattacaaggtgcagatacttagatcatcatcaagtgggatactatgtagtgaaactcagatcgaggtgaaaaccaggccaacagaagtggagtaactgcaaggatgacattggacagtgatcacagatgtgagccctgggatcagatagccatactggaatcctggcttcaccacttattaactctgtgacaatgagcatgtttatttttttctctatgccttagtttcttcaaagtttttcatagtttaaattcctagggaatgattcttattgcctaactcaccttttcatgccaaacagtgtcattggcctcagtccaatgagctgccattgaatcaggtacacattcctcctcaaatttgctgtgactatgctgtagggggtggtcacacaatgtgcatgagctctttcccacctttagagccatgagaacaattttactgaaaaggagctatcgatgggcacacactggatttcatactttgagtacatctcccacccaccacctttaggatcaagggttagatccatctctcctcagagaaaacaaagttttttgtttgttttaatttgatttgattttaggttccaggatacatgtacaggacatgcagctttgttacataggtaaacgtgtgccatggtggtttgctgcgtccatcaacccatcacctaggtattaagtccctcatgcattagctgtttgtcctgatgctctccctgccccaccaacaagccccggtgtgttgttcccctccctgtgtccatgtgtactcattgttcagctcccacttatgagtgagaacatgcaatgaaaaacaaagtttaaaaaaagaaaaaagatatagagatgttaaactagttgggccagcttggaaacaaatctagaaaaaaatgacactttttgacacaggatgttattatgatttttaaacaatgaaaattaggattagatgggaaaatagctaaattcttaatataaccagtctccttccatctttaagaacgacggctcctaagcttttgctcaacttcaagagacagggatgggagggaatgaacactggagaatctagcaaactacataagaaaaaacaagaaagaattctcattaacaatatgaaatttgcaagttggtaagtcagttttccaacctctggaagtaggattacctagctacttaaacagtttaacccctggtttttaacacaaacatttgccttttaagctatttgttcattttgagaaacttacagctgcatctctctgcacgtatcctttttgggcccaaatttcctaattcctggtcctatttgctacttcttcttcatgctttcccacctgcttcctggaaatcagagtcatgttcccaattatctaacaatgtcaagaagataactatgagttgtaatttaccactattggtttcaggagatgacattgtgggggcatatttgagtttccataatgggaggaagggtcagcaagcagaaactcgtgggctgctttaatggtgtgaattgatgtcttattctcctattctccaactgcacacaaagcataaagctcactaaattctcattacttacatcaagtctttagtacatggtaagtgagacctaactaaaaatgattcttgttctcccattagggaaaaaaataatcaaagaaagaaaagaaaaagttaagaccaaggaagggttataagaggaaatggagactgaagcatttcgatcagaatgagaagagaggcagacaggagagagggatacgagaaggaaagccaatagggcttaggaagctgcggagaatttctgaagaaggaagagagaagacatatagtagggggaaaagagatatttaaaggggattcttaggaaaggcagctggtgagcatgcaatatttccttctgcttacattcttccaaagacatcttcagcataacacctctacacacctcttcaatgtttgtattgtgggatttgtgacattgcggaagaatgtttgttctcttcttaaagtaaacctaagaaggcccagttatattcaatttgcaaaagcactatgagaaatacttcctggaaggcatactctttaaaaaaaaatctccctacacctctgaggaaatttttgtgacttgttgaatgggtaaaatctggaggtaactagatccattttggaaaaaatggaagaatccaggcacctgggtgttttaggttagccaaactgctgtgcttccagttgttgtaaggtctgaaaaacaacctttcttcagtagctgtttctttggaactactgccataagtcagctctcatccatagtgacagggctgttcaatctcttgcttcccacttacttccctcaagagaaattatgtttgaactagacagaagatacacctcaagcctgacattcaaacatctgcaaacttatggaggattttgatatgctgctaggctttacttaactgcctaaggatctttggatttggaaagaatttaaatgaaagctttgacagtggttcattttttttccaaaaatatttcagagtaggtgttataggtcagattccctgggaacctgctctcaatcagaggtagtttactaggaaatgttctccatgtaagaaactgaaggaagcagatgtgcagaaggggagatgcttgctgaactgatatgccattacaacaggctttagctgatcctgcagtgtccttcagagatgaactaaatcgaggccagcatccaccactcattgtgtgaaggccattcctgggtaagggggtttaaccttcagcaaggcagctgcttttggtcaagggcaatttctctggagtgactccctggctgtgagcaatcagcaggcagcactgcctgaagctgggggaagaggctgaaatccttattcttgaaagccccagggcatgggaagaactgaatagacctggccctcacttacggattctacctatacccacagcagatcaaggaaaacttggatggaataaaatcactacattctgccctccacctcaaaatatactctaacaccttccataatatctcccagcttctttttaataattattccaagagttagtttcaatatgggacttttctgcattagaagactttttttagtaatattttttcgacctcctcctgtatgtgctttaattttgcatgctattgttataaaatacaatacttaaatagagatggaaataatgctttgtctaaaaatcatgatgctattgcagtatagtagactatcttactatgtaatctgagaaatctatattaatttgtagatctagagataggtataattaaagtcctactaagaagaataatttctaagaggacagagggaagttgtcatagcaatcaaaatcctgattttcctcattttataccacaaaactataaactttttttcatatctcatttttttttcatttttcgtaacttattggtgtacaggtggtatttagttacatgagtaagttccttagtggtgatttgtgagattttgatgcacccatagcccaagcagtatacattgcaccatatttgtagtcttttatctctcacccctctcccacttttcccaagtccccaaagtttgttgaatcattcttatgcctttacatcctcatagcttagctcccacatatcagtgagaacatacaatgtttggttttccattcctgagttacttcacttagaataatagtttctaatctcatccaggttgctgcaagtgccgtttattcattccttttcatggctgagtagtattccattgcataaatataccgcagtttctttatccactcattgattgatggacatttgggttggttccatgattttgcaattgcgaattgtgctgctataaacatgcatgtgcaagtatctttttcatataatgacttattttcctctggaaaggtacccagtaatgagattgctggatcaaattctagttctaacaaaagtataaattttaatgataccttcatatcttttctacattgtattttagccagtggccattttacatattggttaaatatgtagctgcatcattcattcttgagatttagcttctgaattacattttaaagttttttttttttttttgaaaatctgacattaggaaattaaacctcttctgcaagatccagttttctccagaataaaagttttaaagattttttttctttttgtaatttaaaataattcaggtttacaatattttgagaatgtagacatataggggaaaagtgggtattcttccacaaggctaacactttgtaatgcatctttccagcctcttctctgcaaaagatttcttaaagaaaaactggacactttatatactgtctcataatttgtgtttttacctaacactcccatgtatttccaggtttatagatggctaccttttagatactttttataacatcattttatagatcattataattaagaggtctctctgttggataatttctggcacttctaatattgtaaataatgttactacaaacatccttatattaaattgcttttatatccatttaagattaattttttattgagaatttctagaagaaaaatgaccctttcttttttttattattattatactttaagttttagggtacatgtgcacattgtgcaggttagttacatatgtatacatgtgccatgctggtgcgctgcacccactaactcatcatctagcattaggtatatctcccaatgctatcccttccccctccccccaccccacaacagtccccagagtgtgatattccccttcctgtgtccatgtgatctcattgttcaattcccacctaggagtgagaatatgcggtgtttggttttttgttcttgtgatagtttactgagaatgatgatttccaatttcatccatgtccctacaaaggacatgaactcatcattttttatggctgcatagtattccatggtgtatatgtgcctttctaaactttttgatgtgttctgttagtttggtatctataaagtatcctcctaatctagtctccttcctaattgcccagtttcttgtaccctcaccttcactatctatatttagccagatttataaatgaatatgttatcccactgttattttaatttgcagttctttatttgtgaagttaaattttttaagattttgcttttagtttttgtcaggaggtagaggagtttgtatttctttctttgaaaattgtttgtgctgctatttacaatagcaaaggcttggaaccaaccaaaatacccatcaatgatagagtggataaagaaaatgtggcacatatacaccatggaatactatgcagctataaaaaagaatgagttcatgtcctttgcagggacatggatgaagctggaagccatcattctcagcaaactaacacaggaacagaaaaccaaacaccgcatgttctcactcataagtgggagttgaacaatgagaacacatggatgcagggaggggaacatcacacacccggacctttcaggggtgggaggcaaggggagggagagcattaggacaaatacctaatgcatgtggtgcttaaaaccaccacagcacatgtatacctatgtaacaaacctgcacattctgcacatatatcccagaacttaaagtaaaatgaaaaaaaaaaaaagaaaattgcctgtgctggactttcttttagaagataatttaattttctattcaataatatttttcttgataatttaattgtctattcaataatatttttcttggtatatttcaggatgctgaattccactttaacaaactaaatgactgtgtctctaaaattaagtactatgtttcctttcagtaagatgacttgtgtcttccatttactggcaaatagattcaaaagaaaatcataaatacttcttcagtactgatttaattgtttaatgatgcttaaatgttattagtagagtagaccagtagaaggaaccttggatcaggctaaatctgtgtaggaccaatcacttaatcctgggaaagccacactccagttacttctgtaaaataagattgagttacttttcagggttgtaataggaattgagaattttctccttaaatatcaacaacagtattttggcacaaagtaggtgcctaataaatggaatcattagtattagccccttttggtgttattttatattaatatgtcctttattttagtggtttttcaaactgcaggtatcaaatcatgagtggattgtgaaactaatgtacacaactttgagatacaactagaattttttagtgataaagaatagagtagaattgaatttatccaagtatttcacagaagtgtttttatgcgaaacttctcttcagtatataatatctaggcagacagagtgtatatactggatgacaatgtaaaataacctcttaactatgggttgtatccaaaaactcctccaaaaaacaggattatattggatacttgtctcatagtttccaagtcttttgatactatagtggctaagacaccttggttcaaatcccaactccattaattactactatatgactttaactgcctggcttttactgtataacctcctatgacttactttcctcacctatgaaatgggtgataattattaacgagaataatatgaaatattatatgctttaatatgtgtaaaccacttagcgggtgctcaataactgttagcttattttttaaagactgagtagaatatctttttttctgaataagcaaactatgtacataaaagaatataaagtcatcaggctgggcgcctgatggctcatgcctgtaatcccagcactttgggaggccgaagcgggcggatcacttgaggtcaggagtttgagaccagcctggccaacatggtgaaactccgtctctactgaaaatacaaaaattagtcaggtgtgttggtgggtgcctgtaatcctgactactcaggaggctgaggcagaattgcttgaagccaagagatggaagttgcagtgagcagaaattgcaccactgcactccagcctgggctacagagcgatactgtgtctcaaaaaaataaaaaacaaaaaatgaagtcatcacattagccaggactgaataatcagctaattttttcatccacaaaatgatgcctcctgataagcattttatttccataaatatgaattttcaagaaccaagtaactattcttaggtttgctatttacaaacaatattatctctcaagatatgaaggaataaaaataaaacactaggcaatcccttagtctttgtcagtatattagatcctcaattacccacaacatttttgtattttatgatttttttaaatttcacagtggtatgcactaagtaaaaagaactttgtctatatttcttacaatctttttttgattaaaaaataagaattaacagggatgatatcattggctggtaagagttaaaagcttatagctcttacttttctgatgaacaccttccaagggtattttatgtctatagaggattggtttggaaattatagaaacattctttgcttcccttaaaaaaaagctgggtaactttaagaacattttctaaatgttgaccctgtttagcaaaagtcttattgttcctatagtcttttatgtctttcaaactatatgtagaaattttttatgtacaattataagctggagtaaaatgaaaactatttagcaactcaagaagtgaaggaggatccagctatcagtacacacaaaggctagaaacaactgtgtaatcacttgaaagtaggagctgaacatcagtctgaatgaccagcaacaatatcccacctctacaactggacaaaaattaagcagaaacatagttgagcaatatacctttaatgtaatgatggagctattgtacttagctattttcatttaactcaatcatttcctttaaattctacagtaagccataagtcctcaaatatcttcaactatcctgtacagagataagtaataatgtgtgtcacatctggtgtttctcacagcaaaggaaaaattaattttttgaatacgtgcctgtaataatgtgtgtatatgtgtgtgtgtgtgtgtgtgtgtgtgtgtgtgtgtgtgtacaattttagtctggctgactcaatgaaatacagaagttaggacatcattaatatcaacagttttacccaagttgtatcaacagagcaaacaaaacttcaaagttttccagggagatgagctcctaaactgaacaaaatcagataatcagaaaaagcttctgggacgtgacttgagttggaaacaaaaaatttccacattctggacaattctgggaggccaagtgctattagagatgtgtggataaatcaattgatcaatcaattgattgatccactggtagtctgttccattgatccactgatctctggaacaaactaatatgccagtggatcaattgaacaatggagcaatggaacaaattaatatgccagacactatgctaatttttttgcataaattatttcatactcataaaaaccttacagatttggtctgattatcctcattttacaaaagaagaaactgaaaaacgaagaagatctgagccgatatctgtccaattctaccctttaggattatattggtagctagtaatggaaaattaaaaacttaaaaaagagaacaaggccaggtgcggtggctcacacctgtaatccaaatacttgagaaggctgaaaccagtaggatcatgcgagcccaggagctcaaggctgcaatgagctatgatctcgccactgctctccagcctaacaacagagcaagaccctatctcataaaagagagagagagaaatagtcaattataaaataaaaattcgtatctatgtatatgtgttagcctcagccatgatctcctggaagtagatccaaaatctctggattttgattaagattttaataagaatcttatgcatctgagattattctattttcaattgtactttcactaaatatgtaactatgcatgaccaactcacaaatcgtttgcatttctttcttttttttttttttttttttttttttttttgagacagagtttcgctcttgtagcccaggctggagtgcagtagcacaatcttggctcactgcaacctctgcctcccgggttcaagctattctcctgcctcagcctcccgactatctgggattacaggtgcctgccaccacacctgactaatttttatattttagtagagatgaggtttcttcatgttggccaggctggtctcgaactcctgacctcaagtgatccgcctgcctcggcctcccaaagtgctgggattacaggagtgggccaccacgcccagactaaatttcatttttaaaaaaatcttgtttgctggttatctccacgtctttgcaaattaaaaggtttttataagttcgtctactttcctgttaagaacgtgaagtgaatcctgtccaggcctctttacttatctatttctgccccaaatcatgcccattctttcctcagaaagcctgaaatcttaagttctgcaggaaaattacaaagtctggaatatttttagaatggagaatattcgttcatttctactcccttagaataccttccttacatttgtaccttcacgtgttctaagaaaaatccaggaagggcaggttttagttcttcatatttcagaaggtggataaattaggatgtcaaatgccctgttaaagtttatttaactagtgaagaggatgagaactgatgtcttctgaattcacagctgtttgtattgattactttattaattattttggcatattttggaggtaaacaaatacttaaaataattgaatacattaataaaataaaatattctaattaaataagctaaataaagtaaaatatctaaacttataagttatgtttcattagcagcaccttgatatatatagtcaaccatgccacatttatagtgacttaaataattacccagcaagacaagtaaattattgatcagagtattgtttacaataaatgtgaaaaaagtgactggggtgaaaacttaccatcaataaataagattcaagaaccaattactgtaatatattcataacatcttagagtatcaatattatgaataatattacttataaccatttttaaagtcactagcattttgagtacatgttatcatttatcaacatttccaatacaaatattttatctctttcttccttttagaaaatacaaaatatttaaagtataaagcatgtatttcatcaagaattgtttcatacacgttttggtaagatatgggttaaaagttaaatctacacagcaaataattggctgtataaataactaatagatttgacagtatacatagtattgctggaatagaatgctattcagtaactatgtctggtcttaccttctggggaagaactcttcactcgctgtggttccataaatatttcatttaccaacacaaagcaatatgctaatgatggactatttacccagtgagcaggtgccacctctgatgttgtttcatctctgggatacctttgatgtgggagcagttaagccattttgaattgttctgtctttgcttccctcccctcacagcttcacctgaacctaaaatggtgagcgagagtcaccatgaggccctggcagccccgcctgtcaccactgtcgcgactgttctgccaagcaacgccacagagccagccagtcctggagaaggaaaggaagatgcattttctaagctgaaggagaagtttatgaatgagttgcataaaattccatgtgagtattctatattagtacttgagtaaaaataagtggttgaaaaataccccatccattggaaagaaagtagaactccgtttgatatactataaatttacatttaatttattactatgggaatgatagtatcccaatataaaatgaaatattcttggaaatggaatattcttcttgtctttaaatatacttcataaatgaaaatccagtttacaaaaaaaaaaaagtctgcagcttgtatttaatacaggtaggttgttttctttggtgtctgtttctctcaagaatattaatgtttatgggttctgttatatttattttggatttgcatttatgaaattatttcattgcaaagattgtttctgaacaatagctaaggtttgctttcccaatatcgcaggtttgattttctgtcattcatttgtcatcatttaaaaatcttattgttattttttaaagtttccttattgtcattaaaaaaaactgcacctaagtttatttggataagtatagcactaagtctaatcagtgacatttaattttttaattttatttttacactgacagataaaatcatactattgtacaacatgttggctatcattaataatatatctatggtgtattccagaaaaatgttgagagtgaatataaagtgttctcaccacaaaaataactatgtgagattatgcatatgtcagttagcaggattcagttattccacaatgtatcaaaatatcatgttgtagacataaacatcatgttgtgcaaaagatctctcgaacttatttctcctctgtaactgaaatgtattcttagaccaacatctccccaattgccacctccccacaatcaccacagccactggtaaccaccattctactctctacttctatgaaatcaacttttttagatttcacatatgagtgagatcatgtattatttatgtcctgtgcctggattatttcacttaacaatgttcaccaggttcattcatgttgtcacgaataccacgatttcatttttttatagctgaatggtatctctcaagtggatgtaccacagtccattcatccactgataagacacttgggttgattccatgtcttggctattgtgaaaatttctgcaacaaacatgggagtgcagatatctgtttgtcatattgatttcatttctttggatacataccgggtagtaggattgctggatcatatggtagttctagttttaatttttaaagaaatctccatactgttttccatagtggttgtagtaatttacattcccaccaacagtgtgcaagggttcccttttctccacatcctcgccaacacttatatttgattttttgataatagccattctaacaggtttgaggtggtatttcattgtggctttaatttgcattgccttgataattagtggtattaagcattttttcatatttctgttgaccatttaaatgtcttcttttgagaaatgtctagtcaggtcgtttgcccttcttttgattggtttatttgttttcttgctgtttgaggtccttatatattttggacattaaccccttatcagatgtatagtttgcaaatattttctccccttctgtagattgcccctttattttgttgattgtttcctctcctgtgcagaagctatttagtttgatataatcccattcgtctatttgcttttattacctgtgctttttgggtcatatccaaaaagttattgtcaagaccatgtcataaaatttttatcctgcattttattctagattcataattttgaatcttatatttaaatctttaattcattttagttgatttttgtacatgttgtgagatagagtatagtttcattcttatgcatgtggatatccagttttcccaacaccatttactaaagaggctgttctttctccattgtgggttcttggctcttttgttgaaagtgagttggcagtaaatgtatggatttctttctgggttctctttctgtttcatcgtctatgtgtctgtttttatgcttgtaccatgctgttttgattactatagctctatagtataaaactataactctgtactatatttcgaagtcaggtagtgtgttacctccagcaatgttctttttgctcaagattactttggctatttagggatttgtgtggttccatacaaatttttattttgtgaagaatgtaattggtattttgtagtgtctttgtctggcatttctatcagggcttttctggctttgtaaaatgagtttggaagtattccttcttccatttttggaagagtttgagaagaaacggtattagttcttcaaatgtttcatagagattagcaatgaagatataaggtcttcacttatgggagattttttattactgattcaatcttttgttcattactgatctattaagatactctatttcttcataattcaaccttggtaggttgtatgtatcaaggaacgtatccatgttttcttggttatccaatttgttggtatataattgttcataagagtcccatgagcctttgcatttctattgtatcagttgcaatatctccttttttgtttcttattttatttatttgagtcttctctcttttttctcttagctaggcttgctaaaggtttgtcaattttgtttaactttcaaaaatgcagttttgttgatcttttctgttgtttctgtagtctctatttcatttctttctgctctgatttttgttgtttccttcctttactaaatttgagcttagtttgtctttgtttttctaatttcttgaggttcaacattaggctatttatttaagatttttcttcctttgatggaatagacatttatttctataaaattccctcttagaactgcttttgctgtattgcataggttttgctatattgtgttttctttttcatttgtcttaagaaattttttgtcttcaagaaatgtttgtttcctttttcatttcttcagtgacccattatttattcaagagtatgttgtttaatttccatgtatttgtgcattttttctaaagtcccttctgtttttgatttctagttttatatcatggtcagaaaaaaataacttgatatagttttaatcttcttaagtttattaagacttattttgtggcctcacatacgatctattctgaggaatgtttcatgtgcagttgagaagaatgtgtattctgtagctgttggacagaataatctgtatgtctgttgggctgattagatgcagattgtagtttaggtgatgtttccctactgatttcctgtctggatgatctgtccattactgaaaatggggtgttaagtcattattattgtattacagttgatctctcccttcaggtctattaatatttgctttacatatttaggtgctccaatgttaggtgcatatatgtttgcaattattatattctcttgctgaattttgaccatttttatcattatataatgacctttttatttctttttgcaacttttgcttttattttatttgatctgatacacatatatagttattcctgctctcttttggtttccatttgcattatatatcttttttcattcctttattctgtatgtccttacagatgaactgtagacagcatgtagctggatctttttaaaatccattcagtcattctatgccttttgattggagaatttaacctatttacatttaaagtaattatcaatacttactactgccatattattaattgttttgtagttattctgtacattgtttatttctctcttttctcccatgctgtcttcccttgtggctaaatgatttttctctagtggtatgtctgattccttgcttttcattttttgtatatcagctagaggtttcttctatgtggttaccatgaggttttcaaaaaacatctatagttataacaggttattttaagctgaaaacaaattaactttgatcatgaaaaaacctctacaattttactcctctactgtccacattttgaattttttatgtcaaaatttacatattttatattgcatattcctttaaaaaattattgtggctattattatttttaattgttttgccttttagccttcatactgaatttataagtaaatgacacaccaggattacagtgttatagtattctgcatttgactgtgtacttacttttaccagcaaattttatacttttaaatgtttttgtgttaatcattagcaactttttttttaacttgaagaactccccttagtatttttataagacaggcctggtggtaatgaactcccacaacttttgtttgtctaggaaagcctttatctctcctttatttctgaaagatagctttgctgggtacactattctctgttggcagtttttttcttcagcatgttttataatattccactctctcctggcctataaaatttctgttgagaagttggctgctggatgtattggaacttccttatatattatttgcttcttttctcttgctgctctcaggatcctcttttttgtctttgatccttgacaacttgagtatatgtcttggggtagtcttatttggaatgaatttaattggagacctttgatttttctgtatctggatacttacatctttctccaggtttaagaaattttctgctactatttatttatttactttttttttcttttttcttttttttgatggagttttgcttgttacctagactgaggtgcagtggcacgatcttgcctcactgcaacctccacctcccaggttcaagcaattctcctgcctcagcctcccaagtagctaggattacaggtgtccaccaccatgcccagctaattttttgtatttttagtagagacagggtttcaccatgttggcccagctggtctcgaactcctgacctcgggtgatccacccaccttggcatcctaaagtgctgggattccaggcgtgagccactgcacctggcctactttaaataagctccccactctttgtctctgtcttcttttttatctcctatggcttgattgtttgctctgttgatgctgtcccataaatcccatgagctttcttcatttcctctcattcttttttcttctctgactatttttaaataggctgtcttcaaaatcaaagattctttcttctgtttgaccagttctgctgttaataccctctactgcattttttttctttcattatatttttcttgactccacttttcatttcattcattgtatttcttagctccaagaatacttttttattatttaaacctctattaaatgtcttattctggtctcatattattttctcattttgttttcttgaagttcactgagcttccttagttatttggaattatttgtcaggcattttatacctctccatttatttacagtcagtcacttgcaccttagttttttcctttggtgatttgtttccctgattcttcttgatctttatgatcatgtatcaatgtctgtgcatttgaagaaataggcacttacttcagtcttcacagtcttcatagacaggctttgtctgtgaaagccctgcagtagggtgtggtgctagagtgcatcagaagcccaggacagttgcagccagcatggcatcgccagagcctggggcccactgtggcaggtgaagcactggagtgggcaagaagcctgaggcagatgcaaatggaaagacactaaggtgctctaacagctggatgcagctgaagccagtgcagtgctgccagaagcctagggcccactacagcaggtatggcactggggcagaccaaagcctgggacagctgtggccagcatggcacttccagaatctcagggcaactgtggccataagagtggtgccagaagcctgaggtccacaacagcaagcacagtactgggacagctgaagccaagggccactaatgctgcctgctgctgagggtgacctgaagcccaagacaactgataccaacccagtggcgatacataccagagatcgagtttgccatacgagcctgaagcctggggctttatggtccctcctggcaccagggcaagtttagaggctcagtcaccagtataggtcttgaatataaggccgtggtagtctgcctggtactgagttttactgtgcagttgcaatgctaggctccaaagcaaagtcctgtgctcgcttccctctctttcccccaagttgacagtatctctttctgcacctgtgctgcctggggctagggaaagagtgatgcaggtgttgtagaactgtccttcctatctcttcaatgcattttttcttagtattatgctactaccagttactgtgagctttcatgtggtttccttagctcttgtgaagttattttcatgcatggatagctgttcaaacttatgattttgtgggagatggtatctggagagtcctactcctccatcttactctgcctcagtccagttgcatataatttgaatcttaaactacaacttagtcttttttcttcaagtatgaatacttactatgtactaggcactttcccaaatgctgagaacaaatatttagcactcacagagcttatattctagtgaagaaaagaagttagaaattaataaagaggaaaatatatattaataaatgatgtaaggaaaaatataatagtgtaaatgtaatagggaaggggaaaagcataaaaggttgttattttggggatgaccagggctggtttccttcataaggagatctgaaggaagtggaggagaagctatcacaaaacctggcaaatagaaccaaggcccttaggtaagaatctacctggaagagcaagaagcccagtgtgccttaagtagattgaacgaggtggagactggcagaagataaatttgaatgtagcagaagccatgtcatgtggggccttgtcaattgttctaaagaacttagattttacactgagtgaaataaaatgcctttttgagcagaggtgtcccatgatctgacgggtggtttttttgttttgtttcattttttatttatttattttttattattattattattattattattattattattattattattagagacagagtttcactcttgttacccaggctggaatgcaatggcgtgatctcagctcactgcaacctccatctcctgggttcaagcgattcttctgcctcagcctcccaagtagctgggattacaggcatacaccaccacgcctggctaattttttgtatttttagtagagacgggatttctccatgttggtcaggctggtctcgaactcccgacctcaggtgatctgcctgccttggcctcccaaagtgctggaattacaggcatgaaccactgcgcccagccctgacttgagttttttaaaagattattcttgctacagtggaaaaaaaaaaaaaagcaggggtagcaggctatagagaggcaagggtagaagagaaagcaggttgttgcaataatccggatgagagatttataagagaattattctataaggacactgaaaaactaaatgaagcatacaaggaatcagcttcttattcctcattaattagcaacttgttaatttgtctgtccacttttaagaagttcaagttgatctaagacacacacttagcacagttgtcagtaattaccattcttagcaggaagacttgtaagccagtagagatgaagatggtccaatacatcgaacactagaatgggaaacacaaaatctcagttcttgtccttgctctgctgctgagttaatggactgatacacaaactccgggtacttttgatataactttgaggtcataactaccaggcataaaccaaatacatatattatgggtgcaaactttcacttaaggaatattttatcaaaatgtttacataggagaaatgtgttctagagaagcagagaaagcaatgaacaacataaatcaaattcatatcttggcttttaacaccatcttcctctctggaagaataaacaacatgagacacatggcaaggctgataagtataggattgaaatgctccccatatacgagcctaactcatttacccatttccttttggtctttgcccaatgttagcacctccccaaccacactatttaaaattgcaatccattcatctcaccccatctttgccagtatttcctgtcccccatccttgctttatttcccaccatattacttagcaatatctgaaatatcatgtattttattattttgttttaaattgctctagcttcttccaaaataatgtaagctctctgaaggcaatatgttgggtctgtttatgctcatgcctagcacatatgaggcactaaatacatatttgatgaatgagtggattaatgacaaccaatttaacttgtatcctgagccattcctcttagactttgaggccttaatatgctgacaaatttaagcatcttactaaatcatacattttaaatttccaacacttatgaaagcatcattttaatgcttgactgtgtcataaacgttgaaaatgtaattgtttctttggtcacaactcctccatcttttagcctttctcactcagagccagctattactttattttttcctccctattcattagtaggaaagcaatcagctggaaaaaaattatctatgaaactctcctttcttttgcttctcttgggtaatctcatctttttccttcccaaaccattgtcttagtcctgtgtccctctattgggcactggaaatcagaccagataaacaatctgcttgtccatggagatttgcctttgaccagcaacctgaaataacagaatgtcaaagaatctgagtaccacccctaaaaaatattatgttgctagcactctccttgatttaacaggaagaaaaaagtaaggtaactaaaaccttaaagtggtatggtaaatcaatgttagaaaacactgcatcataaataaaagccatgccatttatttaaagtggtatgttaaatcaatgttagaaaacacagcatcataaataaaagccatgccatttattaaaagtgtgtaatagtatgtattttacactttcattttaatccgtcataatttttcctgcctatataattgacatttctaataggatttatatgcaggaggcaatactaaacaaaaataaaacacatccttaaaatcaaattcctttaggactataagatatataaaggttatcacttttgacttggcataacatactgtgatgctaatgacgggtaacaaattagaatattaattgatttcagtctctgaactaaatcttggctatctggcagatgtgttttttgcaaaattgatagcaaacagctttactctgtcacttgaaattcccacttgtaagaagaggggtgtcacaatggcaaggagtgtgcatgtcattagttgggtaatctgcacagtccagcatgaaacatattcaaaccaaattgcctgatgatatcatccaggccttaatttttttaaattaaggcttaaattttttttaaaaaaaggagaaggaaatggtaaacgcttagcatttttatctttcaattcattcttcacactgttatctaaatgaagcagacaaggttttttagaattttttttattttgcaactttgattttaatatgactagggccatggttggtctgtaaagcatgaactcatgtcatctgaatagctgtgattaaggctttgatattcatgagcttcttgaagtagagtgcacctttctttaagcacagtagaaagtcaaatagccagaacttgactcttagtccagaataagagcaagtggattaggaatagttgtataatttatgcagaaatgttattggatagacagtttaattcagaaattaaaaatacaagctctagccatagactacaagagttcaaaccctagctccactgcatactggctttgtgaccttgggcatcttaattaatttttctgactatcagtttcctcctatataaaatggggatgaaaataatactcccatcatagggttgtttggtaaaggtgtcaatgcatgtgaagtcgttagcagagtgtctggcactgaataagcgctctataaatggtagctattattaaactcaagctgtcactttaacaagtctatttctattttagaaaaaccctctattcaggtcagtcacccaaattgagaaaattccggaaactttgcagccaaatacaagtgcattgcattctttaatcccattccaatgatctctgtgttagagaaggtaaattctctcttggtgtttcttatttcatcctctcctccattttttttttttttggtcctataattttactttctctctccttcattccctttagcctacacacatgctcaagattcacatatctgataatgcctagcaaaattccatacatcgtaggttcttaaggataccagttttctacctttatgctctaaaaatttcttcccctactttacctctcccatcaagctatcattctgtctcctcccttcacatctctaccatacttatttaaaaacgtaatctggaccctgacatctgttttatcaactcccattaccaactcaattcctttcactctaatttccatcctttgcatactattaaaattgtttttactaaagtccccagatacttcccgatgtacaattacgagggttattacaaatattcagttgctcagatatttctgcattattatcactattggccttcatctactgaaaactcttgacttccaggaccactctcctttcttcctcttctttcctccccttctccttcactgactggtccttcttttgttatgatcttttctcccattaggtgttagaggtccttgttttctggggtttctcttttaatcctattccatgtttattctacatgctctttttgggcagtttcattcacctagccattcaaataaaaaaatctcactattattcttgactccttgagcgatttcaccacatattctgtacctgcattcaagttatgtgaactaccttgaacgtctctcaaaaccagccagcacttcactacaccactgtctcccctcatgattttctctcttcctggattccccttccccagtaccctaatacattgttggggttttttttgccattcaagagccagttcaagtgtcaccacttggatgagaggttccctcatttcccaaggcagaaatatatgagtcttctccaacctttcagagttcttcattcaaatctctcactgttttggttacctggggttttctgcctttctcactgaaatgtaaattagccaaaggcaggaccattttcttacacatcttcgtatcccccacatcttgaaagtgtctgacaccaaaggcattaatcaaatccagatctcttctcggcactgtgttgggatgaggaacaacagcaaagctgtccttccaatacatggggcagcctaaacggggaggaggagctgtttcctttgagactaggttaattactgctacaaacaactatttagatatcaaattacaaaaattaacattaaagcaaacagtgcggttcttgtgccatgctcggagaaactgtgatctagaaagcagtagttttcaaacctttttagccaaggattgctttgttcaaatgcagtattacatagatacttaaatgtataaggtcttattttatttcatcatcttctttagtttataattttagtttaattttgactcaaaatatagaaagtgtgtctgtgtgtgtactaccgtgtacgtgtgttttaagagttaccattaaaaacaatcctatggcagaaagttcacctaaagcagtagggttttttttattttttatttttttattttttttagacagagttttgctttgtcgcccaggctggagtgcagtggcacaatcccggctcactacaacttccgcttcccgggttcaagcgattctcctgccttagtctcccaagtagctgggatttcaggcgctcaccaccatgcctggctaattttttgtatttttagtagagacggggtttcatcatattggccaggctggtctcaaactcctgacctcgggtgatccacccgcctcagcctcccaaaatgctagaattacaggcgtgagccaccacgcccagccaagcagtagttcttaatagagatggcactgctcctacaacacagtgtaaatattttgggggtcattttcagtatattaaaaactgcaggaaactcctggcatttagagggcatggtcacaggaccctacacatcctgtaaagtgtgggacagtttcacagaatgaagaattgttctgaatcccacacaaatttcaaaagccccataggacatacatgtagatggaaaccctttctataattatctgaacctaaaactattttctgtataaacacaaagtgtttttgcatggctctcatatatgaatacatggaatagtctagtttgtattctaatgtccacctagcctttaatctccaattttcttgtgatttttaaaaaatcttctgattgtcttctctaaatctaaacatgctttttagtattacatagtttcaagcatttgattatttcattgtgtcttattgtatagttgcatctgaagatttttgtactgaaatagaattttttaaataaattactgtcatttctccattatattatagttgacaaattttattaattttaaaattatgtaggtaggtatgttatattcttatttacactttgagacagaaaaaaaggaatattataaaatatttgttatgaactggggtaatactgattttaaaaaacaaatgtgcagtaggactctatcaacattctctattcaaggtggaatgctaacaaaagtacattctactgatgctacatttcaggaaggctgtttatatgtctccttggattttgttttataaactagtgttgagggatttttataaacttccaaagcacaggtaatacagagtaacagtaagcacaaaaagccaccaagtaaattaaaatcgcaactaagtttctaaactttattcagctacattccattagcatttcaaagatattaagaaaacacacctgaggaaaatgaggggcttgaacaagattttggacctatatccaaaataattcaggaattactttgctgaaacaccatacgaatatactttaaaatagctttaacatctattttgtttttaccacgtagcaaaccacagactacattttcactaagcaaagcctgactacaaaaacaaatctacaaagatgacagaataagagaagctgggagactgctgtttctcctcactcatgactatgtagatctcttattgcattgctgatctgtcaggtttgtgctagtttctattaaattgagtaaagaatttagaagcagaaaccagagggaatgtatgagatataccattatatttttagtgcttggctttatttttgtttgttttgattttcctttataagaatactgtaataaagggatttgtacttgatatcttctgagtccacgtgtctccccagcctgtcttttgagtgaacctaggtaactttgaaataaagattaagaaaatattggcccattgaaagatttcctcactaagcaacactttcattgacactgctaccctggagaaatttcaaaaccacttgaaccctctccttttttctcttctctttcaagctgttttcacacatacaagtttttcttaaaaaaaaaagataatagtagacaacgaataatagaaatatatttgaactgataaatatgccattttctgaaagtagtttatatctgtccataaaaactcagaaaagagccaggatcttgggacaataaactataattgatttagtcatattgttcaatgccttgaaggtaaaatgttattttaatgtaaaaatataaaaaattaattatttaatgtaaaatgtaaaaaatttatttttgtaaggatttggatcagattattttaaatcagttaactattgcagtggatttaaaacactgctgttataatcacgcaaatattactacctaaattatttgttatacttcagtagcccaaaagtggtagcaatttatccataatgctgtcttaatcactcacagattcttagccaatattagcaactaaccgaggttcaggagaacattgtttgctatggtgagcatctatgaaatgaggtcatttgtagtatgagctgcaaagttggtcttcccaagttcaaaattctgactctaccattactagtgtgtgaccttgggcaaatgatataatttctctgtaaaataaagacaataatagtactttacctctgggaaggtgtgagcagtaaagtattcgtgtatataaagtgcttaaaacaatgtctggaatataatggtcacattcaaattccataagcttccactgcatatgtatagagcacctactatgtgcaagactgtatatgccataggaaggagttaaatcaaagcacataatttttctggacctcaacagcattacaactcagaacttttctgcgagaaggacttctaaattaaaatgtcttagcaggacagcgatggctctttatgatatggctcttgcatatgctctagcctcctcttcaactgttcgccctcacacagtttgctccagcacgacagttactaaatgtattatccatagtttttctttcttccaggtctttatacaaattgtctcctctgcctgaaattccttacttgccatagcttgtctacctagactccttctagttagccttcagaactctatttttctttaaagcttttccttttttctggtaccaacttcctaacccactattcctcagcaattctccctccataacaagtttatactttgcatatgtttataaattttacttttattattttgtatttacttgaggccaaggacacactgtcttttcatctttgtgtctccagttccagcacaaaatctggctcataggtaggcagaattattattctcctttagctcaaaggccctcatatcaagttatcaagaaagacttccaaagagctcttacgggaaaagggtgagaggacataataatcaaaggcgacattcactgtgaagctgaaccgaaggtaggcgaccttccagaaccattctgccatgccctctaccccactctactttacaatacatctttgctttttctctctccttttatttcttttctccctttcctcgacctttctttaacattatcatcttctgttccctttctttcctccttgcccctgctgatttaaaatgttcattgtttatttttttctctacctgtctcgtggcagccccatctaattcagagtcaagatgcaagcagccaccaaattggtcctccagctaaacagtgtcctcacccccaagcatgtttattccaagtggagatcagggactcggtgatagcttcatctttttgttttaaaaataacgaattgtattgaaatgtccagaaaataagattagttcattttacatgatgattgttatctaacatagcccagtttcctgtgttttcactgagacagttcaaaagaaacctggatacactgttacagtggcttttcctccagtgggtacttgtgtgaggtttgctttgctgagtagctgtttatacgaaacttgtgtaggtttctgtgtttcaccctatcaggcacacaaagcacagcagttcctcttttcagctacattgtcgatatcaccacaaccgtggatatcatttgaagtggtgcttccacgtggcctggacagccatcttctgcccacagtgattggaactgttctgtcatctcacctttctacagctgctgtcattcatccacctttcttttccggatctgctaatgtggctctaatgcgatttacctggctgctttccaggccctcatcagtagtgaatctgttttgctattttgcattaagtagtcttaagcaccagtgctactgacgtgaaaggcaaggtacttccataaaagcttgaatgtaataatctaacagttgagccctgcataattttaccagtgctgcaattacaggaaaacatataggcagtttcccaaagtcagttgtgctgctgttatcttccattggagattgatgccgccttgcctctactctggattacttgatttggccattcccttaggcagggatagttggatccgtatgtacaaggcaccccacacaatgtatcttactgtttattgaaaatctcgtctcccttggcttctgatactcaattctctaattctctttctttccttctaacattctttctctctctctgtctcctccaattgcctacaggtgggtactctccaagcctctgcctctggcatttttctacctctatgatttatttataatttcaggatttccaatactatatgtaaatcacactcaaaactcagtcctcaaacttgatatctctgttgaactctcctcttttgttaaattaactttattgaagaatggtttacatacaataagatgcacccattgaaaatgtatagttctatgcttttagtcatatacaagcaatgtaatcaccacccccaaaaattgcttctagttcctttctagcaatcgctgccctgctacctctagttatgggcagttattaatctgcttttctgttattacaaattagttataactgttccagcatttcactaaaatggaaccatgcacgtattctgtgtctgatttctttcacttagcacaatgtttttgcaattcatcttgcatgtttcagtagtccatttctttttattgctgagtagcatttcattgaatggatatccatgagttgcttatccatgtatttcttgatagacatttaggttatttctagtttggggctttttctttctttctttctttctttctttttttttttttttttgagatgaagtcttgctgtgtcaccaggctggagtgcagtggcgcaatcttggctcactgcaacctccgccttctgggttcaagcaattctcctgtctcagcctcctgagtagctgggactacaggcacatgccaccatgcccagctaatttttgtatttttagtagagatggggtttcaccatgttggctaggatggtctctttctcttggcttcgtgatccacccaccttggcctcccaaaatgctgggattacaggcgtgagccactgcgcccagcctagtttggggctcttaagaataaagttgcagtaaatatttttgggcaactctttaagaggacatatatttattatgttttcgtttctcttaggaagtgcctaagtatagaattactatgtctggtagtacagaagtatatttgtcttactttataaaaaagaactgccaatctgttttctaaagtggttttattatttatatctccacaggtgatatatgagagttctagttgctctacatccttgctaacacttggaattgtctagtctttttcattttagttactctagtatgtgtatagaatatatcattgtggttttaatgtgcaattccctggtaactcacaatggattgtagacctaaatgtaaaagttaaaactgtaaaacttctagaagaaaatatagacaataatttcatgaccttgatatagacaaagattttcttaacaggtcaccagaatcattaagtataaaagaaaaacttgataagttaggatttttcaaggagtcaagccttctgctttgtaaatataccattaagaaaataccaaaaacggctagtcacagaatgggagagaatattcatttcatatatagatataaatatatatgtaattaatatataaatatatataatgattatatataatgacatagaagtcatttccataatatatatattttaaaacttcttacaattcaatacaaatatgagcaaaatatttttaatagacactaaatcaaagaagatatgaatggctaagttcatgtaaacatgttcagcattcttagtaagaaaatataaaataacaatgaaatggatttttaaagctctcttctagatttgttcaactatatacccattagcaactgaaattcaccatatccaaaactaaattcactttcttttctttttcccccaacaaaacaaacacatgcatgtttcttgactctgaagctcaataccagagcttatatttaattctacccacttttggacccccattgtccaactagttagcaagtcatatttcctaattttctgtcctctctctactctcaacttccactgtcattattctggtttgagccctcatctatattgtaagagtctcttaggaggtgttcccacaacgattttccatttatggccagcccattgtacataaatctttcagatgatttttcttagatctgagctctgaacatgcaagtcccttgttcagaaacctttagtacttcccccttagctggcttttcaagttctttatttggcattcaaacctctctatagtttaaccccaacctacctttccagcctctttccagcctctcttttaagtactcagtactttgtgaactgaactaattactgttctacagatacgtgcttccatttcctgttgttttaccttagtctgtggtgttctcccatctgaaatgacattacccccatctctgtatagtcaaacctccctatcctaaaagactaagactcaattcaaatgctagctcttctataaagctcctgctgaataccagtattactcatttaatatacttttcatcttccaccaagtggtattactataagctcatatcttccttactagatttttaagaaaactgtagaggttgacccattcctacatagtgccaactacatgttatatgccctacaaggagaaaacagtcaacaaatgtttgtgtcatggataaacagcttgatgatgggatataaaatagaataagccatcattcttacaatctgataagagaaatagaatatgcatggaaacaataacaacgtagcatgtgatgcataataaaacttgtgagagacgtgtagaggagtcatcatagggtaatttggaattaggttagagaggtccatcaatatcaggctgaggttagactttatttaatagttaaagatgagccaggaaccattcaagatattcaaacacagaagtaacataattacagttttgtatcaatctggcagcagtgtgtgggtagaatggattgtgacgggggaacctggaaggagagaaaggcaggacagagagaactgaaggaacactagcgtgagataatgaaagactaaattgctagcaaaagcgcagatgtgacagactctgtgaacatgctgttgacaggtgctgtgtctgggtctgaaggtgtgtagaaaagagaaaatgaaatataatttcagagaagctgggtaaccattccagggttatgccctgtagggattggacaatacgagaaagagttgggcattagaaattgagatttctttgaccacatacaagtttaggttgcattaaataaagtggatatatgttattagtaagactacacagagggggaaaaaagacagaaatccagtgataaattcctaaaatacaaaactcatggaagagtaaagaagttgatgaagagataaatgagctgtcaaagactattgggtaaagtagaacagcagtgtgtcatggaagctaaattaagagagagtttcagagaaacaatagtcatttccatgtgaaagaatgttttttaaagtactgcttaaagtttggaagaaacaaacaatagggaggctctgagcctactccagctccagaagctgcccgttgaaaattttaagttaaaaaaaagaaataaaaatgattaaagcaggcaatctacccttatagtgttttcagtctaatggggcagaagtagcagacttcatcctcatcatcaccattcccatcattttccgagtgcttagtacaggccatcatctgtatattgaattataattttgctaaccctatacacttatgatcccaattttatagaggagtagaaagtctcaaagatgttatgcagaatacattttagtacagggtttaataaagtacatattaaagtgagatacaagtgagctaagatcaaaggaaatacaacttgtatgggaatgacagaaaaggagttaagaaagagataacctctagactgtgccttgaaccaaagaaggatttgcataaccagagagttggtaaaaagtcattccacactgaatgaggtatcatcagagttttgtggttaacagtgaggttggtgtgattgcttggtgtacaatatattgtatatactacaacttactgtaggatacatttagtggtatggctggaagagaaagcatgtgaccccgttttctaagaacttttaatgccatcctaagcaggttttatgctgcaaactctaatcctttgtgggctttaaggaacaaagtatgacccaacttttttttctttttggaccattaaagaaatagctagacatataagcatccaggcatggcaaatgcttcagatatatcacagaagattatgcctgaaaagagggccagtggatttagagctctttgttgaccttggaaagccttgtttcattagagagctggaatcagaagccaagttgcagggtgcaggatgagaagttaagaagtgaggaaacagagtgagaatgtgaaagcggtgagcgtgaactgttctcttccataagaggacaagtagaattacagctcatgcacttaacaagatgcagggcaattgggtatgtgctgcggtagtgaaaagaaggagatgaaaataaataggttttcattaccaaaggcagagctaactctcctgcctacttccaaatgctaccacatatccacacccttgatgtcattactaatccctcatatatttgcagcagaagttgcttgtgaacctgggacagaaatgttgatggcaatccaactgataatcttgaatgtgagaaatccttttggatatattcatatggctaatttgctttgactataaagtgttgctgagacctcattaacaaatttgcgatatttcccctgcttctttgatcagagtctccctgtccttggaattctccataagcctcatgcatatagcacttgccaattttatttgtatgttctagttatttgccttattcttccaaattatcctatattctgtggtggcagaaattgatattttgtatgtactgctcctatacagcaggcactaaataattacttttggtttgaaataattttagatactatgtttccctattataaatatgtgtaaaaaattgacttgtagagatatcttagttttctattgctgcataaaagtttaccacaagctattcctctgcagaactaatagccctagtataaccatgagaaaaatatcagacaaatcccaatttagagacattttgaaaatacttgaccagtacttctcaaaactgtcaaggtcatcaagaataaagaaagtctgagaaactgtcacaaccaagagaagccaacggacacatgacaactaaatgtaatgtggtgtcctggaacagaaaaactcagaaaatctgaataaagtatggactttagttaacaataatgcatttacattggtccattcattctaataaatgtgccatattaatgtagaggttaataataggggaaactaggtatgaggtatatgagaaatctctgtacagtcttaacgtttctgtaaatctaaacctattctaaaaaaagtttgttaaaaacatttgctacaatattagtggcttaaaacaacacaacgtttattatctcacagtttacatgaattagaaatccaagcccagcctaacagggtcctctgctcggtgtctcgcaaggctgccatcaaaatgtcaactagaccacagaagagggagtccaggcttttttccaagctctttcagactttttggcagaaattctgttccttgaaattacaggactgagaccctcagttcctaaagatgactctgccatatgcagtttacaacatgactgcttcttcaaggccagtggaacatctctctcacctcaggaagggcctagtcatgctttaagggcttgcaactgggctcacccaggacagtctcccttttgatgaattgaaatacaacctatttgggaatttaattacatctgcaaaatcctttcacctttgccacatagcacaatccattacagtcacggatctttcccatactcaaagagaaggcttacatagggcatgtatgcaggagagggtagagtcttgaaaaccatcttattaatagaattctgcttaccaaagatttggaaagagaatgaatgtatgacagagaacaaaagaattgttactttatgaaaaggcaatagattaccttttatctaaatagtgtcaattggcactactctattttttacaaaatttaaaggatttgaactgaaaagcatccttcttattctcattttcttctctccttctttttggtgtcattccattatagccactaaaatagtgtatttttgcagggttagcagcagcatggttattatagtggtgatatcttccagtgcagattctttagagtctgagcattgtttaaaaagaaaatgaaagctatatcagttcactattaattattctcagtctagtgaatccttcaaaggttatattttggtgatggtgatcagttcatatcaacaggttcaggaatgtctatttccaatctatgaaaacaacatagattccaggttggagacacggttccaattctaaacttttgcttaaaataaaaaaatgattaggaagaagtagagtttctgtgcttaatttgatctcagttgtacaacttgaaattatgagctagtatacatgggattggttattagaaattgctagcttgacacattcattttttaaaaagtaattatatattgcaaggtgttgatattgtcttttataagaaatatgcatctaaaaaatgtagaggagaatattttatttaaaaaagaaagggctgggcacaatggctcacacgtgtaatcccaacactttaggaggccacagcaggaggatagcttgagcccaagagttggagaccagtctgggcaacatagcaagatcccatctctataaaaaattttaaaaccagcctgtcatggtggcacatgcctttagtcccagctacttaggagactgaggtaggaggattgcttgagcccagaaagtcaaggctacaagtgaactgtgatagtgccactgcacttcagcctgaacaacagagtgaaaccctgtctcaaaacaaaaacaaaaacaaatggtaagtaaaattctgagattctagaaaaaagcgattcgtttactgaggaatgatttgcactggcaactttttttttttttaattttatttttggagatgaagtctcactctgtcacccaggctggagtgcagtggcacgatctcggctcactgcaacctccaccttccggattcacgtgattctcctgcctcagcctcctgagtaattgggactacaggtgggcgccaccatgcccggctaattttttgtatttttagtacagatggggtttcgccatgttggccaggctggtctcgaactcctggcctcaggtgatcctcccaaagtgctgggattacaggcatgagccaccatgtccagcctacactgactttgaatgtgtttcccaaaacataaaaattcatgtttttataaagcataggaaaatgactaagtacaaaataattggtgttggtgaaaacagaaaaaaaatgtatctgcattaagaaattagaaatgtattttttaaactcaaaagtagataatgtgtgctgtgggtcgaatcatgtgccccatactgtatgttcaagtcctaacccttggtacctatctgcaaatgtgacttctttagaaatagatcactttttttttgaagatcgaatcaagttaaggtgaggtcataccgaagtaatgccttagaagagaagagaccagcgtccttagaagagaagagagatacacagggagaacgccatgtggcaatggaggcagagattagagtgatacatctataagcctaggaacaccaaggattactggcaacaccagaaactgagagaaaggcatggaacagagtctctctcagagcattcagaaacagtatggccttccaatactttgatttcagacttgaagcccctaaaactgtgagagaataaatttctgttgttttcagtcacccagtttgtggtcatttgttacagcagtcataggaaacaaatataatggacgagctgcatgtggatcacctgggtccttgtgaacgaatgctgcaatgactttaccatctctgcccaggatcattgtcacccaccgctcctgaaggagagaatgtcccttaacaagaagagggttatagagcggcttgggaagctagacttcatctacttatcatcttctcttgggctagttatgtctactttggattgtgtgaggacaaggaaaactctggcctgaggaccttttgcagtgagaggcccctcccctgtgggcttgaaatgctgatttatgcactggggcttgattgtcctaatagccaccattggctgagtatgcacctagtaatatacagaaagaaattaagttttcaagcaacaagcaaagtgatatttttttaaatcatggcttctacacagaggtaaaacaatttcagaaattgaagatcagaaattgaagatagagagatttattaaccaagattattcaactgccaagtagcagggcaggattcaaaacttagccaaaactaagttcttgaaccaaccaggttgtctgctactacatactgcctcctcctcccaaaatgccagtggaagactgtgtgttatatttaatatgtaacttgtattgcacgtgtatataacttctatgtaactttacattgaaaattgtaccttgctgcttttttcctaaaatggtgtattagtcatttttatactgctatgaagaaatacccaagactgggtaatttataaagaaaaggagatttaatggactcacagtaccatatggctggagaagcctcacaatcatggcagaagatgaaggaggagaagaggcacatcttacatggcagcaggcaagagagcatgtgcaggggaactgccctttataaaaccatcagatcttgtgagacttatacactatcatgagaacagcaggggaaaaaccagcccccatgattcaattacctcccatcgggtccctcccacaacatgtggggattatgggagctacaattcaagatgagatttgagtggggacacagtcgaaccatatcaaatagtctccaaaatgttcccattttatcgttttttcatgtttgttttctttatgacttgttaaatagaatttcttaaattgccctagcacagccacatgctttctcacatttcagtgtcaagcaaaacatcaagtacagggcatatttttcacactgatgcaactttgctggtaaattaagataagaatatttattaggtctcttttgtgtttatgtattaaaataaattctaaaataaactcagcacagtgagaataaatttgaggaccttccctgggagcaagaattgctaaagcaatcgaaatcgaatcccttttccctgcttcgaaattcaagcatcgtaaagcattcttaccggcaagcaggaggtctctaaaactaaagtcactccagagtggcagagttgtcactttaaagataggccttaatgtaatgttaatttcaaacctctactccttaaatgtactaagtatctttatctcagaaatggaaaacaaagttcacagggccttccaagcaggaaaaaaaggtaacattacaaatttacttagcataaaaagtaaggaaggaggaaaggagggaaggaaaaaagagaggaagaaaaaaggaagaaaggaaggtgagatggaaggaaggagggaaggaaggaaggcaggaaggaaggaaggaaggaaggaaatacaggatgggggtggctaaattatacctaataaagcttagaatgtgatataaattttatgacatgaaaagcataatcctgtatactctatcataaagtaaaagaaagttgttatatattttacccagtttcataatgaactcttacaccacattttcaattgtgttaaaacaattgatcaattcaccttgattccattctgggcactttaacgtactgcatcgaaagacttcatactgataattattagtgttctcttttcctggccaaaaattaagatgctttaattaataccttcatcactatcattggctttgcacatgccatactctcatttactttacaatttgctaaacctttttctctctctttggaaatcttgatcctcaagaactttccacatgatttctttcatagttcttttgcattctttttctccttagaaactttcattttttctacattggcacaggaaacatcaatatttgatcataaagctaaagtgatagcctggcacagtggctcacgcctgtaatcccagcactttgggaggccaaggtgggaggatcacttgaggtcaggagttcgagaccagcctggccaacatggtaaaatctgtctctactaaaaatacaaaaattagccagtcatggtggtggcgcctgtagtcccagctactcaggaggctgaggcagaagaattgcttgaacccaggaggcagaggttgcagtgagccaggatcacgccactgcactccagcctggacgacagagagagaccctgtctcaaaaaaagaagaaaaaaaaaaaaaaagctaaagtgctccatggttatattaaccttccccgctaagtttccacacatctcagtttagtacatgttgagctagtgaagctgggattctagtttgacttttgaacggcttttttttaactgagatttctatctttagtttctttttctatgtggcaataatggaatgagaactttaaaagttactcaaaaacttcatctgatgaagtaggtagctgtcttggcaagtaaatgcaattcctgaaaattttttccactggaatgatagctattatggctacaagataaggtatgagcaatgagttttctggccgaaggaatgactctgaaattgccatacctctgtgtagaagcaagccatgctttaaaaaatgacactttggtctttgcttgaaaactcaaacataaataaataacttctaacctggctttgacttcataagaacttcattattgccgggcgcggtggctcacgcctgtaatcccagcactttggaaggccgaggcgggcggatcacgaggtgaggagatcctgaccatcctggctaacacacggtgaaaccccgtctctacaaaaaaaaaaaaaaaaaaaaaaattagccaggcatgttagcgggcgcctgtagtcccagctactcgggagtttgaggcaggagaatggcgagaacccgggaagcggagctgcaatgagcccagatggcgccactgcactccagcctgggcacagagcgagactccgtcaacaaaaaaaaaaaaaaaagaaaagaaaaaagaaaaaaaaaacttcattatgtatgtattcgtgcagaactttgagaagaatgtttataacaagaaaaatataatggcaaagcatcgtggcaaaaagaaaaaaaagaaaaagaacacagaaaataattatgcaattttgttaattctgagaccaaagcaagctgttctggggagcaactcaggggaaatcccttaaactagcttctatcactgtctaattaaattcaacatgatttcttatagatcatgtagtaggataaatataggtgagataccaaatgaacataatacatgattccttcagttctagaaatgtttaacagagtagtttaagaggatttcatgaaaagtaaaaagaatatataacagtagactaacactttttttttttcaggaaagggaaccacatgagcaaatagatgtggcctgagcagggcataattgagatacgtggaaagatcagtttggttgcagaaaatcagcccctgcaccatagtatgagataaatgtttagcatccaaatataaagtacttttaatatcaatttaaagcagagcatttcttttattttaaaaaatagggagttattaaagatttttactagtattttaatcataagattaaaatattttatggaaattatgcaaaagtcttaatgaagaacagaatctgaagaccagtagacatgttagtggtcaattccaaaagacgaggcaatgtgcataaaagatattgttctctttttcaatgtagtacttattttcgcctctactcttttattcacgttgcctctctttcacccatcagcttcgcatgtgtgaattttacacatttttcatgatacccctttcataagtccattccagttcttctcttctttctctggatttccacttttttttaacttttgcctctgtcttagtccattcctgccgctataacaaaatatgtgcgactggataatttttaaagaacatgcatttattgctcacagttttggaggctggaaagtccaagatcaaggtaccaacaggttcagtgtctggataggggcctggtccttgcttctaagatggtgccttgaacactgtctcctcacacggtggcaggtggaagagcaaaggggcaaatactgtgtgaagcctcttttataaggcattaatcccattcacaagggaggagccctcatgacttaatcacttcttaaataccttgacttttaaaattaccacactggtgatgaagtttcaacatatgaattttgggggacacattcagacaataatggcctctgaggcaattatcgttaattctatctggaatcatagtcatttatctcttatctcaattattatgattttctggaaaattaaggggatgccttgatttctttttatcacccttgtccagcccagtggctggaacataagggttcagtataaggttgacagagcattcagttattgggggtgttagatggatagagtgatagaagtaaagatgtacagttgctgagaagtcaaagaataaaagcaacagattcaaaggataaaggtttttttaatctagaaattttaaatttgtttccaattccaagtgtcatagaggttgggaaaaataaagataattacatttagtgatgagtttatcacctgtgactttacagtgtatggtttttatagagcagatattaaaattttagggagggtattcaaaagtcaagtatgatgaggcatcttttctcacctgtatagaaaatgcattctcatttctcccatttaccggtactttcggttcactgcttttaaaaagatatctgaagttaaaaaccatctaatatgtataactcatgaggcagggaaggcttttcttataattggactttacaatattgtttttaaacattcttggcctagaattaacataccactgctgggatatatagagtataatgcaaagtaacacaagcaaagtcagtgatacacaattcttcctcatgagagaaacaatttatgggaaattattaagaactccaggattattagcatcccacctgcaattgagaaaggtaaaaacatatattcccttaatacatggtagattgtttagcaaccacctacacattggccgtggatctctaaacatttaatgagtgcctgctgtgtactaaacaaccttctagagtacacaacaatggcagtggaagacatttacaatacaatagatgctttcagcacacaaacatagatactcaaaaggctcacagttataaaagaaaacaaaaaaaaaataagagttgaaaaacagcttccagagcagtatttcaaaaaccgcaggaagctatagtgaaaatctaggaagatgcacagtgaaggaacacaaagtatgaaagtaataagagccatcttggctgctgaaaatatttctcttaagaaagaacatcttgaattacgtgttcagaaaatgaaggtcaataaagatcttattggttagaaaaaatagcgaagaatagtccgaataattaagtcaaattttaaagttaacttacacagaactaagcccatttgacccagttggcacagtccatttaaatcttccttaggatgccccacattaaagtaggtgaactaatcacataacattggtgcaaaccaatgagatttctgaaaaaaatattttaagtgaatcctccattaatggagagttgagaagattatttttagatccaaaagacaggatttaatagtaagtgagatgaatgagatggataaagggtacagtaagattagattgattaaaataaaaatatattagaaaaaaactaggactcaacagacggagagattgggttgtgcaggtgatggagaacctctattgtacctgacattctttaaaggaggaaaattagcatattcaaaaaagaaaaaatattttgacaatagcatgaaagccagagacctttcttgcctccttgtttagaaatcattatagcaatttacgcatggaaatatcaaaaggaaggagaagtatggtgtttgtgaaaatgaaaaagtcttaagtttcaaaaatgccatggggaggaatttggcagtggataggatgtaaatgagtaccaaagaagatggagaaggctaactttactgaagactaaaatgagagtcaagaggaaatggtatgttcaacaaaatgcaaataggcaagaaaggcttgcttctggaatatatcagatttcagatcttgctgacacaaacacctctgggccaaaagtttaagtcagctggagacccttgacattctaattgagagttagccctgcaaaggaggtgattgattaaattgattctaacacataactgattgtatagaaaatctgagaatattgaccctttaaaaatctgtgaaattaattatctgtttttagaggtaggatatccttggcagaataaactgattttatttctctgcatgtgttttagctatttttgactccggagcatgtttcatctcccaggcatatggctattccggcttagagttgttgaagggcaaccactatgcaaattattccctcttctctttacctctttctttttttttttttttttttttttttttgagacggagtctcgctctgtcgcccaggccggactgcggactgcagtggcgcaatctcggctcactgcaagctccgcttcccgggttcacgccattctcctgcctcagcttcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcttgagccaccgcgcccggccctctttacctctttctatatcttccatctgaagagttggaagtgtgagtggtgagaaatcacatgcatccagaggagacagactctaaaggacatacacaactctatggaaggactagactagcagcccaatcaggtagttaaagaaagaccaaaagttattggtttttctttagggagatggcatcaaagcattttgagccagaagttagtgctaagtacctgcaggaaggatgtagaaacaagggtcttgtcatttgcagataaccaagcaggtaatgtggcagccaatagcagcagcccagccttggtgatgactttactcctatcaatgaaccaacaagagaaggttaggtcaccattcctggagaaatggaatttaaaatttttcatgttaacagcagtttaggagaatgaagcctgttttagaaattagagtagaatgtaaagtatcaaagttttgaaccccaacatcagaagtgaatctccaaatcagaataaggcaaattaagaaagctagaactccttaaagtccccagaccaaataaaaaaaaaatagggttgggtctggaacctgtaatatgatcattatcattaatatagtgattattaagcactttacttgaatcatcttaattaatcttcatgcaattctataagatgaatattatcattatttccattttagagaaattaacttacccaaagttttaccaataatatgtatctaggaagatacaaaatctatctaaaagtggttgacaaaaaataccactgcataggtgaaaggaggattcaggacaagagttgaacatcccttttatagaagtccttccaggaaaaaaaggaacatggcttggtgtgtctgacttccagaatatgatacctcccagtaagaaaaagctcttatttcttgttcttactcactctttattaataaatacaattccggtatgtaaacatattcctccgtattcctaataagggctttcctggaacactcacgttgaatcaccctcagatatgtcaatttccttgagtccagcaagaacagaccacttaaaatatttcaaatttgagggtaattaccgtgcacaactttggtatatctctgcagtgtttttatatctgtggaaatgtatttataatttatactgcagcaacaataaaaatctgtgaacaaaatggtgaagtcagtgattttaggatgatccaattctggtcattttgttataataacccagaactagaagaatcttcatatgataaaatggatgatctatgaattgtattttaggtggggggaactcaacttcaacttgtgtgttaaggggaattttttgtttgttggtttgtttaagaattaagaagtagccacctaccctggcttccacaaagctggacaccaaagggcaaattatgttatcagcatttcgttttttctttttccatctttggcttggctttcttcaggttttaacatctctcttaggcaggtgtcctctacatgttggttatctggcagctcaaggtttccattcaactagtggagcagctcagcataaagtgacttttcactttatgctgagtgcctaccatgtgacagcattgtactcaatgtggaaatacatcagtaaagaagactgcaaaatttctacccttctgttgccttttctagttctagcatttgtcacaatagtctcaagtctgagtactactaatactgacttgggtcatgtactcagctatagactaatcattttgccctggaggaatgaaatctcctgactcaccagacctgagacttatatccacccttaaagaagggaagaatcactaatactctaattaccctgattaacaatgaggaagcattatttttccagagaggaatttgagtgcttttaccaaacaatggatatgaacctggagggaaaaaaaaaatcaattaaaactccaaaatccaaattcaggaaaattaaatgaggaaatctccccagaaaataaatagaacttgctcagataagagaaaatggaaatttgagtcaaaataagcctccttagtcatcaaatctagatactccctcacccagtcaacaagcgcaggtagcaaaatagtcttcccataaagagtaagttggtggatgaagttgcacttctatggataaccacactctgtagtcatcgcctgaatgcattgtctgaggtttataacttctatttatagaagttcagcactcaccaagtgaagagctctgggctatagatacttgcttccttccatggacagtaaaaagtgtgttcaatcttgacttaaccccaagtgagtagaactcaggctgttagtgattgaggcctcaggcttggtaatttataaaatatactttgcttttctgttttatggaggaaaacctgcttacttccatgctttggaaaaactgattcaaaacgtgtctaatatgctgacttcaactaagtgtatagtaactgataaatatctcctaatggagttttatttttttttccaataacagtgttatggtagttgaatatatgtttttcttaacaagatagatgattgatagatagatagatagatagatagataatatatagacagatgtgtatctatatatctatggatatttgaagagcaaaaatttacagatttatgacatggtagagcatgttagttaccagcatagatttcacagctacacggcctaagtttagtaaaaaatcatgactctatcattaagcttctaaatgtgagcaagaacctactctgagattttcatcagagaaatgagaataaaaatggtactcacattataagattattgtacatattaaatgcattaatattaaaaatttagaacaatggctaatttattgttgacattcaataattttaaggattattatcatcatcatcatcatcatcaccatatttagtatacattcactgcaagtaacaggattcttaagcagaggtagtggtcattagtactgttcaaaaagtatttctgactgcgcctgcttaggggcacttggcagaattgcactttttttactctcttgtgggtagaattgtgtgattcattctgacagggaagttgtgaatggaagtgatatgcttcacttctgggataagcatttgattgttgatatgagatcatccagacctcattcttctttcaggaacagaaaccagcaattttgcaggtgctcctgctccatcaacccaggtctctaagtgactgcaataaacagaagttctactgatccaccgtagacctgtagcatgagtgagaaataagcttttgtggtgttatacccctgagacttcggattgtttgtgacattactggtgcataatctaacttatcctgactaatacagccaccttacacaataacgcatttaactttctcagataaagtcaagtaatggagaaggaagttccagagctagttgacaggttgagccagtaattctgagccttctctgaatcattaaagaacagctgtggcagctccaaacatcatattcccacatagcaatacaatcaggaagtggaatggtggggagcaaaggcaaaaaggatcttttcccctagtgctctctcttttatcagggaggaaaatattttctgaaagtctcctccaggtttccattatatcttactgttagtgctaaatcttatatccaaccctagaccaatcaatgacaaaaagaaaaaaactataagcttgccacattttatcatgtttcactgtattgcactttaaagataccgcagatttttttacaaattgaagatttttagtaaatctgtgtcaagcaaatcaatgccattttccccaaagctacgctcactctgtctctctcatgtcacattttggtaattcttgaaatttttaaatctttttcattattattgtatctgttatggtgatcggtgatctttgatgttactattgtaattgggggcaccaagaactatgcccatatgagacagtaaacgtaatccataaatgtggtgtatgttctaactgttccaccaaaagccattgcccagtctctctctctctctctctctctctctctctctctctctctcacctcagaaagcttcccaattctctgagacacaacaatattgaaattaggccaattaataatcctgcaatgacctctaagtgttcaagtgaaaggaagagtcttgtgtctttcactttaaatctaaagccaggaatgattaggcttagtgaggaaggcatgttgaaacccaagacaggctgaaagctagtcatctcgcacaacttagcaaagttgtgaacgtaaaggaaaagttcttgaaggaaaagtgctactccactgaacacacaaatcacaagaaagtgaaacagccttattgctgatgtggagaaagtttcagatagaaggtcaaactagctacaactacctaatttgatgcctaatccagagcaagatcctaactctcttcacaactctatgaaagctgagagaggtaagggagctgcagaaaaacagtttgaagttggttcatgaagtttaaggaaagaagttgcctccagaccatcaaagtgcaaggtgaagcaggaagtgctgatggagaagctgccacaagttttccagaagactgatgaaggtggccacactaaacaacatgtcttccacgtaaataaagcagccttgcattggaagaagactttcataggactttcatagctagagagaagtcaatgcctggtttcaaagtttcaaaggacaggctgactcttagtagggatgaatgcagctggttgaagccagtgctcatttaccattccaaaaattttacagcccttaagaatgatgacacagctactcttcctatgttctataaatggaacaacaaagctggatggcagcatatctgtttacagcatggtttattgaatattttaagcccattgttgagacctgctgctcagccaaaaaaaagattattttcaaaatattactgcccattgacaatacacacagtcacccaagagctctgatgaagacgcaggaggagattgatgttgttttcatgcttgttaacacaacatcctttctgaagcccatggattaagaagtaattttaactttcaagccttattatttgagaaatacattttgtaagactgtaactgctgtatatagttattcttctaatgcagctgaggaaagtaaactgaaaatcttctagaaagtattcatcattctagatgccattaagaacattcatgattcataggaggtcaaaatatcaacattaacaggagtttggaagaagttgattccaatccttatggatgactttgagaggttcagaacttcagtggagaagttaaatgcagatgtgataatggcaagagaactagaattagaagtggagcctgaagatgtaactgaattgctgcaatctcatgataaaacattaacagataaagaattgcttcttatggatgagcaaagaaagtggttccttgagatggcatttactcctggtgaagatactatgaacattattgaaatgacaacaaaggatttggattactacataaacttatttgataaagcagtggcagggtttgagcagattaactctgccttcaaaagaagtttggctgtgggtaaaatgttatcaaacagtatcacaggctgcagagaaagctttcatgaaaggaagagttggttgatgcagcaaacttcatagttatcttattttaagaaattgccacagccaccccaaactttagcaaccaccaccctaattagtcagcatccatcagccttcaacacagaagcaagaccctgcacctgcaaaagattatgacttgctgaaggctcagatgatcgtcagcatttttttagctataaagtgtttttaagttaatatatgtacattgatttttagacctaatgctattatatacttaacaggctacagtatagtgtaaacagaacttttatatgcactgtgaaaccaaaaattcatgtgactcactttattgcaatattcattttattgtggtggtttggaaccaagcctgcaatatctgtaagttatgcctgtacaaaactgacttaatttggtcataatccatctcacacatctgggaaaggaacctactattcttgagtaaattaatccctgcataataccagaacaattcagcactctcttagcaaaaagtaaggaagaagaatgtctatgtaaccaggaacgtttttcataagagtaatggccttctacaagactctgtggaattgaaagatttcttaaaatgaggtgcccttgtgtttgcagtatatgcagttttgtctcaggagagagttttgggtctactgagaagaaactgaggtatactgataagtttcactgcttgtgtattgtagtggataatgtggatttctaaatagatttgctctgccacattattagacagatgcctaataatttaatgtacattaaagtatgttaatagggagaatgtgtaatcataaattaattaccaagattatgattatcccaattttaaacagtgcttgaattaaaatatatccctagaatacaaaatgaatagtggcttacgtgttctaaggtgagagataagggctctgcaaccacttgtggctttggaaaatgacatattttgcagtttgaaagcatggatttcagttaaacattaaaagcagatgactgccatgactatctgtaacatgatcatgcaggacaatgagagaaacggcaaaagaaattctgcctttcggcacatattttctctactaatatttgcaatgccaattttcaacagcacaggtgtatttaattgcctctgaatattgcaatgcaaacccattcaatgttgaaaacaggagcccaaaaaggaatctcaggctttgttggcctgcagaatcttgtagctccagattgattttaatatatccagggaattttttttctttgtcattgcgctttctttagaagggcatttaaattatcaaaccattaccttatcaagcacaaatgtgatgccaattcttgtgatttctgagttatatgtgctaaaaattacatgagttctattgaatatttttatcaagtccagtgatagaaacatgtattttctcatgctgtagttccaagatctttaaaaggggttggtcaataactcaaaaccattttttgatgaagggagatacactactaatagcagatatgcttccaaaagtttacaagcaataggaatgcttctaaaatttttaatgccagttactctgcctgatacagaagaaaaatgccatctactcaagttaattaatccatgtttctcatttgtttgccttacacttgagttttatctgagtaacaatattacaaaatgtacttacacaatatgagaatattatattttacgcagggtatacccatgattcatctttaaattaacttcaggaaatctcaaatcaaagcttcctaatgttaacttcagctccatttccagaggagaccatgttactaataaaaatagcttctagcaacttgataagagagtctctgtgtgtttatggccaagataaatgatcttaaagatgtagggcacaaaagagaattttgttgaatttagccttaacagatatttagtagcatgtatcaaaattcaattttatctgaaactgaagaaaacccatcagatattataataagacaataactcaatttcagacttgtaaacaaaggtgacattaatctattgaaatgtgggaaaatagtcaacctgtatccttctcataccataaatcagcatgtttgatcactggaagcttcattttgatgattagcagtcatgtattgaggctaaatgatatgtttgtcgcacagctaatattaactaaatctatttatcatcttgccagtggtactacagtgaggtcacacttttggtgcagaacaaaaagaagccaggaatctgttaacagcatcccattgtaacattgctgttttttgttttgttttgttttgttttgtttttgtttttgagacggagtctcgctctgtcgcccaggccggactgcggactgcagtggcgcaatctctgctcactgcaagctccgcctcccgggttcacgccattctcctgcctcagcctcccgagtagctgggactacaggcacccgccacaacccccggctgattttttgtatttttagtagagacagggtttcaccatgttagccaggatgatctcgatctcttgacctggtgatccgctcgcctcggcctcccaaagtgctgggattacaggcgtgagccaccgcgcgaataaaccgagaaagaaaagcatctgactattaacctcatatacttttggaaatggatgtttgtgtccacatcccctttgatatactgggttatggccttggcggtgaaaattccttactgtatatagtgggttaaaaaagtaggatgaatgctaacaaatgttttaggatgtatcacaacatctgaattctcccttctgatgcttagcattttatttcacaaaaggcaaggttactaaaagaagaaaaaaaatcaactgtttagatgaagaagcaaaattaattagtaaatataaaaagtgattatttgagttttgctatgacaataaacaagaatatctcattctcagaagaaagtcagctaaagtacacctttattttacatattcctatggattacacatttaagaatactaaggaataatcattctgatttattttatttcagaatgactgcgatggtgttggaaaacagggttttatgcttcttttcttatgtttttctgacttaacatcttgtctgactttcaaacagttcaaaggaaagagagtaccaattagacaagggaagaagatgagagactgcctgaacagcatcacttttgtaaactgagagttcttccaaggatagagtgtgtaaatgctgacctacattaaatacaagtgacatggatttctgggcatgtgggacgccttggtaatttgagtgacaaatcacgtatggtgcgtttactactcttttgtggctttaaagttaggtgattttgactctaaagcatgaaagttcaaagagctgttaagatttctctgtgatgtatgcaagggttttcttaggaataaaaagtctaaaaaattcccaagaagacacttatgtgtaataaaagcataaagaaatgtacaggaataaaagcactagattttgtgtagaggttaccccttaggaagagagaaaaggatgcaatcaaaggtagtcatatgtggccttagtagtacccatacttttttatttcttcactgagtgtgggtaaataaataattttttacttgacttaattttaataatatttgaaagaattaaagaagtccatgaggtaatgtgaaaacttgtaatgaaaaaggctgaatacaaaattgtatatgctgggatgacaactctaaatgtttgtgtggagatggggacaagaagaaatagaaagagttaacttgctaagatggcagaattatgagaaatttggacagaaattgatgagaaaagtgatttgaggttttggtgatgaagaaagggagaatataacctaaggaagattaaagatttcacataaaactaggaaatgtttagcataaatcagtttcaccaatttgaacctggtcttcctctctgtcctctcccttgtactcaccaaatcattttacaatcttccaataaggaaaaatacttcctttggtatgaatgtctagaattaatatttatagttctacaaaaaaattcagagctcttaacctaaaacaagtgaaagtacaatcattgtttttaaatgttacaaatacaatacctgacattaaattgtatttcctctatattgcatattctgaatttaaaactgtctaacacctttaagcttaaagcttaaattaggcatgtaaaacaagataatgacaaaagaaaagaaggccggatgtggtggctcatgcctataatcccagcactttaggaagcaaagactggagaatgcttgagcccaggagttcaagatcagcctgggcaacatatggagaccccatctctataaaaaaataaaaatattagccaggcattgtgtcatgcacctgtggtcccagctactcaggaggctgaggcaggaggatctcttgagcctggaaggtaggggctagagtgagctatgattgtgtcactgacctccagcctggatggaagagtgagtccctgtcacaaacagaaacaaaaaaactcatatttattttcagaagggacttgattatgtggagccatatggggcaaagtgcaaatataccttagaactactttaaaatacctattattttttctataagtatccacagccagaaagagcaaaacttgctgagtatgattggcaaaaagattttcttttgttttgattccaccgttccttatttttcaggccttgaataaagtcaaatacagaactcttatgaaaaaattcagtgtagaacctataatttagctgcgattgttctcttggttttattttattttgatcaatttcagtcaggttcccttgatttctctgaaactggagagtattgtattctaaacgaatgacttgtctttgctagttgaagtaaataagcaattagagcaaaaggctgtttcattgaacttcaaagaaaattgtttttaagattctgttgttgttctgtggcccctaataatgcagacggtctttatacaacagaaatctgtcagagaagaaatttttattggtagctaactttacacacacacaaacacatgcacacacaacttcagaagcagaagcacaaggtacttcctcagagaaccacaaatatcatcaaagtcttattttgacataatgctactttaacaagaaattcagatttatggaatgaaaattgctgtagtaacaagtattttgaaatccaccctaatacccagaaagtgacagcaaatcccagtgcttcagtaactctgagccagttaaactgtaggacaaaattctgttgtgttctagtatcactgtctttctgaactaagactgtcttgtgctttggttgataggaagcagtgagggtcctgcctttcccaggtttgaactttctcaggtggttgagatcttccttgcagctcctaaatttcattatatttttctctactccacaatccccatccagtaataaaaatctattcaaaagttgaaattaggaattcttccatttacatctaagcgttagattatttttctaaggaaaaaattaagattctgtttttacagaaatctcatatttttttttttagtagacttgggtctcaagccattctgttaaaaggggaaaggagtaatatcattatattaaaatatccaaccatatcatgagatcaaaggataaaaacatcttgaggatcatttggtgagtccgtctacctgcagaaatcctgcatgtctgcatcactgtgaacagctcagtatggctcaggggtcacctcgctgttggaacttcagtggtctcacatagtccctaaatccaagccactgtcattgttcttgggggttgtaaaggccattaagtgctcagtagtcttataaaaacatgcagattcttcaaacagaaataatagctttagttagtgtactttagagccataagtttaaaacccagcaggagaatataaatgatggccaggcaagaaaaacaaaactccctgccaaccttcactgcctacaaaacttaatgatctatgccacatctactatttgtaaaattctttcagaaagtatccattcttaacattaagaaatgtctaccttccttcctccaatattttcaatctctctgccacactatgtttatattctctcagaattctagtggatcccattgtctaagacttaaaagctgttattttatactggattaactttaatcatctgtatttcttccaaattgtagagattgcattggtccaattttcttttccttcaatttttaagagaagcaaatcaaaccaagtctttaaaggaagcacagcaagtctcagataattttattgtttgggcctaattattttaaatgttaccaaggaatatctttaggttaaaaaaattaaattttagaacagaatttgatatatatttcttattatttaaaatgggaaagggcattagcatttattaaatctcatctgtgtgccaagtattcataggtatcacctcatgtaattctcacagttattattgcggtattattatttcaattttcatgtaaagaaataaaagctcaaagaagaaaatgactcactgagttctgaacacacaattctctgagtccaaacctctagcactttctagaataccatgaagagtggaagtaatatgtaacattataattaatgttttattattttactctcttattgttaaatttcacacagtaaaatctacacataaacattcattttaatttaaaatcaaattatactgacatagtgccaaaataactgctctatgagatcaataaatccaatctattctgatatagaaaggcaaaacccgtgtgcattgctttgtaatagtaaccaaacagtcattatgtttcagccatttcaggaacttatttgtgattgttgtatattgattataattctggtcagttgtagttaacaagccttttttttccttatactttcttttttccaaagaacctattttgttttatagcatggttggacttttctctagaaaattacaaatgtattcaatataaccagtatttatcccaactttctgaagaagaaacttctcctacttaactccaaccttatgactcttctctgatatttttccagccataggtgttagcatctgctgttgtaaaatctttggtgttgattggtgtggactgagatgaggaccagagccaagatcactttttacaagaaatatacaattctgccccttgtccaactctataaattactagaagtttctggaagtgtgtacatcttcaagctcatcttaatcatttccacatttgtattcttgagattatacctgagattctcatccacacaatccttaattaaagcagctgactcgcttctcacaatataggaaaatgggggtgccaactgctttctctgccaacttctgagtactgttgaagctgaactagctcctcaacgcttcttctccaggaaatgtactgcaactctcatgctatttagcaccttccctcctcatttcaaaaattgtgctgatcagagacattcagaaaaagtgcaaaagaacaaaacagctccaaatagctttccacagttctgcactgtattcttccctctgttgatttccctacaaaacaaataggcaaaaaagcagctcacaaaaaagatagagtacatagaaaagagaaaaccgaggcataagacagcactgtgtgcttcaagaaagtcctggagcaaagcttggagcacagggttcaggtgagaactgaagttatattagcataaacatatggtcgcttactgccccctctgcaatgtccagaatgcattcctaattttcattccatttgtctccaatgcgtgataggacttcaaagagtcatgattaaagaaattgttcagtgcaattagtcaccacttacaagtcagtgagctcgcattctggggtgagtgctaagctttttcaataggagatagcacactccattcacttctttgttgttctttcttaagatccttcttctggtgattttttttttttttttatgtccagagttctactattttctttctttctgcctaataatacttaatttaaaataaatacatcttttcagaaataataatttcatccttagtgaaaacatttacccatatctgcccactatattttgtgttttatattctttcatttaaaagtattaagatgaacttcaattataaaatcttacattgcttgaaagacatttgcctaaatatgttatgtgtctactgtagtttttcaaaaaattttgatttaagaagccacaagtatattaaaataattctatttcttccaggaaatggctggatttagtgatcctgtaaggttaaaaacattataatatttgtatagtgaccaggctcttgatttagatggttacatataagcaaaatactgaatgaagacaaaaaacacagctatcccttttattaagtttcatagcttttaatcccctaaggaaatcctttagctatttcactattttactaaatcatattaaaatgcaaatttccactaatattacaattctagtcaaaaccaccaaaagaaaacatgggctcttaagcttttttttttttaagtatgagcacagacagcagaaaataaagctttcctgtaagtgaatatggcatctacatttgaattatgtacacagtaaaggactaaaaattgtgtggtcctaagtaagtttaaattctattgtctttgattgatttgaaatagaattatcagagattggattaataaaaagagcttgacagttcaaagaagtaagcttgtgattgggctatgattttttccaaggattttttgggcagtcatattattttctgtaccttaaatttaccatctatgaataaagataatattgactgcatgaaataataagcccagcaactttttttttttttttgagatggagtctcctgtgtcacccaagctggagtgcagtggtgtgctctctgctcactgcaagctccacctctcaggttcatgccattctcctgcctcagcctctcgagtagctgggactactggcgcccaccaccacacctggctaattttttgtatttttagcagagacggtaaactattcagtggaaacgtgataaagttgtttctcaatgaaaaatgatcattataatgtaaatgtgcatgtaactagttattgaataataaaagttgaactcaaggtagctttttcagtcacttcaaatacttggccaattttgaaggaaaaaagaaagcagcacccaaaagtctattgttgttgatgcactatagaattgagagtgtgttcaagcaaaatctagcatgttgccaatggaaagatagtaaaaatcttgctactaatacctgcactgctctgctgaaacatttacctcaggtagtgttagctggaatggctaattattgaaaatacaaagtactgcatattgtttatttccattagtacaaatttagtattattctaatgctgcttgcattatttgaataagataaacaattctcagtcactgtgacttcaaagaactattctttattctccccaaagtttgatttactcattctattgtttattcatgaatagctgtgtactaccaaatgtcttgcctttcagtttttcaacagcaatctttactttagaaccttactctcaccttctgatatatcattaagtttgaacatgttgaatgctttgacggttgtattatacatgtaaaattgcttgtatttcatcttttatctagacagcttttatagtttgggtttttttcaaccaagttttcaacatttttaagttatgaagtttaacaggaattgctgacaaatgataataactggcatttttaaactcttcttagtatccactacactaagtactttacatattataaatctatatattatcacaaatcatttacagggtttttatgcttatctcttctctccacctggctctcattttatacagaggaaaactgaagttcagaaagtttaactaacttgatcaaatttatttggcaatttaagtggcaaagctaggagtccaaatccatgaaacttcttatacttgatactgccctgttgttgttatgattaatagcaattatgttttttgacaaatgattttcactgatttggagtaaataatttaaaattatttcatttaaattaagcctgatagtactatactaactgatacgtttacaaaactaaactcttcttagctgtaatatcattagcatttgctcaattttcagcagagacacaaaagaatgccagaatatatggaaagagtatgaaagctgaaccccaaggacctaaatctgatcccaactctaataggaatcactttacagaagctacattttagatccccaatgttatcatctttaaaatgaagataatgttagctactttagctattctacaatatggtgtttaggatcaaaccagttgaggtcatgtgaaagggtctcagaaagtgaaaaaaactataaatgaaagaattagacaatactgcaagtgctgcatgcaagaagagtaaaactattagcattactaatacaatgttaagagaatcttttcaagaggatctgctatgcaaaaattatttagaaaaactaattgacagaaaacaattgagtctttctgtcatttccatagtctatccagaataaagagtaatgaacacgtgcatacgttttctaaataatctggaaaagttgatattttttaagtgtaccacttagatttaataaggagtccagtggagccatgcttacactataggtaaacaatatttgaagaaagctttctctgcctctgattatatttttatttattcaataaacattttctaaagacttagcatgtacttaactgacatttcatggaaggcaaaggaaaggaagaaagcagtatccctcttcaggtagcctcccccatgttagaaagacaagtcacaaagctactagaaaacaaagattgatatatgataatacaaaacaaaaggagtgaatacatgcagatgtgaaacaaaataaagggcttatatatggtattactcaggtagacatttggaagaaatcttttgggagcaatgtcttattttggcaaagaaaaaaaaataaaggggattctacatccttaagggagatctgtgaaaacctacaatagcaagagtcatgcagggccttgtggtcatgtgcttacagttgcagtgcttagaatacaaactctaaacagaagaggcatatgatggtaaaagaaaaaaatcatgaagaaaaagtaactgtgtaaaagactgacaggtatagggaagtcccttcagacgcaagaacagacaataaatcaaggatcatgggagttgtagaataaagttgacagtttaaaagccaggaaacaaaaagaaaaactgctgctacactttgaaaattggacagataaaattgccatggagagaaactgattgacaaaaacagagcaaactacagattgggaggaaaattaataagcttggtctgtagcagcacaaatccattggataatcaaagaaaaatgtcccgtggatacttaggcaagtgaggggctttgttttcactgttgcctacctgtcactttgtatagtaatgaaattaatgagcctgaatcttccctttcatgactgtaaagactcaaacgccctgttcttctccacccaagcatagcagccatgcaattctgctgtcaatgcaatcaaatctttccaagttacagagaattctaaaaacgtcctcacttgtttctagaatcttaaaagaaaggtagtggaggaaaaaaaatccttccaaaaaacaagtaataaggcatttttgtttacttattgcttatagctgttggccttaaattataaaatatcagggaatatatctgcccctttagctgataatcttttatcataattgaatttaatctcaataacattaaattgcttagaaaagaaacaaagtagatattaagatattgaattattcagaagctatcaacaggggccatgttcaattcttggaatgaatttctttttctcaggcatctttgccaaagttggaaaacaggttaacaaaattgttaaccaaattgaaagtgtcaaaataaagccaaatacaaattgggtcagaatccaagagctgcctattgtgaagtcttctaacgtaaaagttgaaaagaaagttagcttccttgacaaaagaaaaaaaagactaagaggttatgtgtttttagttttgaacttagaaatcagaactcaagaaagacatactgaaaatttcataggatgaatggatttccctttaaccacaatattgtgttgtccacagcatgaatgaaaactgttacaaacttccaaaggcttcagatgattagcctgtgaattgccttcacctctgccaacttacctggcatcctttacgtttaccagcgcacttctccctggagcctgcagacagcaagctcctgggctgactgtggaggcttatctaaatcctctgaaagttgtgctggggtttatctctgcctgaagacccatcattttgcatgtcaaatgtcagacattccaatactgtgaagatatagatggctttgccttatcatttaaagcagactaatattattataggcattttataaaattaattatttgaccaatacatgtgcagataaaacgtccttcattcaactaacttccatcatcaagactaatcattgcctgcagtgagaaacatcagtaaccttaataagttattcagtagggactgtgaatttgttcaacagcacaggaagtacagaaatcagatcaaagggtagaggatctggtaaaaatttatcgaagcatagattgtgactttgtgtatatcaaaacaatatgatatactttactaaagttttgatgtattgacagttgagtttatgggcaaagagaggcagatttacgattctattaaatgttaaggatttttaaaaaatcatcgaaaaaattgtattcatttgacatgtaaaataagtttgccgtgactatatagcagaatcaaaatccattaaccatggattaatcattaaccctttaatttggaattaagatgatatgtggtatttttcacagtatttcatatatgttagtcaaatctgcccaagcagactgtaaactaataaattatttcaaacttgttcaaatggatgagtgaatgaatgagtgaatgaatgaatgaatgagtctctcttctagattactgttaaccacaatttatctgccctaaaaagtcacaggtaactgacccaagtcaatggcttggagcatttttacagtatttttgcacagacatatattccagtttcctctttgtcaggaacacaaattgaaaagagaaatagagctatgtgggaggagaatgtgacatgtattcttaaggagacaattctgaaggctatttggagaaggctacatgaatttactacaaggaaacatcttttcatctactatgatagaaaaatctaatgcagattttgataagtctgtatcatattgaaagctctgtttaacagagtaatcactggctgacaaattagattaaaaggagtctgaaaaccaaaggaaagaaaggaaggaaagagaaaggatgaaagagaggcaggtaggaaaagaaacggtgtcttccaaatactattttcaccgtggagcaagaagggctttggagcatacctcagaacgtagctcctccatgaagtcgtttttgaattccaggccccttttatcttgcccttctcttttttttttttttattgaatatcaataaatttattgaatgccagattctgggctcaatgttttcatacatttgttcgcttaatccttacagcaatcctgtgaggcaggtagtgttctcttaatttacaggtagaaaactgtgaaacagagaatttttttattgtaaataaagtccctctccatgagctttatatatatatcttgcccttctctaaccagctacctataaatcctttctgctccactgaattttgtgcttaactgtattgcctcctatctctagttttattttctgggagttagtctttctaagctcctagggaaagggaaccatcctttctgtgttctctgttctctcactccacctctgcataagttctctcactccacccctgtatagtttaaacacacagcagattgtcagtaggaaagaaatgaacggttaaatgatctgatgcaggaatacgtttttcctttggccttggtgtgtcttgccttgatgctctgagaaacaggtttttaatttggagtccagttgtcttccagacctggagaacaataatctgcactcgggtaccacatattaccaactgtatgaaaaagtacacacacacacacacacaatgcacacacggatatatgcagtttcccatgaagagtccacaacttttatcatattttaaactggacatatgattcaaaaaaggtttagaactatcattctaaaggaaaaaagatacttcagtaccctggggccaagaattggtagtctttgaagccattttaggctataatgagaaattcttcatttggacctctgattgatttaatcttaaattatgttctatgagactttacatactttttcaaatatgcatttaatgttctgtctccagaggtggctaatgagtgtattaatgcacatatttccagaacttttttccatttgtattgtataatttagaaaaagcttgtttttatttttgctgatttttgaaaaatgattatccttgtgtgtttttgaaaattattcataaacagccccaaaagcaagactttgaaaaagattttttgtgctagttaacagcagaataattatttccatattatattctgcaccttgcatctacttataatgatctagaaagatgatggattattttgagtaaaactagaaattggcaaaaagcatcagtaaatataagaatgaagaaacatgtagattattcataaaatgaataatgcacacattagtgcagtggtgaagcattcataagacaaaatagagatatgttgaaggtagaaaatgcttgaagttactgctgaatttttgtggtgaccatagcaatggtattacctgtattgtcttgaggctcttggctgaaatatctgggactgttacaaatgtacaagcttatatttttccagggatgaaaatatagctcatcctgtgaaaaagatatggatttaaggttgtttcttaatatgataaatgccaatggaactaataatacaaatctgcccttaaaagtgaaaccaaggcagaaatacaaaagacaatgaattatgccgtagattaaaccaagatcccagtgagtaaatctaccaaagttttccagcctaggggacagaaatagctgactatgaatgggaatgaggatgaagagaatcagtgctaaggaaaagccccttgagatagtggcgtacttcaaagactgtccgctctacttctacttgagcttaagaacatggctatgtgggtttccttcaagtcatctaatatttattgagcactgactcaggcattttagggactgcaaaaaagatccattgggaaataaatgcgtagaaccgcatagagcctgcctccccttagccatagggcacattgtataaattagaaaaggggctcctccccaattgttcattcagtaggtgtgagattcaatgaatgtctgatgaacaggcctcagatttggaagcatgaacttgacatgcacagctgctagtctataataccaaagattttcctttttaaaatgtatactctgcaacacccttgctcttggtgaagatttcatctttgttttcacaatgctcaattaaagagaaagatatttggagcatttacttttaaaatatatatatgtcaggactccttaagtaaataattttttaaaaaatttatttagtgccaaaactccctggaagaagaaataatgacgtttttccatccgagagttatatttttattgtagaaagaatatttgttagttggcttcacaatagttgtatccctgaagcactaaatttgtatacaggagcctattaggccatgtagatttcatttgaaaaatgtaccgtattatgttctaagagctgagtttagcaaatatgagaaattgagttcttttagtaaaataaataagactgagattttaacacctgggaaataaataataagcttcatgattgcacaaaccatccttagcactgtatcccaatcctgagaaaaatgccttgcacatagtagatgctcaataaatatttttctttgcacaatttttaactgctcaatttatgcctacttgtcatgaaaaaacaggctttcttgataaaggaagatctttttttcaacaaaagacttgctaatactaatttatttctaaatgattccaagtatttctattgtgtttgtattaatatcagtgctttgtgtcatgaataatctacagagagccaagatttaagtcggtgagaaaaacatttcttgtatgggaagagagtttattaagatacattttatacatttgcacacatttatctctttttttcttaatgcatctttttatacccatctaacataaaccactcaatgtattgtatcacatagtcaatatttctaccaatggggagcagattttaacagatgtatccgatatttttattgaaaaatccatcaatgctaagtgaggcatatggtaagccttgaaaaggaagtattatttaaatgactggagaggaagaagaatagcatttgaaaaaagaaagaatgcactttagaaaacacaggagtagaattgagcagggaacaacttacccagtctgatgagaatagaggtgagtgtgggggaacagtgagaaataaacacaaataagtaggatgggctaaatgacagaggactttgaacactgtgcacaaaataattgataattatatattggaaagttttatctgattacaatgaacgggtaaaatggacagaggagataattgatgggaaaagagatcagatgggagataatatcaggtctacaccttataaatagacataaaagaagagtaaaacacattgaaggagaaatggcaaagcttaccaaccagttggatttgggagtatgtatttccccatttttccaatggggtaggaaacgacagaagcaccgacagagccatggagctgttttggagaactggtttgggaaggagataaaggatgcacaaagcattctatagactttgggaatacactcctggagtatagaatagggagtagaatagagtaactgaacgagtagtgaggcatgggaaagcatgtgctcaacaatgagtgaatgggaagataaccaaggggctgagaaccaccttaagtagcaaccacattcaagccttgagaatagaaagggaaggagaggggaaaaatgtagagatgtagcagaacatgctggtagggaacagtaacatgaaaataaaagcagaagaaaattttaagaaggattatgtgatcaagattttctaataccacagacagtgttgtttgggtttgaccaaaaaaagctattcattatcttttggagaatcctgagtacaatgttagagtcttgagactggttgcagaatgaatagatagaaagggtagataagaagaaaagacagttttttacccccaagatagcggattggagcctttgttagtgtgcctcagccacttggagagagcaaaatagtgtgtgttaccttttttctttctttttttttttttttgacaatatctcgctctgttactcaggctgcagtgcagtggcacaatcatagctcatggcaggctcaaactcctgggcttaagtgatcctatcacctcagctcctacatagctgggaccacaggtatgcacaacatccagctatttttttttattattttttgtagagctaaggtctcatgttgcctagatcttgaactcctggactcaggtgatcctcctgcctcagcctcccaaagtactggcattatagttatgagccaccatgcctggccacacattgtgaacttttatccaagaaggaaaagagaaacttaacagaaaaagtgaaagaaacttcactttcaaaggagcagtaggcagtgaggcagaaaactgtgagtctccaaagggcaaaagagggagagaccatcaccatgattctcatttccactgcagagcctggcaattcaggccacaggggagcgccttaaccctacccagcactgaagctgattttgtgagcagcgaggaggatatgaggagcggcatcaggacacactttgcaggcactcctagaccccagtgaaacagaaggaagacattcctgatcctaactcgtaaaatcctccaaaagttggcaagttaaactcagccagcgcttagaggttgccagaaactcccaactgtggtggggcgtgatggctcacgcctgtaatcccagcactttggaaggccgatgctggcagatcacgaggtcaagagatggagaccatcctggccaacatggtgaaaccccgtctctactaaaaatacagaaattagctggccgtggtggcacgcactggtagtcccagctactcgggaggctgaggcaggaggatcgcttgaacccaggaggcagaggttgcagtgagccgagatggtgccactgcactccagcctggcgacaaagcaagactccgtctgaaaaaataaataaataagaaagaaagaaactcccaaatgagattcgtgatctaatctcaagtggggatgaaccccgaaggccagagctaagcacaagtgggaagtgtgctcttgccacaggtgcgggagctggacacctctgctttgcgggtcaatccaggaagggtgtggcctgagagccattgtttgtgtcttgagtgggaagtcttgcatcctgggtcagttttgtattctgagcatgaactgcctgagattccgctggcagttacagctttcttctgctgaagtctgcaggtgtgagacacaccatgtcaggggcatgagagctgagtgggtctcactgtggtctgctgcccctctcttcctgtgcagactgttttgtgcagcagaaatggttccactcctctctggaacattaccccagtggccaggaaacttcctttcaacctccgctgctttgcatctgcacttgggcagccgcagcgcaaacttggctcacccaacccccacacagcttcacctcctttatatgccttggtagcagacaatggatagggacttttgagagttcgatggccccacccatctcctgggatatctgagtactcttcctgggtaacctaggccatgcataaatcccacagccacagctggctccctcctgaaagtgtcacctcctggcaggaggtcaactggcacagccaattacaacatctgctgacacaacatagtactcatagtgaacatgctcactgtagctggcaattgagaaagccaccacactaaggctatttataaccaaggaaatcttagagagatacatcacttccctgtcacccccatcagagctggtgcttgcacctgccactgggagaccagaggacagatcagccttgtccagctccacccaccaccagcatgggttgtggcagccccaccaggtggctagatccagaggagcaggagaattcacagtcttctgaccctaagggactgccactcctaggggaaaagggagtgcaccacaccaagggagcaccccacaggacaaaagaaaccagagagtttttctctattccagaactttctgcttgtgggcaaagaacagctgcatctctttaagcagaggcacaggcagagtgctgggctcagtggaggaagactatggctctgcacagcagtcaagcagcccctgtgctcatgaagagatttggagaagggtacttcttgtctcccttggccattgctgcaggcacacccaggaattctcctgtgaaaactcagtgagagtgcacctgtacacagcctttctggaacatttgggggtgactgcgtccccaagggaggtgtgccctccaggttcaggcttgcaagaggggtggagttccactccccctctacatgaatatcagtattcctgcagatggaccgaggtgcctatctgatctgaatataaaaaatcctgggatgggggcatgataggaaggtaggtcacttttgtgctggcctcatagtggagctgaggtgactccctccctcccctgtaaagatttcaatgtatttcgctgggagctcctccagccgcctctatcagagctgggacttttgcccactattgggttttgcatttacccagctgcttcagccacaggcagttcttacccttaggtggcttctactggcctgaaggctgaactgttcaacccagtgaaaaaatactgagggtgtggggagggaagtacacatgactggggaatgaggtaagcttcatgagacctctgccaccctagccccacaggagacagtaaacctgcttacacatccagtacatagctactacaagcagcatgtgagaaagtcattgcacaaagattctctatatctaaggaactcatacagagtctttgacatggaaagcacccagagccaaagctagtcaatcataaactatacacattatagtcacaacctcaaagctccatcaaaataaatttttaaataataagaagaaatatccccagatgagaaagaaccagaaaaatgattctggcaatataaaacaaacaaacaaacaaacagttttataacacccccaaaagatcaccctaactctccagcaaaggatccaaatcaaatgaaatctttggaataccagataaagaattcaaaaaattgattgcaaagtttctcagtgcaatccaagagaaagttggaaaccaacataaaaaatcaaaaaatacaattcaggatataaatgaaaaattatctaaaaacaaatatttctttaaaaaacaaaacaaaaaaaacagaattagtggggcgcaatgactcatgcctgtaattccagcactttgagaggccaaggcaggcagatcatgaggtcaagagatcgagaccatcctggccaacatggtgaaaccccatctctactaaaaatacaaaaattagctgggcatggtggcacacacctctagtcccagctactagggtggctgaggcaggagaatcacttgaacccgggaggcagaggttgcagtgagctaagatcgcgccactgcactctagcctggtgacagagcaagactccatcaaaaaaaaaaaaacaaaaaaaccagaacttctagaaataaaagacttgcttagggaattacacaacgcagttgaaaattttaacagtaaactagaccaagcagatgaaagaaattaagagcttgaagatgaggcttttaagttaacccaatcagacaaaaataacaaaaacaaaaagaaataaagtctccaagaaatgtggcattacataaaatgtcaaaacctaacaatccagaagaagaaggaaaaatgatgaaggaaggagaagaagaagaaggaagaaggaggaggaggaggaggaagaggaggaggaggagggagaaggaggagaaaaggaagaggaagaggaagaagaaggagaaggggacaacaataaaatgtttagaaacctatttgagaggacaattgaggaaatattccctggtcttgctggaatattagacatctagacacaaaaagctcaaagaactcctgggagatacattacaaaaaggatatcaccacagtatataattatcaggttatataaaatcaatgtgaaggaaagaattctaagagtagtgagacaaaataacttataaaagaaataacatataaaggaaatcaaataacttataaaggaaaacctattagactaacagcagacttctcagcagaaaccttctaaaccagaaggccttggggtcttgtctttagtcttctaaacagaagaactatcagccaagaattttgtatcctgcaaaactaaatttcataaataaaggtgaagtaaagtcattcccagacaaacaaatgctgacagaatttgtcacaattagactacctctacaagaaatgctcaaaggaatggtaaacatcaaagcaaaaggttgatattcaccagtataaaaacactcaaaattataaattcatagagcttatgaaataataacacagtggagaatacaaagcaattaatgatccacatgatgaatggaacagttacccacatatcaatattgactttgaatgtaaatgttctaaattctccacttaaaagatataggttggcagaattgataaaatacataatccaaatatctacctccttcaagagaccaacttaacacataaagattcttacagagtcaagataaaagagtgggaaaatatatatcatgcaaatggaagccaaaagcaagcagtagtacctattcttacatcacagaaaacagactttaaatcaacagcagtaataaagacaaagaaggtcattatataatgataaagaatcaattcaagcagaagatataacaatcataaatatatacacatctaacatcagagctctcagattcatgaaacaaatactaccagacctaagaaaagagatagacagcaatacagtaataagggagaattcaacaatccactgacagaagtagacagattgtcaaggcagaaagtcaacaagggagcactagacttaaactggtctctggaacaaatggacctaacaaatatttacaaaacattctgccccaaaagtgcagcatatacatacttctcatcagcacatagaacattttccaagatagaccatatgacaggccacaaaacaagtctcaataaatttttagagatttaaatcctaccaagtatcttctcagaccacagcagaataaaactaaaaatcaattttaggaggagctctcaaaactataaaaaacacatggaaatttaaaacctgcttctgaatgatctttgggtcaatgatgaaattaagacagaaatttttaaaaatttttgaaaggaattataacagtaacacaatgtatcaaaatctctgggatacagcaagagcagagctaagagggaagtttacaatgcttaatgcctacacaaaaaagacagaaacatcacaattgacaagctaatgtcatgcctcaaggaactagaaaaacaagaacaaaccaaacccaaacctagcagaagaaaagaaataataaagagcagaactaaatgaaattgaaaccaacaaatacaaggatcaatgaaacaaaaagttggttatttgaaaagataaataaaatcgatagaccaatagctagattaaccaaaaaaagaagaaagagaatttaaataagctcaatcagaaatgaaaatgaagacattacaacagatactacagaaatgtaaagtattattcaagattactctgaacacctctaagcaaacaaactagaaaatctagaggaaatagataaattcctaaaaacatatagcccccccaagcctgaatcaggaagaaatagaactcttgaacagaccaataacaagtcttgaaattgaattaatactaaaaaaaaaaaaaaaacctcacaacaaagaaaagcccagaactagatgaattcatagccaaattctaccagtcataaaactgacatcaatcctaccgaaactactccagtggatcaagaaggagagaatcctccctaactcattctacaaagccagtatcaccctaataaccaagccagaaaaggacacagccgaataggaaatgtccctgatgaacatagatgcaaaaattctcaacaaaatactagaaaaccaaatccaacagcacatgaaaaaattaattcaccgcaatcaagtgggtttcattccagggatgctaggagggataaatatatgcaagtcaataaacatgattcaccacataagcagaattaaaaataaaaaccatatgatcgtatcaatagatgtagaaaaatcattcaataaaatctagcatctcttcctggtaaaaattctccacaaactaggaatagaaggaaaaggaacataactcaaaataataaaagccagatacatcaaacccatagccaacatcatactgaatgagggcaaagtagaatgtgttccccctaagaaccagaacaagacaagggctcccagttttaccacttccattcaacatagtactggaggtcttagccagaacaatcaggcaaaataaagaaataaagagcatccacattggaaaagaggatgtcaaactgtctctgttggctgttgatataaatgtatacatagaaaaccccaaagactcctagatttgataaatgaatttaatgaagtctcagggtacaaaatcaaggtacgtaaatcagtaccactgctatatgccaataatgatcaagctgagaatcaaatcgagaactcaatcccatttataatagctgcaaaaaacataaaatacctaaaaatatgcttaactaaggagatgaaagatctctacaaggagaactacaaaacactgataaaagaaatcatagatgacacaaacaaatggaaaagcatcccatgttcatggattaaaagaatcaatattgtgaaaatgaccatactatccaaagcaatcttcggactcaatataattactgtcaaagtatcaacatcatttttcacagaattagaaaaaaaaacactaaaattcatatggaaccaaaaaagagcctgaatagcctaagcaatcctaaacaaaaataacaaatctggcaatatcacattacctgacttaaaattatactacaaggctctagcaaccaaaacagcatggttgtaaaataaaagtaatataaaagtagacatatagaccaatgaaacagaatatacccagaaataaagccacgtctctacagccaactgatcttcaacaaagccgatgagaacatacactggggaatcgatatcctattcaacaaatggtgctgggaaaattggatagccaaatacagaagaatgaaactggatccctatctctgaccatatacaaaaaaaattaacacaacttggattaaagacttaaatgtaagacccaaaaccataaagattctaaaagaaaacctagggaaaaaaactcttctcaacattggtgtaggtaaaagatttatgaccaagaccccaaaagcaaatgtaataaaaacaaaaataaataaataggacttaaattaaaaaacttctgtacagctaaataaataatcaacagagtaaatagacaacctatagaatgggagaaaatattcacaaactatacatccaacaaacggctaatatccaagatccacagggacctcaaatcagcaagaaaaaaagataataatcccataaaaagtgggaatatgtgaagagagatttttcaaaagaagccatacaagtggccaacaaacatatgaaaaaaatgctccacatcactaatcatcagagaaataaaaattaaaaccaaaatgagataccaccttacagtcagaatggccattaataaaaagtaaaaaaaaaaaaaatagatactggcatggatgctgtgaaaatggaactcttactcactgttgatgtattaggtaaattagtacaacttctatgcagaacagtatggagagttctcaaagaactaaaaacagttctaccatttgatccagcaatcccactaatggatatctacccaaagaaaaagaagccattatatcaaaaagacacctgcacttatatgtttattgcagcacaattcacaaacgcagaggtatggaatcaacctaagtgctcatcaatggatgagtggataaagaaaatgtcagatacggatatagagatatagatagatatagatagatagatcatggaatactactcagttataataaaagaacaaaataatgtctttttgcagcaacttggttagaattggaggctattatcctaagtgaagtaactcagaaacagaaaaccaaaaactgcatattctcacttataagtgaaagctaagctatgggtatgcatgggcatatagaatggtataatgaacactggagactcaaaagtgggaaggggatgagagattaaatattacctattggatacaatgtacaccattcaggtgatgggtacactaaaagcccagacgttactactatacaattcatccatttaaccaaacccctagagctactaaaataaataaataaatgaaaagacagcagaaaatacatgactagcccacatgaatattactaatgtatagttacctatatacagcatatattacaaatctcttgaggtcttctttgtatcacttgagttcctattgttgctataatgaattattccaagtttactgtcataaaagccacacacatttattattttcccattctggaggtcagaaatctgaaattggtttcactgagctgaaatcaaggcgtcagcagggccaattctctcttgaaggtgtaggggagaatccatttccctgccttttccagcttcaagaggcacctgcattccttggctcatggtccctttctttatctacaaaaccagcaacagagactcttcaaatctccctctctctcttggactctgacatttctgcctgcctctttcacttataaaaactctggtaattgcattgagtctacactcagataattcaggataatttccccatctcaagatccttaatctaatcacacttgcaaagtccctcttaccaggcagggtaaggtattcacagcttccagaaaataggatgtggtcatcttggaggggccattatcatgtctaccacaaggtattaattaaaacatcagaagcagttttaaattaatttgccttgtacttaattattatgtatcaatttacctttgggtcagataatatatgtgagattgattcattaactagaaaatgaaaataaaatttttaatagagtttttatactagtcaattattttctgctgaaaggcctttaagttgaatgttaaaattgttattataaacttccatgtaatggtagttgggtagcaataacaataaactgatagttttctgcctgtagcagtattttgatgagactatttttgactgaaactcttattttgtatttaaaaaatcactgcattttatgctgttatttgcttcactgaattatttaatttaatatgttctattaaagagactttaaagctagatacaaattttttctccgtatacatttttaatattcacatttttaacctaacgacctaaagataaatttgaatttctcaaactattcaacctatagtttttcctctgtaaaactgcagtgatactgaacaaaactgctgcaaagaataaataagataatgtatctataactgtagccaaattgctgggccataacaggtaggtaggtcttcaataaacttttagcctgatccaaaatatattccacaagatttgctgaccaatattgaaacatgtttctacaaatactgcagatgaataatactgtgggtgttgtttcttagtaaacttgccaaattttaaatatttggttactctacacaattaaataaaattttaacatgagcatccaagtaactctatttactaaaaatggctgtttctttacatgatatatgactaatgagtgaagctatcctatagctatacaaaatgataacgttaagcattttttattttgtctatctaaaggtgccaatacattgtgaagaaaattctgttaatttcattatatttaatacagcatattccaacttaaagttattcagaagatcaactgaaggcaaatctaaaagacagcagtgctttaagaaataaaagtcataaaacaaaagtttttcagtggttataaattactttcaagttgcattatttcaaatttcttcctgtaatctcatgttcctagctctttaactccctttgattaaatgatgttcctttgctttcactattttctttttgtgaacttgtcaaatcatctttgtcttgtcttgtacaatttaagagacttttatgtagctctctgagcgactatcaccacacaagtccaactgggagaataatttatgaggttcaaaatgaagggtcattatgaatgctgtctttcccgcaatgaatacatacactctcttgttcatgcatgacaggattttaactaaatcaatggagatagatgcttttaaatgaagtattatgaatgatatcattggttacataaaataatttactttttatgtaatctttaccttgtttaataaatttagagaactggaagaaaacttctttaggtgtgggtttatctgtaactgtcacataagtatttctttggtagaaaacacaatttcaaaagttgtagttttatgtccttaggttaacatctagtatccagtcataagccagaatattatgcatagtaagtattctgcacaatgatactaaatgcagaggaaaagcaaagagagtagattttctcaattttgaagagaggttaatttttaagtgtttttactttatcaaagtattcctgactggtgttcagcaatcattggttctagtaatgtttatttggctttttcttatcatttcagtgcccagtatcttttttttttattacaacagacaaatctaattacttctgattaatctcaatagctgtgatttggattatgaatacttcccttccaatctaactgaaatcataaatgtttccatgtcaccttattttttataagcacatggtgtaaggcataccaaataagaaaatatattaacttttatcagagagacaactgtaatagaaaactcaatgtttattttagtatatttatgtatatatgttctattattttaaacagcctgtaaacctaagcctctcctcttatctaaaaatcatccgtcctcctctcattgcctttgcattttcactaaactcccctctgtgtatttatcttgctttttaggtatttacttgtgtgagtagtttatgttttttcatatgtcctgagctctctgccttacccaccatgccttgactataaagaaatgatagctaactttggccaggtgtggtggttcacgcctgtaatcccagcactttgcaaggccgaggcaggtggatcataaggtcaggagatcgagaccatcctggccaacatggtgaaaccccgtatctactaaaaaaaatataaaaattagctgggcatggtggcgtgtgcctgaagtcccagctactcgggacgctgaggcaggggaattgcttgaacccaggaggcagagtttgcagtgagccgagatcgtgccactacactccagcctggcaagagagcgagactccatctcaaaaaaaaaaaaaaaagaattgatagctaacattaattgagctcttgctatgttccagatgcattaaaagctttttaacatattaatccctttcatctttaagccagatgaaatgggtaccactgtaatcttcactgtatagaggaggaaacagaaactcagaacagtgaagcaatctgagtagagtcacacagcctctaagtggccgaagccaaaatctaaacctgggttaagagccaccgaacacatgagcatcacccacatctggagaacttcagtgcatacattttccccatgcttgattttcaaatcaccaagtacttttaattaaccttcactattgttatgatttgacatttgttgttctatatatacaactaatatctgccccataccatgccagaacataagaatacaacacctagtattttatagatgagtaatagcagctgccatttattaagcttttgccatgtgccaggcactgcatcttattatttaatactcagaaagatctatggggtacctaccaatttatttccactttagagatgaggaaagtgaggcagagagaggttagatgacttgcccaagatcacacagctagtaaatggtgaagccaggatttaaactcaatggctgaactccaaagcttggctctgaatgagtgaagagatgtgttcctagaaatctagcttggagagtcaagaaaagtaatagggaggagatgacatttgacatatctggaagggcaaagtgggaaagaaaggaaacaatacactcaagggagacaacaacatggataaagtactgaggaatggtgtacctgcagcataacaggtgctcaaaaatgcaaatgaaaaaaatgaatatctttatagcccatgagttaaaaggttttccacatctaagtgttgtatgactagtgctctctgtgtgtttctttcagtgccaccgtgggccttaattgcaatagccatagtcgcagtccttttagtcctgacctgctgcttttgtatctgtaagaaatgtttgttcaaaaagaaaaacaagaagaagggaaaggaaaaaggagggaagaatgccattaacatgaaagatgtaaaagacttagggaagacgatgaaagatcaggtaatgtattctttctacatttcttcttattttgtttaaaaaagataaacaaatgtattattttatgccatataattacagaaataaacaacttctggacccatatcgtttttgagatgctttgcaaacctttcagtcattgttcaagatcccaaagcataatggaagcatttggcagggttttccaatctcctgagcatatagaacagaaaagggcatccatgatcatcaggcccatcttgatgggtttggcatatgagaatgatgcctgaatattttgattacatctgtttaaccagtcttcattgcgtttagagttagaaaaatcagataaaaagtgcctgagtgttttgcatttgggcaggggatctttctaatttctactgttcatagtcactgttaaataactgagttttacggctgttcatcaaactggatgaaagctgcttttcctacatgtccatccagctgaaaaattaattctcaagaataatgagttacatgggagaagggagagaaatatgagccagttctaaagaacacgacaggatagaatttttgccttatgaaaaagttttctttcttatttcttataagacaaaattctcatttcaatttaataaggacaattacaaccataacactggttataaaatccatctggctgggttatctttccaagcccaaaaaagctatttggatgttctttatgttgctatctgtttttggctaaattaattggacaacttggttcaagataatgtttactattattaatgataattattaaatgcctcttcatttttgaaataatatccatgttgaatatctctaaagaatatttaattcatattttaaaattaaaatgtaaatgtacagattttttatagaattaacattttcaattatcaatgttttcatcaaatacaaaagttttatttattcccaaatagcaaaatatataagcagttttataaattcctcttatactattaattactattaatcaaactcttaaacctgaatctccttaagaacaatttaatcaggtgttacaacaggcattttaagtacatttgcgttgtttcctagttcattacacattcagggacattaactccccttcccagcttcagttttaaactctttttcctcaaagacactatagtatctattgataataatttcacaaaggctcatgttttactccctgcatttttgttctgttttggagctatggaatggatgaaatgcctgtactcatactcagagagttttggcctgagctcggagtagcaagggtttgatttttctggcaatttctaatcacagtcacaaaagccaatgcataaacgttcaactacaggtgtctaataaagatttttctcttcagttaatttaagtagaaactaaaatttccaggcatgtcttactttatttccacacttttcatagcaagcaggacttgataaagatttctttaaacaacttattgggagattaagtgtggaaataacctcctagatggacatggactgaataatatgtatgttaattttatcaatattgtgaaaacaataatttgacaatagatcactatctttttcataattatcataaaatttgaatgtggtttccctgtgttctagaactaattaaaattactgaataatgttaagtgataacgatagcatttcttcctaggacaataaatctataatatttgtgggatttgttctgtatgatgtaaaattataatttacagcatagtggtggtgtttattacccctgttatgacctggataaatgaccaagatctcaaatatagagaattaatgggggttaatttttcattgatgatctattttttggatggggagagacagagaaaatgattcaaacaaagaaatattaagaagtcagtgatagtttatactaatctgttattgcaaattatttagaatttcaaccactcaaaaagatgttttcagttattttaggtagagcactttgtctacataggacattagctaggtctcaatttttgtaagttatgaacaattaaattcacagaataaggtacaatttggacagatgaatatacactccagggataaacgtttatataaccatagcttatgctactttttgaagcagacaaaagtagctaatcatgggttccatcattttatgaagaggaaggctaaaaaagcaaaatagaatgtgcagattttaagaggatgtttcatcacatgatgatcgccagatcacccaaaattcaaaacagcatgaatacaaattaaaattattattaaataattatattttcaaaatatcttcagcagaatgttgaagtgaacatggggaagaaaataaagatggcttatgcccttctcgtttaaaaacaagacagatgtgagaggcattttagatataatttcttaatcttaagaaatatctatatataggctctatatacaagatataaaggctctaggacaatcaatacatttttaccattttaattcatatcaaattcacagaaattccaatttcaatattcatggctacatgtctctatagtaaggttttgcaaccaaggaagatttttttaaatattctgcaatgactacaaaaagtatagacatttatgttgcataagatatatatttatgtgttcttttgtatgtgttaaaattggagaacactaaccagacagagggaaaatattcacatgtaaagtcataggtctggaaaggtcatttctccacggttttcactaatgtgtgtggatattttaatttttatttcttccttctatgtccttatctgtgttgtgtctcatgactgttctggactgtcccttgcggtaggtttcctctgctacttagacatccctagtcaacgctcagatacatttagtggcctggcacctggggctccacagctgagggtatatcattctgacacacatcaagaggctgaactaaattgatttttttaaagataaggtgttctcattttaaacacgctaacagattaaatataacagtattagaaagctcaagttttaagttgatggacacaaaaagaaattcagtcccttgtgctacttttctagtgcgccttattaaatccaaatctgaacaatgtaactgagaatgaacaaatgctccttttgatggttgcaaacaaagcacctgttgaatgtcaaagcaaaccatatgcatgcgcacttaatctttgaaatttaagataaggtctgatgttcccaacccagctttttctactgcaatttatcaaacctcagtactgctaggtttacaagctttttcttccgaattttgttctatgaagaggaaaatagtgctcttgagatattataatagctactgatttaataggtctgaatttaatatgatggtacagaaaatgtcttgcttaagctcagcctttgggacaggaatagacttaatcacttcagtgatgaacagtagcactgagaaattatcaaaaatttagccctatttcatgcagaataattgcagagatggtcctgccttctattcaggtaaaaaccacttagggagaaggagatttaatatatcagctatttcaaattgcattgggctgaaacatgatacataaattcagttctgaaagagacttttgaaaaaggtattttaatcaatgaatttttcattataataatagagcaacatgcagatttatcaaacagaagtagatgttaaatagcttgttattattttttaaaaaccaaaatcttatagggaggcaaattaccgaagctgcaatttcctgagcacacctaagacagtgttaaagacttatacacagctagggttttgaaagggcaaagggattccactgcctgaagttctctaattaaactcagtagtttttttttttttttttgtcactttactatcacgttacctttagtgaccaagccccttgttcacaaattaaacaattaaaataaattttaaaatattttcatgttgtttcctgcctttagctattagtaagtcaacattttaacattcaaagaaacaatgaagcatagattaaactttccaaattaagtggtttgtagctaaccaaatttgataatgtttctacaccgatgtatatcatgatggcaattttcaattttcaaaactcactgaaggctcctaagaaatttccagcaaacaaaggggaggcatcactgacaacagctcaattctgtttatatgaccttcccacctgaatgagttctattaaactgtgatacagctgagtctcagttttttagaatcaaattggagttaaccgggtgaagccaaattagaaaatcttgtaatttcaaggactgagggtgccattttgaagcaccactgaagatccctgagtaagtgggtggattgaacagagaatctccttcctgagaatgctgaacacagcaaagaaaaaagaccatgtagtcttggatgtgggggtagcagagtggaggaactgcggtctgatgactgatgcctatctacagcctggttatacttcttgcatttgagttctatgagaattcttagattcaatttgagagctaagaagagttaagattcctttactttatcagagatataaaacagtctaccactggcttatccattttgatttctgtgagattctacagtaatacatgcatgcatacacatatacaaaaatagcaatgaaaatgctataacctaaaaccaggagacaataattgtgatatataacacaacaatgaagttgaaatcatcaaaatacaaagagcctttgcaaatcaataagaaaaaggcaaacaacacatagacaaattagcaaaggatatgtacaggcagtccccagaagaaaaaatacaaatggttaatgtaaaagtttgtaatcttttcaacctcaggaaaatgtaattttgtatttttttaattttgaataatgactgtgtatagatttctaattaattattctaattacttaaagcagtaagaattacacatccctagaaacaaaacttcatgtacttataacctttgatatttttagcaaaatgtttgcatattagaaaaacacattatatattttgattttttaaaaagaagagcatttgaatgaaacttatgagttagtgagctttctaatatttccatttatagtacacttaagttttaggttataaagagtattcaattggtcagactgagttttgagagttcaatacaattgattttgttcttaaatacaaaacgaattcttatgccaatttgtttttgacagaactgcaaacttaactctttttatcttttgatatcaaacagactcttaatcaatttaattcagcctagcttttggtggagctgttatgaaaataaagtggtaaactgaaattggaagtggggtgaacttttctctaaacacggatttgctggtggtatgtttttttcctctttttcataccatgataaatgtatatgtgaaacacagggaatttaaattttctgaggatcattactgaactatctttttcataggaaataaggcaacaaaaggccatgcattttatattaattattccactgcatgtagcgatgatattttatatgatgctgagcatctctttaaactacatgaatgtgaaacttggcctggttagtagcatgtttatctttcctctgaaagcagcagttttatcagagccaaatacaacaccaagttgacactttctttgcaacaatgttacattttttgcttgcaatattctgaggggcttcttccatcgcttccattttgcttgctgattggggaaagaaattccgtgcacaaaaggaatttaaaaaatatgtaagcagcaaatgtgaatgtgtgtcagacaaacagatttccagcatcttagtgcttgcttcgaacagcttggaagtgtaactacaggcccagttcaatttgagttttgatgaaaactctgaaattcacatgtgatcctttctctatacataggccctcaaggatgatgatgctgaaactggattgacagatggagaagaaaaagaagaacccaaagaagaggagaaactgggaaaacttcagtattcactggattatgatttccaaaataaccaggtctgaagtggagaaatgtcttctaattccattacattttctgaaattaccaagtagaaattgcagcaagatacctcttaaaatattttgtttgctgtgaggggaaaatgcaattatcaaagctatggatgaaataatttctaagaacaggcagtcccctacttgctaatttaacttctggtaattagaattcacagtattcaaccgattacatctacttgtggcactttcagcaggcagacagaatacaaattaacttgaagcagtcggtctgcttctgagagcttctagccacagtctcaccttctcagcttcctcagcctgagctgcagcaaccttccttggactttacagatttagaactagacagggctaggggccttttgagttgggccgctattctagccaaatttttgaaaaataatataatgatttgataagggatcgaagatgaaaaattaattcttgtccattaaatttaaaagcaggatggccttatatgatactaggtgaaactcctagtgctaatgagacagcaattctaaaagagtgagaaaaccagagacttacttctagtgcctaggaatattgcccaaaaagtgacaaggaactaaaggaggtaacaaaacggacatttttgcttcaatttctcaagaagtcatgaaatgtcacctagatgaatgataatattggctaccttttattgactgcctgtcaataaaatagagattgctgaaagacaactgttaaaaatcgcttttcatttgaagacattccaggatccacaacgttgatgaaaatgttcctcaccttctgaattgttaaagaaatgtgaaagctggataagaattaggggaacaggctaagttagagaccaggtttttaaaaatctgtaagacaggcagggtgcagtggctcaggcctgtaatcccagcactttgggaggccaaggcaggcatatcacgaggtcaggagatcaagaccatcctggctaacacggtgaaaccctgtctctacaaaaaatacaaaaaaaaaaaaaaaaaattagctgggcgtggtgacaggcgcctgtagtcccagctactcaggaggctgaggcaggagaatggtgtgaacccgggaggcagagcttgcagtgagccgagatcgtgccactgcactccagcctgggcgacagagcgagactccatctcaaaaaataaaataaaataaaataaaataaaataaaataaaataaaataaaataaaataaaataaaataaaataaaataaaataaaattaaaaaatctgtaagacatagcccttctccaagtaggaaagttttaaacctctccagttcattttgcttctctcatctttttgggtaaagaactgatgaatgtaaaataaatacagttactagtaatgcagcatgtgctaatgatttccagtttgatgagaaatgaacaataaataaatgaaacactaatgctcatctttgataactaacatccaaagtcagtaatgctgtgagagctctaagcagttgcagaaattctgtgctttatttaggaattgacagttctaataatgtcttcactttctaaagtttccagagggttcctcatgaaggatgtacaaatatactgtcatattaaaaataattttttgatcagcttcattatagccctggctagttattacataatacattctagaaaactacattattggtttacaggttcaggtttgtagttataccatttttagttaattacatctgatatttgtggtcatttctatcacttctatgaaaatttgagcatcaggatttggttaggagcaaaacctcttatttatatattctaggaaagatcaaggacaacttatattggtcttaatatataacatattttccaaaaatttaatctggctttctatatgcatccagtatttttttcatcatattgaccattcatattttccagtggaaatctagtggtgtctcattctgattagtcataattttgaagctttcaagttagctttaattattaatactataagtatcattttataaagtagtatttttaagaaaataaataataacactgagaatttttttactaaaatatagtgagagtacatttactgttcccttttcagcaaacatcaaatctaaaaagttatttcattctgagaaactgatgaatttttaaaatattacacattggtttttcccaaatgttctcagttaatttgatttataaagtgattcctaagaagcaggaagttaaagtctgaaaaacttcataaagtttggatcaaatatatgtttaccaaaactaaaagacaaccctaaaatattctaattaagacgctttcatggtacagagaaatgtgatatttatctcttaggcagaagtcagaacaaggttgtaaaaagtaacctcattctttattaacaaaatatccaaaaactctaaattataaatcatctagtttctaaagagtttaagccatctctctagcattttttctgctcaaaagaaaattggttataaaaagtgaggatgaggaagtagaatcttacttattcgcattactacataaaggtaaataccaaatacctacttagcaaacaaagagacagactgtttcctttactaatcatgtctttataatccgatgcctattttagctgttttttgaccatctgtctgtgttttgtttacctacaatctagcactcttattgccactgttgtatcatgattccacaaaaaaaaaaaaagatattgaagcattaaaatagaaacaacataatcattcaggttattgggccatgttaaaagttgagccacctagccaaaatgcacttaagtacacggtgggtcacaattaaaatggttatgcattttttttaagagggggaattgcttttttactctactagctaaaaaggcatgaactcagatttttcaggctgagatgtaaaaacctatggtgttactgcatttacaaaatagcatataccttgaataacagtaagagtctgctttgttacctatatggatctaaatcagtctgttgacacaaaatctctaatggcagagtatctatgatagtctactcacacctctttttttcttcgcaaaaatattaaccataccataataccttaatattcataatgaggcttaagaatgcatcagtaagaaaacagacttaaagaaatgtaatagttctgtggtgtttggaaaaaataaaaaacacagttactcaccattaaaaaacctcacctctaatctcccttgctttctatgaagctgaaattacatttcttttactccgtgtcctatatttaaacacagaatctcatagataataatcattctactgtaagttaaaataaatgtagtctgcacaccagtgaaggtcaaatataatagaaactagaagatcttattttttatctcaaaatgctacccaatttctaagaaatttctactcagctagcctgaggctttgataaagaataaaagtttcccactttgtaattacaaacttgtgattgcttaacaatgcattttcacttacaaatcatgctctggaaagaaaaacaatgcacaagagcttttagcaactggaaagttatttgattacaactcttttgcaaaaatgaactccatatttaactgcaatcagcaaccttttaaaagcctcttttgtgcttaaaaccaggcttcccagagcctgcatcagtcataattgggtttctgaagtctacatagctcagttcatttgccttctgtgttcagattcataagagaatcagagttttattaaaaataaataggaagagggagaaatcccaatatgcagcattgtgaacaaatcgatcttttccaaaatgtccactgatatttatgtatgctgtattctgtcatttatttcagctgctggtagggatcattcaggctgccgaactgcccgccttggacatggggggcacatctgatccttacgtgaaagtgtttctgctacctgataagaagaagaaatttgagacaaaagtccaccgaaaaacccttaatcctgtcttcaatgagcaatttactttcaaggtatttgttaacatttatttataacctttcctttgttgttttacttaaaagactgatctcatcctgacacatacatagacatgcacatgaatgcttgttcaggcactcacaataattccagtcagaatatgcaaaattcttatcttcactacagtcaacattcgatattgcctttcagcgtgttcagagtaggattcggttcagtcatttcagaatggaatggactagaacatgactaggatgtcatagtcacatctaaaaagtgagatccctccctgaaataaagccaaaggaatgaaatcattatttttctgaatttcaaagtttgtgaaaataagtacatctgttacaatcccaggattaagtaagctgtgtcccaatgcttaaatggtacaaatagacatgactcttgtaacaaaattgtgtgtgtagagggcaatttgagcacttcaaagtcattcttcttaactaatcaataaaaggaatatgaacatattttttattgcatttctagccttcttcctttactctaggttctgccctgatgttcttcatcttgttgaggcacctcagttgacaaacaacagagagattccagccatataatatctcatcaggaaaacatgtcctgcaggtctccaggatcttcgtggatcttggcttgaaatcattcattaaaaacaattcttttggtggatatctttaacgtgcgaaaaaaactttttaatgcattacttagaacaatatgtttctgaaaaatgaaatatctgtgaatatgccagcaggctaattcaaaatcaccacgtccatcagccaggcttagcatatgccttgtgttggcaaacattctgggatgaaataaattgaaaatgagggcatgagtcattttctcaaaccttgttttcaattatgtaaaggggaagtgtctttctattcactctaaaatttctgagttttcaagacaaaggtccctcatgtattgtcagtaatcttatttaaaatctggtttttctgtacctaagcagtgaatttaaagtagcagtaaagacattctggaaatactcagttcatgaagagtatctgctcatgaagcttaatcactatagtcaacatactacgaaacgtaaaatggaaataaaattttaaaaatattgtaatagtaatcacagttgttttattcatctatttattaaccttaacttaggtcagcagtttctgaccaaaacttagtaaggaaattcttaaattatatgagctaatgtattggggctttgttttgtattgcattacctacattattatttctttaaaaaatgctaataattttattagtaatttctataaaaccaagtataattattgaaatttttgaattctctatacatttttatcaagtttcattttatttcagaaaggttgatcaaactatacataaatccaaagtataatatattctgctatattaaaaaatacttcaatttttctagagaactggttagacattgtagattactcatcttgaaatgccaagaggcaatatgatacaggaatggaagtataaaagactttaaagaagcctggctttacaatggatttaaatcacttaacaggaactcaacatgccccaaattaattcatcttcttttcccccaaaacagttatctgaaggagctactaatcattcaaacaataaatatttttaagtgcttcttctgtgctaggtgttttacatatattcattcatccctaaaatagccccatgaagcagccattattacagtattatcacaatttaatagatgaataaacttatgtttaatcacgtgccccaggccctttagttggaaagtccaaatctggtacaaggtctgtctgaccccaagtccaggtttttgactgttgctctttgagtacaatcactagaaagtctagagagattttagatatacaataacattttcaagggtttatccttactctaaaaaattttgtttctttctttgagagtcagctctttggaagggtttattttccattccttctaaaatggaaaaaggatgatgcttactttttaatcatatcattttaataaaataatcaggttccaaacagatggtaaataaatgacagaaaagaaaaactctttggaaaactaaaatttcttgtatgtagatggcccaatattcttccttttcttccctccttaatatacagagttaattgagaaatgtttgctgaagcataagacaaccatttacactgataaaataataggaagtgtatgaaaattgatcaaacctttaagacaagtctaaacaatttcttaattaggtatttctacccagttactgaagtgtagcttacttggattgcactgctttcactgaatattaaaaatgtcactaataaacatcccaacccatagcatctgtcccagatatatttgaacagctggagaattcatcagttcttggccttttgccaccactcatcctaaggcatgtcatacccaagaatgaacttcaaaacccatattataatgcacctcttatattcaaaacatcaatttcctagtcagttcttgtcaatcagcaaattattttagggagtaggtgaggcacttgtgaatatcatttcaatcctttcagactcctagcatagcctttaataaatcattgctccattgaactgtggcatttaaatgccttgaaagagttaatggagcatttgaaataagttatttgcccctcagtaagttacaccctgacaatacaacttaaaacaacaataacaacaaaatattctacaagaaaaacttacttatagtcaaatgcaattggcttgtttattgttttattaatcttaaggctttatagtataactaacagcaggatccattattaataatgctaacagcttctagaactttgagataaggcaataaatcactaaaatttcccattttctctcaagtaattttagcctcaagcagtttgtcaaaagtctgaatttaaaaaataaccaaaaacaaaattatctccctgttctgtttatgcaacgtaaatattaaattaagcaccatgaacaagtaacatgttttaagcatttttgtgactggatattttatcctcatgtcttttaatttaggtaccatactcggaattgggtggcaaaaccctagtgatggctgtatatgattttgatcgtttctctaagcatgacatcattggagaatttaaagtccctatgaacacagtggattttggccatgtaactgaggaatggcgtgacctgcaaagtgctgagaaggaagaggtaagggaattactagcatttctaacatcacaagctgtactcgccagttgctgctcatataataacttattgagaaatactctttacaaagggggatgtgggcctctagttgttgacagctgataaaatagggtcaagggcactgcaccacctcgttaaaaagtgtacaggtcttctgggtgttatctgaaagaagagagacatttgtgtactggatctagaaacagcaaccctggacacaaacaaacacacatgcccacaggaactctttctaaaagcttacaaaaggccacacacactcataaactactgctttaaaatgacaacgaaaaattattttatttctcatttttccacaatcattttgtgttttctgcataggttatgtagctattacacagaaataaaatggtactttttccttgattgtttctgcatatcacagacagttcattgtttctcctaaagatacgagagcatgattggtcaaacatcaaatataattcacaaagcctgatattaaatccattttttaaatgactcacatttttatgctactcctcacattgtttattcccagttttaatagtttagcccagtatttttccatgacttgaaaagggaagttcaatatgtttagtgcatttaagcttcataataatcaattgtatctgattatgcgatgcctgcctggcaccagcatttttctctgcaaacatttcagtagaccaatactagaaaagcaaacaacccttagcttctccaaattcctaaaacaactcctttcgcagtcactctttagttcctgacgtaaggctgtaattacgcaagagattgctgacagctcagtcatttaggatctccaggtccctaggattccctggcctcttggggtcaccagggagatcagagagaacgtcaggccttcagagaaactcaatcaagtccatcacctgggaatcctctcagcctaaggttttctgtgaccaatctgaggctatgaactttataccccctatatgatgaaatgaggttttagaacaggcctattaattcccatgctgaaattgaacttttcactctaacattgctgtttgctatttgattttacaaaatgagtcaaaaatacttaagttaaactctgctcttttttttggaaaaaagtatgtatacttatactttccaaaaaagagagcagagcttaagtatttttgtatataatattcatgtatacttattatatatatatatatatatatatatatatatatatttactgtctcaatatctaagaatgttgactaacctttcttagacattgacacagatttagccctactgtggatattcaagaatacccaggaaaaataccgagttttaaaattatatgattttatggatagttctttcctataagtgaactaatagtaatgttacagacatcttcatgaaaaaaaaaattcgatcattcagttacaatgtttataattatttaacaaagtagtgggatgtttcattgacttttttgttgaagtgtttgactttgtgtaaattttttgggtgataaagtaggaccataagaaatgtttattaactgattggttttattaattgactggtgtttggttggcttgttggttgaatatgagaacatgaaccactggtacttcacaatgcccacttgtgcagggtgcatggttcacacttgttactttcacctggataattatcaggtggtaatgacatccaagatcacacccagtgggtttctgaaaaattgtgcaatgtttttttctgagctaagggaatgtggaccattgagcaagtttcctctttcagaaatctttgagtacgagcagagtttgaaacttaacaccaggctgacgggtttcactctagaatctaggggtttaggtaaactgcccattcagaattttaacctagaaagtggcctaacatgatttaccccttatcttacttaccgatgaaatagaatagaacatgaagtacccagcatagagtctggcatatggtaaatgttcactaagtgagaggtctctcatacctttttcttggttaattttgtgtgtgtgttctctttccccattttgtgtgttcatctcctcatttgttgtgtctcttccctctatttttatctacttcgctatcctttttctcaccattgcacttactgagtatctgtaggagttattaatgggaaatattaattttatcattacactcgtaaaactctagagactttcctctttgatttctactcaggaatagaaatttttggttttcagttagactatttctctttatcaaggtataggttataaaaaactgtataagacagatgtctagcttacaaagtatctctggatgactagacccagttagaaactttttcattataaaggaagtaagattccacttgcattttatatctgaagaattacatattctcaatgatatctgctctaacttttcatgccactgtccattaattgtagaaaattataattgtgtgaataaattgaagtcttagattgactttagttttatgattttaaagaaattgtttttccactttacatgagcaattttgttcatgattttagttttgctttcatctagcagtgttaagcattatttttaatgtcataatgagatgaaagatatcaaagaaagtgagaaaaaggagttcaaggaacagctttggaatctagaacaagtactgctaatcatagtaagctgttctgccggagacttggatttaaagaggttaaatcaaacccactgacagccaactctgtgatgttaattaaatggagtaaggttttattgccagaaagttgacaactataagtcataagatgatgaagtaattgtgtaacttaaaggattatgtactattttagcgaccaaataatgtgcaagcaatttagaaagaaatgggaaggaacatggatagtgtaagagcctcatttggaagtgactaggcccatgtttaaaaggaagtgatgtggaagagataaggtgtaccaggaagagccacaacaaaagcacattgttcccactattcgattctatccccaggtggaaacatcactggtgaggtttccatttggcttgatcgtgttccgcaaatttacacaatcaaagccacctcactggtttccgttcacttgccggtttgttttttcagtgatgcacggtcgactactttcttcctccacttccccaccttctaatagatgaaggtggaatttgaccttggagacaggtcaacatttctcttgtttttgtttctttaaaacagaaatatgtatcctctgagttcctagagatggttatatataaaactgttgtttcttaatttttttatttctcagtatatggcttcaaaatcatccttggtaatcagtatataattcttcagtgtgcaaaaggctaccaatatgtatagccccaagctgaatctttgagattttcttctctttaatctttcaaaaaataagtatttattgtatacacaagtcaaacctgaaaccaatctttatctttttagaataatctatttaatattttgacttaattatttcaaacattacaagcaacagctatgactccatttttcccttcttataaatttcacttatgtgcagttttaaaattgtctcagttctgcaccccaggatcaggtatatcatcaaagtatttaaactctttttattttaacattttgttcctatttataaagtttatttttatctccatgccttctactgatatttgttatctctaaaaacagcataaggaatagatagcaccagaaaaaaaaactaagcctttttttttaacattccgccctgatatgctgcaagctctcatgacttgagcagtactgttttattgttttgtttccattagagaataagtctatcacctcggctttgtgtaaaatttggtaaagagtgatttttaaatgagattctgtaatctagtgcaaatggaaaaaaattgattgcagaattaaaacaagttggaacataatttaattagtatccaagcagaagggaagagaaactactttaatgctttaatggaaaatcaattttgcaagaaaatttcacatttttaagcctaattagaaaaagatttacttcacagaaaagcatgtgaagaatacatattcaatcaaatggcaacagttttttaacttccaatggtcaattccttagtacttccttggaatgagttaaagtcattattccttatggcatcttttatgcccaaggatcatgaaagaagtgatgctatttctaagtacatttagcaatcagacggcaactatgctctccaagaatctccacccaacgatcaatgccctgattggaaatccttataaaaggttaattgttggaattttaaacatggatgccaataagaaccttcctggtcattcattcacaacctatcacatttgagaaatacaacaaaaacattaatttgcatccatagcatttcaggaattatacttgtttttctttacttgttcattgtctatcttcctcactggactgaaactccatccaggcagcaaccatgtctatggttcctcaccaagtgtaatcacagaggcaagaacacaataggcgtgaaaaactatttttgaatgaatgaatggagatgtttattgtattgtaagaaatgtgtccaaacgccctttttaaagtccgtgttaatagtcattgtgttcatattttacaaatgaaggttaaagtattctgaaagctaatcagcaaaatgtcctagctctgaatgctgaagatagtttagtgcctttctgggtttttttggtatgtttctttaaagatagaggcagtacagatgcttagcaaaatcaaccttgttattgtttttgtttttggttttgaaaatgataatagattttgtctcaacaacttttgtttgtttgttaaaggcttatttagtgtctccctctttgtaaccctctttttcatcctgtttccataatgcacatggagctcatagattaccttaatttttatttaaatgtaagactgaaagctatggtgtaagtctctgcctacatcatggaaattgatccagaggaaaatgggaaagaattagttctagggagaactcaaagagtaggaataaaatctaagtttatcatgcctagaatatttgttgttaatcaattttataatatagtagatatagtttagtagtattgaattattttatagtatattaaaactataatatatattagtgtacctagtatctctgcgtccatatcatgggacttggaacatattgatttccctttaaactgctacagaagtatagatgtgttttattttttacagtatcttgggtcatagctgtggtttatttgagtttgagtctttggttagaatttctgtcaccaattataattgtattcttatgtataataaatgttatccacttcgtgatgtggtttccaagaacatgataggaaaaagcaaataacttgaaatatctctctagtatgtaggactgtaatttgcttgcctttctggttaaaaagacttttcaggcagaggtaaaagaaatccaaattctcactttagagtttctaaacaaaaatccaatattttttattttaaattccctagaaaagtaatataaattagactctaatttgaagcaagaattaaagcaaggagagatcctggacattttcaaaatgcactttggctaccttccattgttctccctcacgttgtcatactttagcctactgcacctgccttccttgtcacagtgataaccacccaaaggtctggtctcacagcctggctctctagcttccaaagttcatcttcattaaagcttatattaacttctctacctatcctataaacacaaataatagctatcatttactgagagtctactatatgctgacaaaaaaaaaaatctcataacattcttcaaaattggcattaccaaatctgttttacaaaacagggaaggaagggaactgagacccaggaaagtttaagtaatgtgtccaagtttacacgggcaatgccataactacaattcaaacacaggtctaaaagcctacacttgccattttttgagattgagtctcactctatcgcccaggctagagtgcagtggtgtgatctcagctcactgcaaccccccgcctcccgggttcaagcgattctcctgcctcagccgcccaagtagctgggattacaggtgcctgccaccatgcccagctattttttgtatttttagtagaaatgaggtttcaccatgttggccagcctggtctcgaactcatgacctcaagtgacccacccacctcggcctcccaaagtgctgggattacacgtgtgagccactgcacctggcccacaccattttctttaaagagtctctcttggtcttttcaggtctgtctggctcccaaacccattttctctctacactgccatattgccactaagagagtgcaaggatattgtctgttttgtttatctacttaggcccagcacattgcactgtgactgcaacatccaaagtgcttaaataaatattttcaagtagattggttgaacaaattagaatttaacaaatatgcattctaatgttctatcacctttgagagagtcatctttaaaagatacccagtcattccagttgcactgtagtatcctaaaatatttttgaattccagtccctctctccaagtatctttctcaatgtataatacattatctgttctcaataatgatttgtctttgctttgaaaaggtaaatctcattgaaatggccataactatgtagggtcaagtataggctattagttgatgatcgaattgggtaaaacagttgtaattactgtgggaaagtgatgagatggatgttcttgtgagttttatattctgattctgtcctaaatgctttgagcattaacatcattacatggtctctcaaatggtttgctatggggaaaattctcattaggagatataaattctgatacacatagtaccaagaaaatataattgttttaatagaaatcaatgtaagtattaggttttctttttatccaaagaataaaaggaccgagagttttcagctgaattttaaataaagcagagcaaagtggatttgggagcctggatttcatgtgtataagctggcagagcagaaagtgaggagtgggagttgaaatgggaacaaatataaaacaaaaggagaatgagaataatgatgtagacaagagcagccttgtttacatctggtttttcatattactgaaataatgaaaagggttttgagtgggaagcaatgtgagcaacacaggagaatgttttgttctgtcttccacagatttaaacctattcaaatgtaatcttttctcttgagttcatcatatgcttgggagcaatattttttatcttgtttgtgaatcttaaaattagatgtttttaccttctgtcttactcctacctacctttgagcaggccaaatgtttgtgctgtaaaatctttaatccattacaatctgttactctgcaattagatgaaatgtcagtgattgacttgtactagttgtactacagaataagggaggagaatgaggactcgctgaaaaacaagagcttaaataattaaagaatgcgagagagaggaagcatacacagacacacaaacttacttgctttaaacatgattaaattcttgccaattatgaacaagaacttttaaatactgtaaattaattttatttattcattctttcactgatttcatcatatattaaacctcttttataagccaggtattgtgctaacttcagggaatacagtggtgaataagatagacccccacgttcggccacctgaccttccgagctggcggggctgaggctggagtcctcccaggagccacaggggaatgaaatttgcagacttccggggcgcctggccctgggcgttgggcgagcccggggatggtcggaagggctgggggtgggggtgggggggcgtgggggggggcggcaggaggagcccgaacgaagcctttgcgattacagtcatggccacccagatggggcagtcttctggaggagaagggctgtttaccggcaatggcaacattggaatggccttgcctaacggcatgtatgacttgcatgatctctctaaagctgaactggcctcacctcatcctgtcttgctggcaaatgcggccttcagtgggaaagtaaatggcagctgctgtgattacctggtcggtgaagaaagacagatggcaaaattgatgcctgttggggatgacagcttttcagatagtgaagaaggagaaggcctcgaagagtgctgaaatgaaaggtgaacctcatgggctgagacgtttggaactcagcgttgtagaacttcagcctgcatttgaagcatcagctgctccagagatttacagctcaaataaagatcttcctcctgaaacacctggaacagaggacagaggcaagaactcgaagaccaaatcctttcgctgtaagtcatgccaatatgaagcagaatctgaagaacagtttgtgcatcacatcagagtgcacagtgccaagaaattttttgtggaagtgcggagaggcaggccgcggtggctcacgcctgtaatcccagcactttgggaggccgagacgggagaatcacctgaggtcaggagttcgagaccagcctgaccaacatggagaaaccctgtctccattaaaaatacaaaattagcccggtgttgtggcgcatgcctgtaatcccagctactcgggaggctgaagccaggaggcggagcttgcatgcggtgagccgagatcatgccattgcactgcagcctatacaacaagagcgaaactccgtcaaaagaaagaaagaaagaagaaataaagaaagaaagaaagaaaaaagaaagaaaggaaaagaaagaaaagaaggaaaagaaagaagaaagaaagaaagaaagaaaaagaaagaaagaaagaaagaaagaaagaaagaaagaaagaaagaaaagagaaggaagcaatagacaaggaatctggctcttccactgcagaagagggagatttctccaaggtctgtattcgctgtgaccactgtggctacaataccaatcgatatggtccctatactgcacacctgaaacaccacaccagagctggggataatgagcgagtctacaagtgtatcatctgcacatacacaacagtaaacgatatttggaaactgtaagcctggaattaggagacataactattccttcaagttttatagaatatcacttgggagattccaaaaccatagctattacatggcaaacctaggataagagcagtagtatgagtgctggcagaccagctgccactttcctatacagtgaaaaaggccggtgaaacaagtacaggccagatttttaaaaatcatactttctcaaggatctccacaaactggagggtgtcctggctgtctgtgtgatagcctctttctacaagtgaggcctcaaatgaactgcagctatcctggtgttcctgtgggggcactttgtatgaaaaaagggcatgtactccaaaacatttttgtaggttctttggccaggcgccaaacagtacgaaagagtccaatgtaggatttttcttactgatagcagttattcattgcagtgaaataaaatatgatcccagtagggaatcttgaattctgacctcccatgttctattttgaaataaccactttatgtttctttttttttttttatctgatgatctctttgaggccagcttcagattttggtggtacaacatgaaagattaggaaaagcattaataatctgtgggtggaaaacttattagaaatctgagagtaaagtttgagttaaaagttgtttgaacatggaattgactgggaggccaaagatttttaaaagcagaagattcttaagacctgaggaataagttatgtgataatggtgtgtgttttgtgtgcatgaatggaaattgtaaatgttgaattctaggctccgataatcactgtcaacagaagatcaagctgcaaatatttatgctttaaaacttaaattataaagctagttaaatctttctaacaactagttttaatgttcatgggtacattttacctaaggtactgttaacattgtatagagaaagattcatcttaagcacagattggctatcaggaattagtttggggatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttcagtttaattacatcccatttgtcaattttggcttttgttgccattgcttttggtgttttagacatgaagtccttgcccatgcctatgtactgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttcccaattgcttctttttctgaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgattcctccagctttgttcttttggcttaggattgacttggcaatgcaggctcttttggttccatatgaactttaaagtagttttttccaattctgtgaagaaagtcattggtagcttgatgggaatggcattgaatctataaattaccttgggcagtatggccattttcatgatattgattcttcctacccgtgagcatggaatgttcttccatttgtttgtatcctcttttatttcattgagcagtggtttgtagttctccttgaagaggtccttcacgtccctcgtaagttggattcctaggtattttattctctttgaagcaattgtgaatgggagttcactcataatttggctctctgtttgtctgttattggtgtataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaatacgctttatttccttctcctgcctaatggccctggccagacttccaacagtatattgaataggagtggtgagagagggcatccctgtcttgtgccagttttcaaagggaatgcttccagtttttgcccattcagtatgatattggctgtgggtttgtcatagatagctcttattattttgagatacgtccccatcaaaaagtgggcaaaggacatgaacagacacttctcaaaagaagacatttatgcagccaaaaaacacatgaaaaaatgctcaccatcactggccatcagagaaatgcaaatcaaaactgcaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacccgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaagcaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatggatacatatgtaactaacctgcacattgtgcacatgtaccctaaaacttaaagtgtaataataataaaataaaaaataaaattaattaattaattaatttttaaaaaggaattagtttggggaaaatgtttttttgtggattctttcatactgcaaaagtaaaaccatttgccttctggggaattgagctaaattctcatctagtctaagactaaaatgctaaaaacaaaaacatgaaggaaattaaaaccccttattattaaatcgatttgtaaaaatgttgttactggaaatttattggacttgaggccttcttccagaaaataaggacttgattgtcagggcctgtattaggttctgaaccttaatgccatgtattcgtacttatcagaaattatttcagtgaaaagtacattagcagtatgaacttctgatccagttggaagttcttccatttgaaaaatgtgatatttgcatggaactgttttcatctttttcttttctagtcccactcccccacactggatagaatttaagctagaattttcccttttgataaaagaacaaaaaatgaacatgttatttgtaagttgatgtgtagtatctagtgataaacttgaaacactagaatacatgacaagcctaatcttaggtagtcttatgaaaacgaatctcttacctatcttttgaaactatattcacattgatttttaagattttttaagttatattttttccttttttcttcagagctgcttcttattttggcaccacttttttcttttattgtgtaattcacaaggggctgcattttttttttttttttttgataaggcttgtaactatggctggatgttttgctctagtcttctaagaaaggccattttatttttcagagtcacttataaagtcatgtgtaactaactttgtagactgttttgcatatgactgctgctacaaattaaaacccaaatagacctcattgcatgtcactctatgaatgttgacaatgaaaggaataccttgcctgtggtatactgtcacttttggactgaaaagctgaggaagaaacttaattttcttttttgcataagtcagaaaaacttacagctggtgttcccagtttcctggttgactccagcagatgaaatgaacagatagtgttaattcagactgaagaaattatctgaatcttggcttgtgtagatttacaatctacatgcaatattaactaaatcagatagcttttacagtttcacatgtgtacataggttccctcccagtcccttccatacccattagttattgaactttctaattctattgaaacattacaacagtgttttgttgcaccaattttataaacttatgccgtgcaatacgtgttatttttctgaggcagaccaaaggtaaatttctcaaggttcttgctgccttctttagcagtatttgagggaggatcttttatacatttgtaacagataaaaatgaagcagattgcaaatccttttttaaaatcttaaaccatgtaccaagtttttggtccaaattgtgtaggataagttaaccttaaattgcattctattaaccaataagagggtatttccgtaagcatagttatgttgaaatacagttttaaaaagcaaaaaaaaaaaaaaacaaaataaaagatagacctgctaagcttagtcaattaaaaattaatggtgagacagaactacagggtagattaaagctcagcctatatgcatcaccatgactccgcttactactgatgtctccttcggcttgttgcttaatcctttcataaaatgggattagtatttactcacctccatgagttgtgacacactctaaatgagataattaatgtaaagcacttagaacaatacttggcaccagagaagctctcaaaaaaatattagcggggccgggcgcggtggctcacgcctgtaattccagcactttgggaggccgaggcgggcggatcacgaggtcaggagatcgagaccatcctggttaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaattagcggtttttgttattaaaaacattggtcagagcccttatttccttgccagccgaaaagcattgctctgatgactagatttacatccttccttttttgaggacagtgggacagcctaagtgttcagaaggcattgtcatacatggttttaataaaaaagtggatatctgagcctagataccatgtgcgagagtctgtgggatgtgaaaagattgcacaaagacgaacccagtttaaggctcagcacgtgtgagtggaagatagtgctaccatggtgtgacctcagtgattgtgcaccaattaattcctctaagctctgacaccccacaaaggaactcaaagtttcaggctctgctaaaataagacagacaatagcaagtgttggcaaagatgtgaaaaaattggaattcttatacgttgctaatggaaggtaaaatgatgtagccacttttgaaaccagtttgacagttcctcaaaatgttaaataaagttgccatgctatccaacaattctactaagttctacccaagaaaaatggaaactcatgtatacacaccaaaaaaaatgtacaacaacagtagtagcatttttcataacagccaaaaaagtagaaacaaccaaaatattcatcaagtgatgaatggataagcaaaatgtggtatatccatacaatagaaaattacttagctgtaaaaagaaatagtcttgatacatgctataacactcatgagccaaaataggcaaatccacagacagacagaaagtagattcatgcctaagggtaaggttagggtaggaaatggggaatgacaggtaatgggtatgggattcttttggagtgatgaaaatcttctagaattagatagcaatgatggttacataacccagtgaatatactaaaatccaccaaactgtacactttaaatgggtgaattttatggtatgtgaataaataccatttttctcaataagctgtttcttattttttattttctttattatttttatattaaatacaattaaaaaaattatttgagacagggtctctttttgtcacccagaccagtgtacagtggcacaatcatagctcactgcagcttcaaactcccaaacccaagcaatcctttcacctcagcctcctgagtagctgggactgcaggctggcaccaccatgcccagctaatattttttgtttgtttgtttgtagagactggatcttactatgttactcagtttggcctcaaactcctggcctcaaacaatcctctcacctaagcctcataacctgtggatcaccacagccagtcctaaatctgtttttaaaaaaaagtttcagggacagagatcctaaacatcaaagcatgatgctccaggctgactggggttccatgtgaaacagccctcaggtgtgctggaaatgtctttcctggggctgtttcaaaagttttgggatattcgctgaaaatattctagtctctctttaaagtagaacacttgtctccaaaatcacactccttattaccatttctattgatataagggcagtactaaggttcactttttagagatgaggaacccaggcctaggacatatgctagccaatgagagctcaagatgtaaatgccagtttttctgattccacagccattttctagtagtctactctcccttaagacaagaagtttatgcctaattctcctgatgtaaaaacaaagttttaaacatgagaaccaatctttttgcagcttgttttcatactgtagcttctcagagattcccccaagttgctcttttccagacctttttcctactaacatcgtgactttttaaattgaaataaaattggcatgcaataaaatgcacagatgttaagtgtacagttcaatgagtcttgacaacgctatacacagtgtaacaccaatcaagctacagaacatttcttatccccaaagaagttcctcatacctctttccaatgtgtcttagtgcaagctcctagaggtaacttctgttctgatttttcttaccacagattagtttgcctgttttgaactatataccatggaatcatgttattttgtgtctggcttcttcagctcaagatgatgtttatgagattcttcatacagtaatatttcactcctttttattgctaagtggtattctattatgtgaatatatcaagatttatccattttcctattggtggacttttgggttacttccagtttgagattgttaggaataaagctgttgtacagctttctgtggacatatgctttcatttctcctgaactgctggttcataggtaggtgtatgtatcacacttctttaaagctaaaatgaccaggaccccaggtaatagtctatacaggaatgtgttgtgatacctactgtacaggcttcagtcatgttttcttttcattctcactagcctccacgatgatgctcagtaccaccttgattcttgacctgggcactatgttgtctatcgtccaccgtacaactggcacctcataacacacgtttattctctaagtgtaggtgcatacccacacaatgctgttagataaaaagatgccttgtttacctgtttcgttgtctcgataggtagaacataagcttcttataagtgaggaaagcatcttagcacttttgcacatcacagtaattagctcttaggagaaagtatggcatggatcaaatgagcatagaactcggagtccaagtcacatcaactctctgagcctcatttccacatatgttaaatattattgaaaaaatgtaaaataaattatatacctatgtgtttgaaatttaaaagttatttttcaagcataggtctgtccaatgccaaatgaattcctaaaataaacaatcggatacatcgagtagctattcactttcactattttatggggggaaaacaatccattgtttacagaaccgtttaaaaagtttaggagtattttcactctcactgcagggctagtgaacatctcagtatctttgtcaccacttccttccatccttcccagatttcaagtgcccgaaggcaaagtagaatgacccctaagcttttttcgaaagctgatggaataattccctgtcagcctactttatgcaaaacaacttccggcactggctgtcaccctgccaaccatatctccactcttcttactttttgctctactttaaatgtctctcaaatcattaatcatatgcaattattttccccctgggacgggccacagcaagattgtgaacaagagatggcaaagtactcactggggcgccttgctcctgggcttcaggagctggcagacttctggcttgaaaaagagcaggacattgcacagtgggagaacccggggcacacaaacccagctcaagtcaagctatctactcacaactttaaaatgcttatagggcactgttgtcagaggtgactgtcgggcgaagtgtcagagccctggcatcaggaagtgctcaactcacgtgttggtaaaaagaatttaccaacaacagcataggtttgaaaaggaaaagtttattggaaagaaagaacactgcagaagagtgcagcagtgcaccgcagtgagaggactgagtgcactgctgtgggtttttccttaggggtattcatggaccttaaggcgggagcttaagggtaatttggaccgtattagtcacatagatcatgataaatgatcaagtttgtagacattttggtgtgttaatgtcagcaagggttgtaaaatgagttttggaatggcattactgatataagatactgagctgtgaagaattgccccaaatttaaaaatttttaaagaatgagaaagctaccaaaaatgtatggttccctaaatgtactgcaatgggaactatggcactgaccattctcctaaatttccatttctatataaagagatgtatagaaattttaattacttagaaagattgaaaaaggcctggaaccagaggccaactttggatattaggaaagtctaattacttctaattttcccagataaggagttgtgcctccggagggcctgtttaatagtcaccgggtgacccgtactctcttctaaattcctcaaataaggagtttttgtctccggggccttttcaatggtcaccaggtgattttcactctcctctgtgacctggtttgtcctcgaatggaaccctgcttccagcatcccttctgaaagccttctacatcaatatttctcttttcatgtgaactataactatgttatatgcaagaataaatttctgggccctggataacactagaatacagacagaaacatttatgagtgaagcgaaaggccccacgtacaattctagatgaggacaaaaaggaaaatttgaaactatctctagtcaacttttcttattctctaagctgcagatactctggaatgtagtcagaggttgagatttgccacaagttaaccaactgctcttcactttaagctgtgatttctacatgaataaatcaatattccgacaaggtgcttccctgaattttaacgttctgctagtgttttaaagataggagaaaaaaatgtttttcagaaaccaacatagcgtcagaaatagtctgctcttaatcgtatctcagtgtcaaaaaacaaaaacagagtgagattagaatattaaaataggcagagagtgtggaattttatgtttttattttataacgtatttttggatagcctctcaagtcataaacagggaatatagaaagcagactttgaaatgcccgcctgatataaaataaacattaatatttaacttagaatcagaggagagatgtacgcctcttttcaaggtcatcaactttccaagctgtgtcacactgatgttctgtttatgttgaagccatgctgccatgtttgaagatgacataaaggcaatggaacctatgtgtcgcagtaggattacctaattttggtttaaaaaatgccatttttgtttctttttggtaaacagtgctctctatttcctggaaaatcacgtatagtgcaaatttacctttactcatgtttaaggtcacaccattgagtatctgcttaagtcaagcactgtgctcagtgtgtaactcatttactcacaacaacactgtggggtaggcgccattattatccccaatttataggcaaagaagctgaaactcagagaagttggaattccacgtggccaagtagctaataatggaagggctgagattcagaattttgtctgaccataaggttcttatccatcatgttaaatttactctaacttagaaataggtcacagggcctatgcaagggatgatgttttggtctgcaatacatacactccacacatgccctatagttgtctgtttctttactccaaactcccagcaattctgccaacaccgcaacaccacacagtaccaagggagggctgcaacagccagcatccattcaacaccactcccaagtctcttagctgctcccaagatttctgggccactctttccatgatatacatatgcatgaaaaatctcatataaaattcacatgcttctgttttcaagtccctctattccccatcctttgctttattccattccacaatagtgcaagttcctggaaaaacgcaataatgtcttccatctctttcatcaccttcccttttaccaaataggatgaggagcatggagtagaatatccatccctgtaattatacctaaaacactaaagatcagtgaagtgtgtattttaatgttctccaaatagtatttaattaggggtacttgaatatatgagaaatgtctttgcaaagtaaatgttttacgtgcttagagttttctaagcccttgtgtttcataatgcaatataagctctttattagtaccctctggctgagataagatattgagctgtgaagaattgcccaaaatttaaaactttttaaagaataaaaaagctaccaaaaaatgtatgattccctaaaatgtactgcgatgtgaactgcagcactgaccattctcccaaatttccatcccaaaaccctgcttctcatgaaagagagagagaaaaatagggagaaaaaagcacatgctgcatcttacaaaaccagatagttactaaatgcttgtcatttggtccccaaattatcctttcttgaaatccaaatctttaatattttaaagaataaattgcagcatttctgccttgaggtttttatgtcatcttcataggaatcattttgaccaattttacatataacttagctaaatttttgtgttagatctgaatcttggagcataactagtctgtattagatgaggaacagttgtcattttcagttatgactctccaaacgtcatatcagctggtgctatggctctgatttcctctatcagcagcacctctctcgggtaatttatctttttttctttttcccctttttttttttttttttttttgagacagagtggtgcgatctcagctcactgcaacctccgcctcctggggttcaggtgattctcctgcctcagcctcccaagtagcttggactataggcatgttccaccaggcacagctaatttttgtgtttttagtagagatggggtttcaccatgttggccaggatggtctctatctcttggcctcgtgatcggcccaactcggcctcccaaagtgctgggattacaggtgtgagccaccacacctggcctctcgggtaatttctgaagaccttgattctcaccaccactgcaaacccccaaacccaacccattctacctgctggcttgtgctccctcttcagaactttcctaattttgtgattctagttgctgttcagtccccttgagaggaaaaacaatggacaaacttaatttaaatctgaaataactgattagttcaatgaaatctcacaaactgtgttacagatattattaagacaaatttgcaaattaggaaactgagactcagaaaggctaagaaatttatctggaatcatataactaaggaagtaatggccaaaaatttaaatcaaaagtttgccttactccaaagtgtgtgttaattactattttaaagttctgttaaagcagggacttcatgttaaattcctagtattgggagttcaggaaatgttcaagaaaagcatgagggtccctggtaatgaacttatgaaagaaatgtatcatgtgaatatggtgacttttccttttttaacaaatggattgaaggtttcctgaaaaagtgatgagggataactttaaaaggtgcctatttaaattagcatacaggcagtttgaattctagttcttcctcttttagtatgttaaagggaaggaaatggtttatcccagtgactgctactccatagacacctgaactgaacctgaaggtagaaaaggaatgggacttagctgaattttaacaaggatcatttaggccagggctgctgttcagggcactgggtttgagtctgagactagtatttaccaaaatatgttatacaagtcatcaggggatacattcatggaaaaactcagtacacaaggacaaggaccaaaccttctttcagatcctcatgttgagcacataatgaattcagtgccctgggctagaatttaagtaactgggaacagaaaccagttcatcatgtgtaatttctataggaagataatgcttcagatattgtgtggtctcctccaagtggagcacagccacttgcccagccattagttagagtgcccggacgagaggagagaagcagaggctgggaacgtaacaggggagtgcagttgattgttcctctcagggccaagatgaagtgacccaccgtttcccaccgcccctctcattctcagtatacagtctggtcaatgttccctaagaaaatgattcattcagcatgccccatttccagttgaaatcacatacacttgacttcagaactgagaacgaaaatggttcttcctaaatgcaagttctggcatgcctaaacaaaaatttcatatatagtaagctaaaatctcctaaagagtttaacgcataacttattcaaacgtattctgagactgtgaaaattgaggactcatctatcctcaaatggaaactgccgctggcctcatcttctgcaccttatctttccttttaaaaaaaactctgagatttaccacttacatgcctgcatctgtttggattaactttcatgttccatatatttctgtttttattagttcatctttgtcctccaaatgtgggtcatcatacaagtgataagtttaagtaagatttacattctctttgttcttatgagtgtatcagtgaatattattaatattgcctcacatttgcaggacactttaatgtgctatggaagccattggaacccagccccgtatttctgaaccaaattctctcctccctcaaactctcggggcgttgggcatttcctcaattatgtggcgtctatggcagtttctaatctgattggggctcttaaaatagaaccagaatctcttttttggagtgagagagcgcagtgatgagtatttattaattaagggaaaagcctccacttgaggcagctgggaatgactttctgaagacactaaaatccaaataaaaagaaagacattcaaatgtgggaagaaaaagtaaacccagtaagaccctcctgaaagtgttaaatgttgaaacgatatctgaaagaaccaacttctttggaggatttttaaaaataagaattggggcatggatttgtagtcttgcttcaaggcaagggaatagacaaggtgatctcccgtgggatctaacagccctgtaattcatcaaagaaggtatttaaaagcaaagccatgggggaaagagaacagtagcatcaatctaaatcaagccttacatgcattttctctcttttttttttttttcacttctaatctctccctgcttttttgtaagacctatcacagcaggacatactctctacaattactttgacaaacaatggtaacagcacttgggtttttaatgtcttccaaagtaatctatttttgacagtgaaaagtagaggaaactgattcctgaagctatgaactaaaatgacagatttggggatctgatttaccagagtgggttttccatatatcagcccttgctgacattcctgggcaagtacccacaggcacaaactcccaatggaaagtcggataaatgtaacacaaacaacagtcataagttgactttcctatcaggtaccttgtgaaaaaataggtacaacattttataaatcttttattttaatgaagtttacttaacaccgaaaacgtcagtccagagatgtgaaatcttacattataaagaattatggcaaatagaaacactaacaaactgagcctttagctgtcatatctgaaatactatacatacacatattcatggatgccaacatgctgtaacataattttacatattaaaataggctcaattttcaatgataataaaatggttactgatactatgacttcatggaatattagatagccattaggcatacttatatggaaaaatgttttagtatgttaaatagaaaaagcaaaatataaaattatatataaattatatatatatgcttttgtagtgggttttaaaaatatttgcatatgtataaaaataatttgggaatccatgaaatgagaataattattttaggaggctaagattatggtatttttgtttctattttcttttttttttttttttttttgagatagagtcttcctctgtcacccaggctggagtgcagtggcgcaatctcagctcactaccacctccacctcccgtgttcaagcgattctcctgcctcagcctcctgagtatctgggattacaggtgcacgccaccactcctggctaattttttgtatttttagtagaaacggggtttcaccatgttgttcaggatggtctcaaactcctgaccttgtgatctgcctgcctcggcctcccaaagtgctgggattacaggcgtgagccaccgcgcctggcctgtttccattttcaatatacaaaaatacaaatgcacacacacagggagataacacatttgatgtaacaaatgaccgtgctttcagaattcagtccagtatattatggttgaagaacagacttacattaagtgttctgccacgagttatcagaaaaagtcaatagacccacatgaccccgccttcattcccttttctcctcttaacacctctgccagcaagaacacacacactgagtgggccattgtaacttagatccatctggtaagattctttttcttcttccaaattagtttgttccaaaaattatccagcagattgttcaagagaggcatttaatatttgtctttaagaaatgagaaaatagggaggtcaaaatgaattagcatttaaaaataagacctatagcacccctgcggtgcatctgtggggtttgagatgtgcagcatcatacaaatatcactaggaaactgagacatttggaaacagctaagaagagccacgttgctggaaaaaaccatgactggcaaaaaaaaaagctttttgtgaatattccataacctacaaagaacgggacaaaaataaatacataaagacttataccctggaataacacagcagaaaatatcttattaaaaggttttcactacctttgagataccatgacataatcatattaatccaaaatacttccttgaagcatggatttttaaagcttgactttttaatgccagttgggctgtgttataagtagccatcagattttttgtttccttttcctggccaactaccaaaaatctttggtagttggtgagtttgctctactacaagaaaacctggtaaccttgggatactctgctgttaatatccgattcctattcaagtatcttcccaggaaaagcatgggggttgcagggggaggccaaaccatctgcttattttaacaaggcttttggccagcttctcatggttaaggagcgctaactctctggctagcctaccagaagctcagagaatgagagttcctggtatttacagtgttactttttaaatcagtttcagaatgtgattagcacaccttcctaggtaggaaaaagctatgttatggctgaaaagaaaagaagcagatactcttattcttggtggatgtgggaaaacaaacaatttggatactgaataaagaataaatactgttaagcacttaatttcatacacaaaatatatagagaatttattttaagctttcaattgccttttagatgccaaattcagatctatttatagatgccagctttgagtaattcaaaaatttatataaaatcatttctgtgaaacttacagtttatggaaaacagagaaaggtttgcccatttcaggtaaggcctatgatttcctccttttacactgatttagtatggctacagataaggttcatggaataagaaggtttttgtagtcagacctgggttcggattgcctctgccattcatgagccatgcaaacttgaagacagctaacctccctgtgctttaatgttctcatgcataagatagagaatataaaacctcatcacagtgttattgtagggattagatgagatgcaatatgcaaaaacacccaaaactaacaagtatgcagtcaatattagctccctttcctcttttccttcttccaggctcttgggctactgtaatttacacattaactcattctgtaactttaatttcctactacctctttaaaatacagaccatatttattgatggggggaaaatatacaaagcttaaagcatgtgccgtaaaatagttccttaaagggtagtacagcaaaatggaacacattttcttgcccattcacaggacgactgtgaattttagcataattattgaaaaaaactcagctactctgactttttacaatatctagtgatcaagaaaacctttagatcatattacttttcctctcaatgttgtagttaggctattcactcagagaggcctgtgacaagctatagttaataagtcttccatggtgtcaaaagtaataatattaacacgcctttgtgagttaaattaattttgttttgtgcactggcctgcataaatgtgaatgacatttcaaaatatgatcaggcagaagctgagaaggagccaagtggcaaggcagaatgagatgcggtcattagagcagagcagccagctgcaagcatttgtcagtgcaggcaaagaggtgcaggatattattacagcaaacttagggggttgttctttcagttcattttgccctttggaaaaaaaatactgatttttgtctttagagaaaaatagagatgtttgacatccaggctctccatgtttggaaatgaaagaccatcttcctgctaatcactgatttcaagtgtctttcaacccacagattttttttctctgcctgcgagaggcagctgattggtaatagcttttaaactaatgaccaaacagtggcattttaaagtcttaatggttgtgtttatttcagagacttcttcagattccccaccaccaccatacacaaaggcatatacctcctgcaaatagaacaaataaatatgctgtctgtaaacagttaaaagatacaggttgaacctaggaagaaaacacctcaggatgactcagggatcagatgaccaaaatgactggtgtaataagttttatactttttaccaaatggctggacaagcccttttccacttgagttctagtattttgattactgcaatcagaaatcaaattataagaaaaatggagatgttcctattaaggcagtcaccgtaaacaagaactggataataatttaaggggctctgtacctcttcatatgttaaacttgacaatttaggcaacatcccatagtaatgagcctctacatttctttcatatatctagtatcacaatatttttgtctgttcagaagtactacacatgcaacaaacaatttttaaatttgtctatagaagtttctctattttaataaaatgaagagcactatattcagagctctgcatattgtttagtatccacagcaatcctacatgatatgaaagcattgttatcctcatttcacaaaggaaaagtaaaggaattccctgaaagctataggactgttaagtcacagaatctgtgttttaactcagatcaatttcactccaaagcctgtgctctaggtaacatatagccaaaaatacccatgccctatttccttctggcaaccaatccactgtgacttctatggtaaacaactatgttctgtagcttctgcatttaactatctcaaatcaaaaggcaccagcaaaggaaatggcttattctggaagattttgcattaatctgatgattcacttcaacaaacatacatcttcagatcatttcatgctgggcactggtgatgtaaagatgaattagacagtgctaggctcaaggacttcataggcgatgaggaagggatgatgctatctggaagtgaagagagttcagaagagatggtcagaatgtaaatttgaaatgagttctaaaggatgactaggaattcaactgattgagaataagggcttccaagaagaggaagcagggaaagcattggaacatgtaaagaacaagatgtccagatctgattataatctagtactgtacatgtgagaggggaatggcgtgaggggtaagccagaaaaaataaataagggtaatattttagggccttgaaggtgggagttaacattttaagtctcacatttgggaggcagggaggatattaaagctgtcagtggccacatcagctctgtgtgtaagaaagccaattttttggcagtgtgaagatgaattggaggctcttgcctccatttaggagtccatgaacgatatggctgtgaagacagaatgtgaactaaaattgaaaaagtattttcaaaacaagaatttgcagaattttgttactgatcagatagagaggtgaggggcagagaaagctattgaaaataatttcaattagtttggttgactgagaaatgagcaaacaggacaataaatgaaattacaggaagatgcactaattttaagggaaaacattaagttctgttttggacatgttcattaaaacagagttcatttctatttaagatgatattacatccttttttaccccaccacaacttgttttaatgttttatatgcagtatttaatgttctcctaaatagtaccatacccacagtcaaggagcattatttaatttatctgattccactatctctttaccaacctaacacttctttaaaattactcatggccgggtgcggtggctcacgcctgtaatcccagcactttgggaggctgaggcgggcagatcacgaggttaggagatcgagaccatcctggctaacacagtgaaaccccgtctctactaaaaatacaaaaaattagccgggcgtggtggcaggcacctgcagtcccagctactcaggaggctgaggcaggagaatggcctgaacccgggaggcagagcttgcagtaagccaagatcacgccatagcactccagcctgggcgacagagcgagactccatctcaaaaaaaaaaaaaaaaattactcacaaagaaatcataaaaccatgtttttttctttcaaaagaattccaaaggaaaaaaaatgccctgaagaatagcaagcatggcctttatctttgcagcttaggatgctgcattttcaggtttcctcatggactttgtgatttccatttcaacacatcccagttagcagccaggtataacaaaccgctacaatcatccgctctttattgtgctgatccaagctcatggccacagaggggttaagtggaaaatgaaatccaaactgtgttatccaagcacaagattcagtggacttcagctctgaaagacccactgggtgaggaggccgtaagcaaccctgcagaaggagagccttggaaagggcccaagtgtggtaagatacacacctccacatagatgtcttacaaggcctcactccatgtgctcttctgtgtgtctaagaaaaacctggtaagagagctgacttaggggaatgtctctatatgaacacttacatgacattatctttccattaattaatatactgaaaatataagtgtctgctatgtgccaggcactagctgagcacgaaatacacaaagttggataaaacattttaaaattattcttaattacctatggatgggaatgctactgtacttgaataataatgaaataactagcatgcatgtacactttccacattctaggcactgttctgaccactttatctcatctcatctcatttaatcctcacaaccaggtgagatcagtacaattattatccccattttatacaataggaaacaagcttagagaaatgaaacaatctgcacaaggtcacctatctagtaagtggcaagccagagtttccaagctgtgtctgtctgacttaaggcttcagctgcaaactcctactctgtgtaacctaacaggtgcttcactcacacagccatctctacactgtatccattgaccttcagccatatggaaacggagaagatagcacttattgcttgtttagagaaggtggcttgcttttatctttttctaattcactccttaaaataatccctttcttgcatttatccctcttttttgcagaaagcatatctttccacctattttatcgtatttgacctcattaaatccctataaggagagaggaataaattttattacccctcctgagtcaaggcactgtaatacatctcctcttagtcaatctgtttaactcaggcaacctcaggaatgtaaaggaaaatcagaagcttgtgtttggacatgattctgctcctctgagaaaccctttcacctcaacagtctacagatttccatggaagaccttgagacggtcattcaggaattgtagcctgctgtttcctgtgcattcaggaagacatgaaagcaattacaaattgcttaacagatgatgcataatattagagatgaagaatctggctgtgaacacttgcaccagggaaattctgctgtgtgatttctcttccagatcagcaccttgtgctaacagtatcgtactggcatgatgctgagtactcctaaataatgatccagtataagaagaaaattaaaatttcagaaactttcactacatagaagaaagagcatggatgtctgtgcttaacagacctgttttctgagttctaataacattaggaaaattacctcacagggctgactctcaatttgttcattcacaaaatggagataataactatatttcagggctgtgaagatatgaaataacttacgtgaaatacctagcatatagaagctgttccataagtgatagcctgttgttgacattgactaacatttattgagcacttagtatatgccaggtgctgttgtatgcacttcatatgtattaatccgttaaatccacagaacggtcctttcacttaggtactattatcatttggattttcctgatgaggacatgaaggtccataaggtttaagaatattaccagatcacatagctagtaagtggtaagccagaatttttgaacccaggagactaactgtagtcttaattatggcactcactgtctctaaaatcatcttgggaacctaacatctttcaggcatacagacttaacttccagtccattttcgtttcctgcagttccttattcataaacctaggaaatatttcttagtgaccccaggaaaaattgccccagcttaactctgtaacctgttcaattttaccctcacatgcaattgagaagtgttcttaatttataacagcaacagcttctttcagaaagctttcccacctaactgtaccaatctcacctataagcgacatcattggctcatttctctaccttgaatttcactctggataaatttagaagtcaccttttgtaattttacacattttctttaaatttttcccacaacataaacctacaagattcttcttttttcttaacagcttgcaaaagtggtcatatatatctatgattcatctccttcagccaaatggtctgaaatattcaaggacttcaactgcctaaaggcttttttcagataacacaattgtgcatatactcttttcagctttaaattcaaaatactgtccattagatttttcatattctcctagttgaaagactttttaggacatctaaaatttgtgtgaatttttaaatttatgtcttttgagttattttcttcttttattttgccaagaattaatatgcattttaaagcaatagaaataatttgtccctttgcagcattttttatccctttgcagaatttattagacaatagttactacctttatgaagcagatttcctggacatctacaaacttctttaaattacagtgttagtagtaaacatgcttttatgagattccacatgtggaaaaaaataactttttaagaatgtttagtttgatctctgcccaataggatatcatataataaaattataggtaaaagccacaaaaaaaaataaagtcataaaaaatgataaaagttatctggtgaaattgattagcaatgtatggatcatttttctcatttacatttttctagaaacttattaatttttcttcatcaaaatgtgatgctcaaaagttgaaagccagaatgccatcacaaataaggaggaaaattgtcgtagtttagaatgcctaaagttacaattgcataacatatgctgttaaaaaaatatatcctctattagtcatttctcacaaaaatctgtgatgaactttacataaccaaaaaatccctggtatctcagcagggtcactccagctgtcagtgtgaatacatgcaaaatgaaacaaacaagatatacctattttctttctttgtctgaaaaggatggctttcattcaaattcacatcatacatttgcagataaactatatttttgcattgtgtgatttagtgacatcacattttcatgcaaaggaccattgaattccctaatgatgttctgattttcttaacaatgaacaccagtgaactttcccctaggcaaaccagatggaaactaaatcgtttctgcagaatgaacgatttgtgaaatcttggcaaattgaattccaaatatacttagagatgatcttgactttctctgtaactctaccacaacatgcaatgcatttaaggcctacatgggaaatacactaattagttgcataacctttatgcagaaatgaatgagaacagaagatcaccatcaaaggaataaaagtcagtaactccgaaaaagaagtaatatgcagatgggacatcttcactaagaaagtatgagtttaatgtagatattgtgggaggtattcccttgtcatctttgaattggttctttttaacctgctttgtgaaggaggtaactcattaagcacgtttctttacattgtttcaaatacgtcatttagctagttatatgaaaatctgaattcaaattcttaatctatgtgtctacattttctacttcacacactctcttacctataccccaaaatggaattaaatggactgtgcatgaaaaagattttgtttctattacccacaatctaattatattattttcacagtgacattatgaaactatccagtagatgcaacatgtttgtcacacaaaagataaattgtgctttcttctttatttcaagtaaagaatccttacaattctcatagcattccatctacagagggttataatttccccagatgtgactaaaatggccatagttatcattaggttttatatcttgtctgagtccatttaggctactataacaagataccataaactgggtggctcataaacaacaaaaatttatttctcacagttctggaagctgagaagtctgagatgaaggtgccagcaaatttagtgtctgatgaagtccgcttactggctcatggtcttttcaccatgtcctcacatgtcagacggggcaaaggaattctctctggcctcttttacaaggactctcatcccattcaggaagactcagccctcatcacctaatcacctcccattggcctcacctcctaataccatcaccttgggagttaggatttcaatgtatgaattctgcggaggagacacaaacattcacagcacagtgtacctattcagaaattcagatattccacctcagctactatgtcatcaagtaatcagggcttttttgcatttttacaaggttcactcatatctaaatctaaatctaaagagggtttttttgcatctttacaagattcagccactcaatgtctttaaaaaataatgaggcaaagtcaggaaaacgctttttagaaagggttattctactggcattaaactagcaagaaaaaaaatattggcatctttcatttatagaacaggtttaatttctcaacacttttatgttttgacttgtttattcctaccagctctttgttataaaagatagttacattattatttataaatctaacaacaaacaacaaaccagccaaattcccaatgttgtttatgtatcatttttcaaacctattcatttttctcaaattgtgattgttttctctttgtcttgtttacattttttcctgccaagttaattctccaataaactttatacatggtccgtgacattgctccccttctggaaacattgatacccaaaatcctactttatatttttacctttgcttttaatgagaaacccaaatgtatcttaactcttcaaaaaaaagttactgagtatacgctatgtgctaggcagctttttctttttaatatcactattgcctgtagcttagtttttcatttttacctcatggtcttgaccaactaactccaaacttttcttactgaggtacaaactaagaatgactattttctctgtcctatgcctttcccacagttaaaaaaaaaaatctctcttgtctgtaactctatattcatatggtgcacactgttaggcaaaccgattaaaacccaggacatatttaatgaaagagggagaaaggtgagcagatatttacggcacaatattgcaagtgctatactgagggtttgggaaggtgttacagaaatgcaaagaaagaagaagggccaaacttgaacgagaatggtcagggaaaggctcggcgaggatatgacagtgagaaataagtaggagaccagtaggaaaacaagggaagggaagttgtaccaggcagatgaagcagcacgttcaaaggcttggaggcacaagaacatggtgcaatcgagaacatgcacgcatccgctctccttgttctatttcctgcaaccctatatgaatttgctttcacgtagtaagatttctgttgtgtaagcttaatctcctttgatatttctttgataatactttcatcatttttcttcttatgtccatagacttcatcctctactctggcatcatcttcataggttgccctttgtattcttaaaaatcttttcaagtgggatcaccttttccaaaagcctgtcaagaggtcaggttatgtttaaccaggaccctcccatgtctactgtgttaatccttcttgcttgtaaatattaggagagccaggaacattcacaaagctggtcttttttatttctcacgacacattgacacatctaactcactttttccttctcccacaattcattcccccactccaggtgacattcttcccctactgatgagtatcaaaacatcccaagcctatcccttcaggtgtgttgacctccctctttacattatagtaaagtgcttgtgcttaatagtaaattccattctgcttccaacacggcaagcagtgctttcctacacttgtacgattttatttagtcccccaagaccctttcaactagatctttctttctggaatctaatgtctcctcttgtcagatagtcctttttcctggaacttgggttttatccacagaaagcctgttatgtttgtctgtttttccagcctttcctcgtatttcttctgtgtgttcttatgcctttcctttccttgtatgcctttgcttgtgttctctgatgctttttttttttttttactcgcaatcttttctttaatcttctgtggacttcaaacacaggtccgtgtttgaaaaggcagtggtttccctttcctctgcaagaaccatcttctccaggcacctttatcttggctcttgctcttccgactagcttatttaaattcctgctgtacctttcaatccattttgagagaagtataaataatatgtaacattgataacattttcctccattcaatcaacaatagtttaccaacacacacacatacccaaaatacccaatgacaacctctttttagggtccatccattcaaaaacacataccctgtgctaaacctctcatgctaccttttccttatctgagacttttctccaagcactttcttctcatgtgatttgtcaacacacatataaaggacatctctggctgttccagcaacagccagaacttgtttctgttctggattaaaagcagctggaaagtagaatgcccatgttcaccttgacagctttctgttccatacttatgtttccctatcctaatgccaaatttctctgctgctgttaatgaaactttactacatcataatgggatttttcaatgaaattgccatatgacctatctcctgtgttacagtcttgaagagaactaacagcctttggctttaacttgcttggggaaatcaccagtgcctactgctttttctcctgatacagcctacaaaatatatccattttctctatcatctgaggttcacatcaaactctttatttctgtggatttgaattactgcaaatatgtctcctgggttcttcccaattgaactgataattagggtcctgccacatagtccctctccaggcaacagctctcatccattatgaagtaagtccacaaaaaaagtctttcaaaatccttccactgctttccccacgattcctgagttgattttccttatcttctctcttctttctgtcctcttcctaatggaagataaaatagacaaattggcactttttcccctttattctcttcctcaagcttcttttttctcctctatatctttctctatttttcctacggctttgcctctctaactgcaattctttgcctttttttgtgtcttctctccttttttaagtgtcccatttgcatttgctgttgacagaggccatggcaagctagagccaaaagtagagaagctggctttggccccctctgacctccctaacactgcactcattcattcattcattgagacaggatctcagtcttttacccaggctggagtgcagtggcaatcatagttcactgcagcctccttataacttctgggctcaagcaatccttccacctcggcctctggaatagctgggatgaccggtgcacaccaccatgctgggccaattatttattttttatttcatgttatgtatttatttatttttattattttttattttggggggtggagacagggtcttgttttgttgcacaggctggtctcaaactcctgatttcaagagatcttctgccttagcctccaaaaattttgggagtacagcatgagccactgtgcccagcccctaacactcctttaaatagctcttctctcctcaccatcttctgtgtgacttgccttagtctatcccatgtctttcatgtcctcctttttggttcccctccccccagtgttgggaccccttggctcacagatagattgtgtgccatcctcactgataggtaaatagacatttacagtcaatattgcagtagacaaagaagatattatttatccattttaatggtgggaggagaacatgctcagagtgcacctaggagctgattagtggcagaactcaggtctgctgggcattccccacagctcctcttttatgacagctccctgacaagaaggaaaactttccttgggtaatgacatctccaaattgcgtggccattcctattccctccagagatttcttcttggatactattgtcccagaactaaaaagagaaaaatactctttggatagaacaacatcctagcttctgagctttctgcatcaagaccccattttccccatgatgtcctctcaagttaattaggatgcactagcagaagtagctacagagtgacagaacttcaggatacaaagtccttgcagtcattgagtatcattagtaaaaaggtaatgctgctctgtcaggaagcctgtgtataaatcattcagatacatatctctgccactaaagattatgcttctcagagttaaaagtactaaacaatgccttccaaggtttatctgccactgtttttcatgaacgctccaggatcaagagcacactttctggcatattgctttaaaatgcctcctttctaactgtgcaggtcaaatctgcattgttatttagaaatacatgttgcccatatttcaaaattacttggtatccacacttacatttacattttaacagaagataatactggttcccataatccaaatcactatgaggcagctttatcccagagcctcaaagtcaggtgaggacaggaaagtagaatgtttaaaattggatttgacccagaaaaccgaggacatgtggttgacagagggagaatgttaaagtgacaaagcaacttggtaaaaggtttgtctttggacgccatccccaaactgttctccattagtttctttccacttcgcatgtccttaggcaattggccatttgcctggattcctacttagccctctaccgagagcagcacccaagctatggggctcacctaccatcttccccatttttcaccatttccattgacttagagaaatcatccatattccaagaaaatgtcaactaatttttttttcttttttctttttcctttttttttttcttttttgagacaggatctcactctgtcacccaggctggagggcagtggtacaaatcatagctcactgcagcttcaaactcctgggcttaggcaatcccccgacctcctacctcagcctcccaagtcactgggactacaggcatacaccaccactaattttctttaatttttatttttagtcgctttgttgcccaggctggtcttgaactcctgagctcaagtgatcctcccaccctgacctcccaacaaactgggattacaactgtgagccaccacacctgaccaactaaaatttctcttttttttttcttcaatccctccctgcctccctccctccctcccttccttacttcctttcttccttccttcttccctccctccctccctttttttttattatactttaagttctagggtacatgtgcacaatgtgcaggtttgttacatatgtatacatgtgctgtgttggtttgccgcacccattaactcgtcatttacattaggtatttctcctaatactatccctcccccatcccccgaccccacaacaggcccgtgtgtgatgttccccaccctgtgtccaagtgttctcattgttcaattcccacctatgagtgagaacatgcagtgtttgtttttctgtccttgtgatagtttgctcagaataatggtttccagcttcatccatgtcactacaaacaacatgaattcatccttttttatggctgcgtagtattccatggtgtatatgtgccgcattttcttaatccagtctatcattgatggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccttgaaggaattgccacactgtcttccacaatggttgaactaatttacactcccaccaacagtgtaaaagtgttcctatttctccacatcctctccagcacctgttgtttcctgactttttaatgatcgccattctaactgttgtgagatagtatctcattgtggttttgatttgcatttctctgatgaccagtgatgatgagcattttttcatgtgtctgttggctgcataaatgtcttcttttgaaaagtatctgttcatatcctttgcccacgttttgatggggtcgtttgatttttcttgtaaatttgtttaagttctttgtagattctggaaattagccctttgtcagatgggtagattgcaaaaattttctgccattctgaaggttacctgttcactctgatggtagtttcttttgctgtgcagaagccctttagtttaattagatcccatttgtctattttgacttttgttgtcattgcttttggtgttttagtcatgaagtccttgcccatgcctacgtcctgaatggtattgcctaggttttcttctagggattttatggttttaggtctaacatttaagtctttaatgcatcttgaattaatttttgtataaggtgtaaggaagggatccagtttcagctttctacataatggctagccagttttcccagcaccatttgttaaatagggaatcctttccccatttcttgtttttgtcagttttgtcaaagatcagatggttgtagatgtgtggtgttatttctgagggctctgttctgttccattggtctatatgtctgttttggtaccagtaccatgctgttttggttactgtagccttgtagtatagtttgaagtcaggtagtgtgatgcctccagctttgttctttttgcttaggatgtcttggcaatgcgggctcttttttggttccatatgaactttaaagtagttttttccaattctgtgaagaaagtcattggtagcttgatggggatggcactgaatctataaattaccttgggcagtatggccattttcatgatattcattcttcctgtccatgaacatggagtgttcttccatttgcttgtgtcctcttttatttccttgagcagtggtttgtagttctccttgaagaggtccttcacatcccttgtaagttggattcctaggtatttttttctctttgtggtaattgtgaatgggagctcactcatgatttggctctctgtttgtctgttattggtgtataagaatgcttgtgattttgcatattgattttgtatcctgagactgctgaagttgcttatcagcttaaggagattttgggctgagacaatggggttttctaaatatacaatcatgtcatctgcaaacagggacaatttgacttcctgttttcctaattgaataccctttatttctttcccttgcctgattgccctctggccaactacaatttcataccatgatggatgccatgttgcccattagggggtgaaacagtgtttcatattgttttaaaggacccatagagatctaaagctttagctaaaggtaataaatggtagaatttcaagtacctcagcacactatagcataaagaatcttttgacaaggacacttttggaattcacttttccctactctccactaaaaagtcacagtagtaattatttacaaattcctctactttctctatagtggtccttcctaatacatgtttctataatgacacctacaattttatgttgaatttttgtttatatgcctgttcatgccagcattgaaaaagcttcttagggcaaagacatgttttaatcatcctttgtttctagttctttgtagcatgactggcatattgaaaacccaacataagggtttgacatataagactaagctttactcattttctacaaaccacagatttttaagtggatcactaattatacttctgaaaacactgtttagaagtcatttatttattattagtattaattatttcaggctaggctacaataacaaataggcccaaacacgtaatgggttctgcaaaagagaagtcttggcaggtagggctctgctttattaaatcttcaaggatcctgtctcactgaacctctgccatcttcagcatttcagcatgtagcttccaaggtcactctgaggtcactatcacagacatagaaaagaaaaaaaatcatgggtaggagttctgggggactgggtctaggagtggtgcacatcacttctgttcacattccattagctagaacccaatcacaagaccacatctaactacaagaaaggctgggaaatgtagtctagctgtgttctcaggaagaagagcgtggacttttggtaaactacagagactctggcagtctctgccagagtggaatacttaataaatacattcattcttttttttttttttttttttttttttgagacagagtctcgctctgttgcctaggctggagtgcagtggcatgatctcagctcactgcaagctccaactcccaggttcacaccattctcctgcctcagcctcccaagtagctgggactataggcacccgccaccatgcccagctaattttttgtatttttagtagagacggagtttcaccgtgttagccaggatggtcttgatctcctgacctcgtgatccacccgcctcgtcattcagaaagatgtgaaagatgagtgaaagttaactaagtaaacgggagggtggcaagagggcagaatgtcaagcaaaaggaactgtttatgtgaagcctctgaaagtgtaggtggcgtggcacagttaatgatataaagaaggctttccccttgtggctgttgcgcagagggagaaagaggcatttgatgaggcagaggaataagtaggaaatagaacttgaagattattctaaatgatcataagaatttgggccttttaactcaagagagataggagacctacttaaggattttaagatttggttttttgatgttttgttttttagagacagggtcttgctctgttgcccaggctggagtgcagtgccacaatcatagctcactgaagactcaaactctcgggctcaactgatcttcctgcctcagcctcctgagtcactggaaccacaggcatgcaccaccatgcccggctatttttttgttttttgtagagatagagtctggcttcattgcccagactggtctcaaaatcctggtttcaagctattcgccctccttggcctcccaaagtgcggggattataggagtgagatacgatgcctgttatttaaaaggtgactctgtcaattgtattctaagagtaaatttcaggaaaccaattaagagggtattggagtaatctatatgagagattatttgatcacatggtgaagactataaggatggaaacaagtgaacttattgagagattttatgataaataaaatcagaactcaaaagaagtcaatgatcaacgatcagtgataatgcccagttttctggcttaagcaaccccttggatgctaatatcatttgttgaaatcgagtgaaccagatttagaagaaagatcataaattcagtttttggcattcgagtctaaaacgagtgtgagatattcaatgactagtggacagttagatataaaagtctggggcttagagaaaatatctaaactagagatacaaactggagaatcacttccatattataactaaaaccatatactgggataagattagtttatgaagaaaagaagttagttataactacaccctgcaaagggagaccaagagtgagtggccagggaggcagagaaactaaaatcaggaaatcattgtattatagaatccaaggaaagaaagggagtcaataaattctgctgaaagttcatggaaatgagacctgcaaaatattaatggttcggtaatatggatgtcatttgaaatcttagtagcaactattttaataaaatgatggagagagaaatcaatggaacatgaaaaaatggggacagtgattgtaaccaatttcttcaagaaatttggctgtgcaaaggagcagagagacatggcacatgtagaaaagaggatagttgaaataggaattttgttatgataatagcgaacactcacacagtacattttgtgagccaggaactcttctaactccttttttacatactaactgatgtaattctactgactccatcactattcttccattttagagattagaaaagtgaggcacagaagagaaagtacattgcctgaggcttagtaggtaataagaagcagacttgggaattgaacctaagtagcctgactatagagtccatgttgttacaaagtcactgaggaatcttctaagcatattttaatgttgaaagaaagatctcaaatgttattttgtcttttgtcagtaataaaatatttggcacatactcccaatatttctgtctttctataaatcatatatatattgtgctataccaatatatgatgtgttttataaaacatataaatgaaacacaattttgaaaatatgggataaaagtaaatataaatagaaggtctaatattgtcttctcatactccaatggattatcttatgaaatctgcaatgaagataactaaagaagagagggaaaggatagagaaaaagaactgagtgcatttactggtttcgactacatgtgcaaatttccacaaactccgtggcttaaaacacccatttattagttcagtccagtaaaacagagagaaaaactagacaggtagctctaataaagtaaaatcatggaaatatatgatttcccagccagaagaaccttcaggactgtgttatccagacctgttttataaagacaaggaaggtggatcccgatggttaagcagttgaccacatttcacctccttcaaatccttcttatacagacattccctgaacttcctgtttcaaattgctatccttattccccacctactttacatgtttccacagcacatacctcaccaaacatgccttttattttactgttattttgttgactttgcgtgtcttactgaccactgtgcccaagtgcctagaacagtgcctggcacagaggaggtacccaataaatatcagttataccaaaaaatagtgaatgaatacacatggtggtccagtgctctttccaccactctatactgtactttactgtcactttttgtttgtttttgttattgagacagggtctcgctctgtctcccaggctaaactacagtggcacgatctctgcccactgcaacctccacctcttgggcccaagtaatcctcccacctcagcctcctgagtagctggggctataggcacgcatcacaccacacctggctatttttttgtatttttttgtagagacaggatttcaccaagttgcccaggctggtctcaaactcctgggctcaagcagtctgcccgcctctgccttccaaagtgctggtattacagccatgagccaccacacccggcctactgtcacttttaagaagcattttgattttctattttcatccttattttgatcacatcagaatatctgcttttctgtgaattattatttctaatgggaccacaagtgtatcagttaatcaaaatataaattatggacatcatgaggaaattttgaatttctaaatcataaagtggaaatccattttcaattaaattacatgaattttacacttacagaagagtaacttggtttaagctgttcaaggggtatagtactgtgtacatgcattcctgtgcctagaacactcatgccctcttgtggacagggttcatcctgacttcctgccgaaccttccttatctcagctcaggtaaccgctcctccaggacacctatatgtcccctgccctcctcctcctcccacagacaccagctctggttaaaaggggaaaactagaaggcttgtcttaaagctacatttgcatggccagcacattggttttacaaagaacatgcatttggggtggcttgcagaaatttataacgattattgagggaataaatctctaaagtccccctctccttagttactagaccctggaaggtttcaatcttcacctcctatagcatttgtgccacttctgtagtacagtcaatgcattatatttttactcatctaggtatccatagagcctagactagaacctagaagagtctgtggtggaactcagtaattattttttaataagaaatgaacgaatataaaccaatgagttacagagtatgcctaaagaataagcatccaaagatacactctctttcacctgaacaatttactatacatttgtagactaggccagattcagtctttctagcctgaacacattacacagcaacatttcacactgtgaccatctggtccattagatgtaaataccgatttggcagatacttcaggagtatgagagtaatgcaggaataaaatgaagttgaaaaatgctaccacccaaaagatatatttaaagccacatattatcttattaaaattaaaaacctaacattgtccttcatataagtgaagactgttttagtatttttactaatggggactatgcaaatggtctgaattttcatttgagagataattgggtctccatttgtatgtcacctctaaacaagactcccaacctcagagaaaaaccatctactcatcaaagaatctgttgccaatttaacacatagaaaaatcttcttacaattaacataaatagaatgtccttttaaaatgtcacagcattaattcaggtacttttgaaaaactcactcaagagtacagtgtttccatcaaatgtatgaacttagccccatttgcaaaggtcactaaaatgaacccatctttttccacataaaacgatgtatggggctacagagccattaaataaatattcattttaaatcaagctttttatttatccattggagatgacctctgttctaattatctataatgcttttcaaaaaggaaaggtatttttgtcgttgtctagtaaatcattaatttgtgtctattcaatggctgcatttttttaaaaataatgaaattatcaagctgctcagaacaaagctgccttctgattgtcagctgtatattctaaaagagcaggtaaatttctctgaatctcacagctggaacttttctaacactaactggcagtttccacctagtgatcaaggcaattgactaaaataaattacacataaagctgaaattcctaatagtaataaggccccttcatgagataatcacaccagcaaaagcactcatgtgttggctgcaaccctacagggtcttgaaattatcttataaaagctatacctccagaaatggttttgtttctagtttcatgacagggctaatatgacagtgtccatagcactaggtacaaaggaggagctccaaacaaaattcgttacttgactggattaaaatggagacactgttgttaaagcactaacatcagtgctatttacaaagcagatgactggtgaggacctcatttcaatacagtcaactgacaattatttcgaagcttttattatgtgcctggagctaggcatagaaaagtagtatatagtccctgctcttctggagtttaaggtgagttgagctcacgtgtaagaaataaatagggaaaaagtaatctcgaggcaccattctaccagctataaagcaattgctagcagaaatccaagtgggctagaatagtaaggaggtttttttgtttgtttgtgtgtttgttttttctttttttttttttttttgaacatggactagggcttaatggttaggagtaatttgattaggcagaagggaataaaggattgcagatggattttccaactaagcaaaagtctggtaactggaaggaatatagctcacagagaaatagtgattgctgtagcaaacttcccaatctttgtaccatcttcatgaccaatgcatttattaactgggctgtcaggagtgttgatggcttatagctcataactgagttcccccttcctggcatcaccctcagctgaaaagatgctcacccaagatgtaggagcagcccacatccaatgtttgggggattcaggatgataaaatctcatccttgttgccccatttccaaatatctttgaagaactctcccagctccagagttccccatagaattgactgaggtcttgatgtaactgtatcacagcccaacttctcaacctgtgtaatcctgattccctcactcccaaagaggggttgatctaaaggacacacccctataaacctcatgttgaaaatctgcctgagtctgcttcctcagagaactcaacatatgacaaatgaagatgctgaaaagaccaacctgacttattcagttgtaagaaagctgcatgttctcattcagtaggcatagacactattccaatgctgggaacacagcagtaagaaaaacaagtcttttctcttatggatctgatattctggtgaggaaaacctaaatagacataatagaatgtcaagtaatgacgggtgctaagacaaaaaagaagcagggcaagaggagaggtaatgtttgtgtttaggactgcattggactacattagatagagtggccacagaaaaagtccctaaagaggtaacatgcaagcagaaagctgaataaactaatgaaacaattcataccagtatctaggagaatattgctgacagaaggaacagcaatgcaaagatcctcagatagaagtgtgtttggcatgttttggaaagaggaagtgaaatctggagaacagtggtaggatacgaagggggcagatcatatcaggccttttagtgtaaggaacagatgttattctaagtaaaaagggaagatctcaaagggctttgagtaggattgtcccatgatcagatttccattttaaaaggatcatgctgccttttatgtgagaaggaaactagaaaggagcaagaagagatgcagagaggctattatgaggctattacagaggtctaggtcagaagtgacaatgacatggacttaaggttgccactggtcatggcttgcctgggactgaggggtttcccaggatgcaggacttttagatcttaaaccaggaggatcttaaacaaatcaggatgtttggtcaccctacttggactagagtaataaccctatgaatgaaggcatgtggtcaggttcaaaatatattctaagggttgaagaagcagtgaaacaagagcaaatggtttagacatttaggacagaggcaaaatgtaaaacttcttgaaagtcaggaagaggggttcagacctttcaaacattcacttggcattagtatgtagtatgcattgaattttgaagagactataactaaagaggtctttaatcagactacttcagaaaatatgacagaaatgtcactagggcttaaccacaatggaactgatggtaaaaatggaggtggaggtgattgaaatggtggtgttggtagtagcagaggtcatagtgtaggatggtgaaggtggtagtgatagtgacaagtatcatatagagatggtgctcatattgacatggatgtggaagtggaaggaaagaaagaaagacagatgaaaaaagacaaagaaagaaagaaaggaagaaaggaaaaaagaaagaaaggaaagaaaaagaaagaaaaaaagaaaagaaagaaaaagaaagaggaagaaagaaagagagaaggaaagaaagaaagaaagaaagaaagaaagaaagaaaaagaaagaaagaaagaaagaaaggagggagggagggagggagggaaggaagggaggaaggaaggacggacaaacaggaggaagggaggaaggtaggaaggaagaggaaggaaggaagaaaaggggaaggaaggaaagaagggacggagggaaggaaggaaggggaaggaaggaacgatggaaggaaggatctaacttgagagacatttacaaaatgagaaatatcaggacttgtgggttaaatgaataaaggaaaacaaagagaaaggaaatggagatgagttagtgaccctgacagaaagatgttggaaagaatagttgaggggagggattggtattgaacattaatttagttacagatataaagtaagagtggaataaccaagtggatggccagctgggatattagtttctatcattccagacagcagtgtactagtaaagaaaactcatgattttgagttaaaagagtttgccccagttcctctctgagacagctatgtaacctacaccctctcagtctcaaagtctttatatataaaatggacataacagtacctcgttcacagggctattctagaaaaaagtagacaaaattgtcaaggagcagcaaggatatgacttgggtatcttcttttttctttgcaaattttccaagaacccttttagtccccatcaccataatcccaccaaagaaaaacattctttttaatttagaaaatcttggtttctagaactttagagtgataaataaaatatttatattaaatgtttataaattactatgcagccatctttcttccaaactggcatgccaaaactatgaaattagagtttgatgtaaaactgttcatataaaactattgggttcttctaattcttctatgttgatggacaagagatatagtaaaagcttcacatgctagaacaagactctagggacagaagtgcttttcttctcatcacagaagttcagtgaaagacttcactgaggaaatgaaaatattggtttccaaaaattcgtactggcatgagtctttaaatctgattcagggtaacaacactggcttactatataagccacaaacacaagccttgttttgactggggcagaatagaacacaccttgtggggatgacacagaagtccagatcgtcctgccgtgagggtccttcttgcgggcagtatcagggcctccccaggatgcatattcttttttttttttttttttttttttgagacggagtctcgctctgtcgcccaggctggagtgcagtggcgcgatctcggctcactgcaagctccgcctcccgggttcacaccattctcctgcctcagcctccagagtagctgggactacaggcgcccgccaccatgcccggctaattttttctatttttagtagagacggggttttaccgtgttagccaggatggtctcgatgtcctgacctcgtgatccgcccgcctcggactcccaaagagctgggattacaggcgtgagccaccgcgcccggccctcaggatgcatattcttgctcttgtttcacataaacttcaagtccctcatcctccccaacatgtgagaaacacatgacaatcatatttgcaaatatcctagatcaattaatcttggatcaaaccaccaggtagtaaaagaaagctgccctaattttcaaacttttggtagacaattattaaagctaattcttagggcattagggaaagcatatacttaaacctccaaaaatttcactaacaagaaaatggttagtataaattggatattttccttgcctttttctggaaatgagtttttctctatcttgttgatgcccataaaggacacaaatttcaggaaaatcaaggactagctttcaaatatcttggagatccagaagtaataaaatgctaaaactttttgaaaagtaacttcagttaattaatataaactacacattcaatttggcatatcaattacaataattttatgagcaaatgaaattttacatgttaaagttcttaaactaatgaagcaaatgtagatctgtaaagggtgctttaaaaaagcacttttccatatttttctttctcccaaaatgcccatatttttctcttaaacactcattcttctcccatcccataactttaaaattacaagtaacatcacagatttctcctgcttccgagcatgctttttcaaactgtacaaatactctcttctgaagataaatattatgtaaaatcttttaaacttcctatgtgtcataagattgaggaataaaaggtattggaagaagacatttgtgacatttctttgttcaacacaattgcaatgcccctaaattaatcgtggaattagattatggcccataaagggagatgttatttaagagagagcagtcatgtctgaaattcctaattagaacagttagagtaacctgatcctgcaacacaatcagttccccaaggaggctattgtggaaaatagacagaattctgcgaaaaaaaaaaaaagagccctcctcctaacgagcattttgaacagcaattttgttcatttacatttctcttgtcccataaagttcagataaatttgtccatattttatattaatttccatgatattgtctcccattcattattttcagatactctgaagagtaatttattccactagcctctcctgttgtataaattaattcctaggagtgagtaggcacatcaggtgaattcagcacattagaagtaactctttattatttatattagtgaaagggggttatgacctagataattcaaaacaggtattttctaaagtttccacttatttaagttttgaaactgtgtggaaagtgataatttaatgatggatcctgtcttcaaggagtttacaatcatgtgggagaattaagacatatacacactgagacaaaaacagagttcttggtaacatagagatgtatggtaaaatgctatggggactcaagaaatgaaacacttggagccataaacatatttggtgatgtttccagcacagacattactttagcagaaagaggcactatttctccctcacacattgaatgtattacctctcaattatagaaaaattacaatctttctcttttgaaaaatggatataatgaatacaccccccccccaaaaaaaaaacgggggggaattacattttcttacctgttaaattacatctaggcacctatttccacactggagactctggctgacttaacatatatgtcaagttatagataaagacacatatagtcataataagggtattacttgaaagtgccttagtatatggctttctgtagctcattcctatgttaaaagtctatctgcagaagtctgacataactgttgccttctgtagaatcagaattcacattttattgtgggaaacactaaaataagtcttgatttgccatatagctaattctgcatgtcagaaagcactctagagcctccagtatctgaggggcatacaacaaactctctctcttgcactctctctatctctatctcatgcttataaatatgaatgcaaattctacttatgttgaacaataatttggttcttaattaatcaccctagaaaataaaacacttaaggcaggagaatcagtaggagtcttttccgaaaaaaaaagtaaaattctctataccatcatcattgtaaacacttgatcagttgttcaaaaatgcctgagtacaggactgttgaatgttctttgggcctaaagtatggttatcagtgaaataacatgagaagttatgagatgcatttgcattgtgttactatgggtttcaattttctagcctgctgctcagatttttagaattaggaataaaagttagacctcacttaagatgagtaatactaaaagtgcgaaaccttatactttgttacatttcagctatcaggaattcagaatttctcatcaataaatagaatttaatgacacacaaatgcaagtccttttcccaaaaacctagagtattagaggtaatcctatttgaaatgtaaaaggacaaaaatttaggtcgattgattcaactaaagtgttaggcttatttcaaagctgtttaataaaaacatgaaaattttgccaagagttttgcagtgctattcagagcacaaagtctctttaaaaagtcatgttgttctcatttcctgcaccattgaattatagatatattttgatgaacattaaagtatagatgatctttgttaaaaactgaaatagatggtcttaaaaaaaaaaagctgttatcactcttgataccttagtcaatgaaaggccactgtgtaaatgccaatggacctacaattttcaaattctaatcaacataatcctcctcttgaagaatttacaatatatatgttaaaactctatttacttgtatttgaaaaattgctaatactttcttattggttttcttagcaagagaaattgggtgatatctgcttctcccttcgctacgtacctactgctggtaagctgactgttgtcattctggaggcaaagaacctgaagaagatggatgtgggtggcttatccggtaagcctgcagtgtttattgatttttttcaaatgctgtttcgtcgtggataccaaatgcatggcgcacatgctgcgactccccacttcttaattgatcacagttctctttcctatggagcctggaagcagtctcagaattcatcccaacacagtgccccaggaagccactctcaattcataggaattagcatagaagatgaaatctattttccttctttggagccaaagtatcaattgtctttttaatggcattgaaagctgaaaatgtttgcttcttttctgaaagagagtgttcatgacagattataattttgttgagcttagagggggtttttggtcaaaattcacccacgatataaaaaacaatgttttccatgagacttatttattaggtatttgatagcctaacatagttcctacgataccatttattaaagacacagcatttcaatatatatgcataatgaaatctctgtttcagagtgaacccctatggtaatgcatttaattccacagctgacattgaggatgggagagatgtggggattgaaatttccatacaacccaaccttagtaaaacgtggtggataaagtataccctggctcaaaagcaaagtcaactcaaggacttgtcacttccacggttgaacataatttttcttcttctgcatatgattaaatcaattatatttttaattttccgctaaatcattaaagtgtgaggaattttcttgatatgccacaaggtcatcataaattgactgcagttgtcattgtttgtggctgtggaattacaactaacattactggttattcaacactttctttaataaaaatattgcaaacttcaaaaggtcatcctaaggcagcatggtgattttttattctaaagcataacagctaaaaagtgctacagctgagcttcccctcacttacccactaatttgtcgaccaaattctcctggtacctgagtgtatttctctttataaataagtcacctggggaagctgtactaattctttcatgtcattaagaccctatttaataacttgctgtttttattgtgcctagcagtgtaacacagcaaatttgaagcaaagagcacagtgttctctagaagtatagagtatttaatgtgactataagtgaaaaacatgcagagaaatttttaactacaataacagttccctcctagattattacttagtttcctaaggtaacttcagacacctttaacatttccctgtcctttggttcaacagccaactatcatgacatgatttctttgtatcctgtctcttatgctttgtcccaaatatccatgccaaccatcccctcataacctatgtctagtactctgctagtcttcctaagtcatcctatctgcttcagcagataggatttgtcctggcttcttccggggtcccagaaatgagttcccatcatcatagagagatatttcaaccacgagttgttcatcccagtttgctgtctgtttccactaggacttctccaccgtctgtccccttctcgttcagtggcatcagagaggctggctgcaggcattttggaacttggctaagggaagttaggtctagcaggttatttttatggggcttacagtcatataatgtatagtgaggttattgctagctatcccaaagaaggaagggtacctgcaatgcactaactaactcagcattgtgaaatgaataaggaaaggccaaaggtcatacctaattttgtattcataattttatattctttgtttctgaagagaaccagcaaaaccatattagcttcaggatcctcacaacctgggttcacccctacatttgaattacctggaaggagtttaattattaagtaagaatatttaaagagtaaatatcctgaaaagccctaattttaagggcttctcactgcctgtagaattaagccataatcactctaatcacttgagtctacataatgtagatatgtccagcctatgtcatgccatatctcattttcaccaaattgaccaacacactcttttgcaaacaaactatacaactttctgcctctattacttgcttaggtcgtttccttcacctggaattctcttccttccaacaatgtctagccaattcctacccattctttaggcccagcttaagtattatctcctccattcattcaataaacatatattgtgtccctactttaagtcaacattgttctgagcactaggtttacatttgtggataaaacagtgcaaaagaccctcccctcctgcagcttgcattctaatgtagggaaacagaaaagaagccaacagatagcaaaagcatgagtctaccaagagataacaggtgctatggagcagtaaagcaggaagtaggataaggaatattggggattcatcttaaatggggttcaaagaagacctctgagtaggtggcatttccgcaacaacctggaagaagtgatgaattgagccacggcgcgtctgggagagagaacaaccacggggcttctgggagagagaacagccatggggtgtctgggagagacaacagatacctcgtggctcacttcttcacttcttccaggttgttgctgaaatgccacctactcatgaggtcttaagacctcatggttttaagatccatcccagtagaacaaatctttgcctttttttaaatgccattagccatttgtttacacccctcaaacatcatgcttctctctcactagactgtgttctgtatttatccctcccacaatgctctcagtgatgggtagcactaagcatagctgctgaatgaataatgaattatttacaaaggagctatggcctgaaaaaacaagtcttgcatttcaaatgtgtctaacccacttaccattaaaataactttaagcacttggatggtctgtctcaaagtaagttgacctatgtacgaggagaccaaaattatataataagatcattccaggtaattcaaatgccaaagtacatttgctggaaatgactagttaattggaaccaaagtgggttgttttgccagagtttaaactccatctgccactaactagcaatttgacattgcacaagttatttatttaactcttctaagcctcagctgcattatctataaagtgggaataatgagaggactttgttgatgatgctatgagaaataaatgaaagcacagggcctggcacaactaagtactcactaaatactattgtagtcatttctattagtaattttatcaaatcttgggataaatatgcaacatgggaaagcaaccaatggatgatttaaccaattacttgcttcaatggggaaaaaaagtttatcttattgtttgatggaattagctgattaattcaggcaaacgtatcagtaggcccacattttgcatagacactatagtgaattaagataattaacaaaacatttgagaaaataaaacatgaaaacatatgtaaaataattttcttattgctctccaacaaggttatttccttcctgcagtattcattcaaaatgcattgcacaaagatttggcctctattgtatatccacatgcaaaaaatgcaaatctcagcccttcatactttacagtgacaagcctaattggactatgcacatctctacagtagatccttgcatttgcattcttaatatcccaactttcaaatgcttgtgagcaacagtgaggatttctgaatttaactgcagtcatgtgttgattaacaacaggcatacattttgagaaatgtatcattaggttatttgatcattgcacaaatatcataaacacaaacctagatggtgcagcctgctacacacctaagctatgtggtatggcttattgctcctaggctaccaatctatacaacatgttaccatactgaatactgtaggtaattgtatttgtgtatctaaacatagagaaggtacaacaaaaatacagtattataatcttatgggaccaccattctataggcagtccatccttgactgaaatgtggttacacagggcatgactgtatttgtattgagatcttgaatcttgcaggctgcaagactgttcttcaggagcaagttggtgctgtagaacatgtgtaggactttttgccttatacgtggagacaatcaagacttctgcctcttaaacatgtctcaatagcttcgttgccttttacacatctctgtgtggagtaaatcttccttcaaataagaaatgttttctatttgggaaaattggggaagagaataaagaggtcaaagtaaaggcattggaaacattgaggcttcccaaaggtatgaggctgtgtgtctcatagttttaagctaaagtatataacttttattcttaaatttgtacctgtgtaaactcctaagtcagagactaatcagatacgttgctacttgtccctatttgtgtcatagcaatcactttcctcaagtttggtgttttgttttgttttttgtcatctcagaaatttgacacgtctgagtacagctttaatgaggaatgtcaacactgtaagtttagtttaggctttctgttgtaaattaaatgaaattctgaaagttttctatttaaggacatggccgtttaaagaaggaaacactaaactttaaaataagcaaaaattgaagtgattatagcttttaaattttgatctattccgtagaaattctgtttttctacttcaatctgagaattatttttaactgttaaaaagtcacattatcagttatagaacactttctaatttagaaatattttttaacttggttttctcatgtggttctcatgatagccctgtgagatactttctgaagatagcattctgattttaccagtgagaaaattgaagcttagagacattagacaatgtccataaactatcttcctgcatgtggcacatagatgggggtgttcaatacttgcaattgctcttatcactactgacatttgatctcagctgatttgagggtaggactgaagttcagatccccccagttctcaatgcagaggactttctaatatagcattcagccttgcccacacccctaccttcaagatgggagagcaaggattcctcagctctaacctgcgtgaggtgcctcccctgcccaaagccgaaacatcaagatgaggtcgtcacagtagggaagactagaaatggagtcttcatggattgttggaaatggagggattcttggagactggggaaaatgttcgtaactgtaaacccttaaggatactcctagtcaaatagctccagggtgccccctttcttgccttctcagaaccacaaattgattttcttgcttcacttgtggtttctggcagattcctcttcttgcctggcccaatatgaaacagaatgtgatctcacagacatgttctacttccctcattccctgaagctagcacctaattcttctgagacttttttctgtgtttgtactgctagtagccatggcaaatcaacaagggtaaaaagtgtgcagttctgctcgtttgatgtggtttgcattcacctaaattggaggagtagggaacataacaaaagtatgtcaagcatgggggcaagctggaaacccatatggtaaagggctgaaatcacatgtagctattccagcagcctcctgaacatcaaggagctagggaggtggctaggaggtgggatcaggtcaacaatggttgcaaagtgctctccttcatcatttttctgtccctttcactctgtgttctatgacccatccctagtcctcttcctggccatccctagtcctgccttgttactatgaaatgaaacctgtactgtgaaaagcaacatttggggctgtaggagagttcctccaaaacatctctaagtctccaaaagaaaagggaaatgaaatgtttgaaagtggcagcaattacttgagggaaatgatagagagggaacaggggactcgtggtgatgaaggagtcaccatcactatatgtcacactgccagtgtgtggattagctactgtgacctaggcgagcaaaatttaccctgtccccctccctccacccacacacactctgttttctggaagatgccattttttaaatgttaatcatgggtttgtcttttctctagctccttttctactgtcctagaaatgtaatttgggaaatgcagccagatttaaatatttgagatcatttaggaaagagcaactcacccaacctcaggtaactactagattccaaggagaaaccatgaaccagcagaggtaggtcattccctcaggcgatatttatcaacatgtgatattttgcataaccccatcaaaatcacctagggtacttattaaaaactaagatttcaaggactaattcaaaccaagctgtgactgagtatctaggggtgggaacctggaaattgccttttaaacaggtcctccccgtccatacacacatacccatgttatttttatgcatcttaaatttgaaaactacacttcagaggcttaaaatgctatgtcataattttaactgaggcctaggtcagccaagttccaagttagaatttttttttttttgggtcagtaacatagaatacatcttttgctttatataatggaatttcctcaaataagaagttctatttctttcatcagtccagtatcctcttccctgaaaaatacctggcccacatgtctaaattattatctttttttcttgagtctcctccactgaaagaggaaataaaagcaatagatgtttcctttgtacattctgaagttgtttcctagtacccttgactaccacccttatctgtccttccactggtgctgaaagcacaacaaagaaaaacactccaaattcaattgatgtgaactaaaagccaccagtctgggagccgggccaataaataaaatggcaaaaacttatttgaaccaattagacagggatatgcaaattaattggccatgatatcagggtcaagcaataatatgcaaataaactggcatcttattgagctaatgggacaggaatatgcataataatttggctgtgatgtcagaagcttcatcataattttaggcatgaatgttacaatataatatcaattctgggatacttcaaaatgcttaattacaatattgataaaataatctgaattcgtaaaacatgaacagattggtctaaaaaacaaatgacaagtcttgaaactggatcattctagaaaatgagtaattagaaaggattatagccaagcccggtacaagttgggacccaggcacagttatccacagaatggatagaaatgctctgcctgaaggactaaaagttttagagaaatgagcagatgtgaaatcaagagaaataagtgataggctgtaatgtatttgttcagaagagttagcccaaaaactcctaagtagattctttagccagcaggtatatatccaatcagtcaacaaacatcatgtgaaaactcctctgtgccaggcaccatgccagtccttgagaatatgagtaaaaacagcagacacttgcatagcagaatgtgagcccagacactgttctaaatgctttacatatggctaactgatttaatccccagtacaaccctatgaggtagatactatttttaatgtgattttattgatgatggaactgaaggacagagaggtacataacttacccaaggtcacaggattactatttgacagagctaggatgtcaacccaagcagactgtcttcagactccaatgaataaaacctgatgtctaggtccttatcattgctcagcaggttcaacctggagaacaggtggataactacatgctgcagtttgaaagatgtccaaaagtgacctgattccaaatatcctctatactcaagctaaaattctatcatggaactcactaacataaatcagttggttgactgtttaattagttcttcagctacttagacagcaaaggtgagatcaacaagtccataacaccagacattgaatagttatagatgatttttatgctggaaaggactgtatcagtttctccctaatgtacagattggtatgttattttagtgacttattcttcacacacaaaagaagatgagacacaaaacagtgacatttcagctgtatctgtggtacagaagagaggttgccgaacatggtagaagagagtccaagtttaagggatttgagtgccttttagagattaaagaaaaattttacctacaactaaattttagcaagggctaattctgtaaaggagtatgtgatattattgggagaggggcagtatgatgtaggagtacaaaagcttactacccttgtaaattgttatgggactctttgggtcaaaattacatatataaatactaaaattaaagaaatttgaattgcaatagacaacttaccaggaaaacacatgtcagctagataattttaacaagagaaatctacagatgaagaagtagaaacagggagttccaaagaggtctgttctaaggcactttcaccagtcaccttaaaactcataattctgaagataagataaacgtttccagccattgaaatgcaaagctcagtggtaaatttaaaaaatctagctaagctgagtaagccaaaaaatgtggtagatgtgcttcatttgggtcaagctaaaaaataatacactaaaaggaaaacgtgacccaatttagagtatagagtaataggatcaattataaatcaagaaaaatgtcacatagaaccatccattgaagacattcaccaagtgaacatgtcttttttgctaccccaaaaaaggcttgatgttgtcacagaagattttataaataaaagggagggaaaatctcctacctttgtccaattccagagctcattcatgtgtacaacacacagagttttggttgttcacctcagaaaagacagtggtattagatgactatctgctggaggaaagcagctacaataaagggatgaaggggccgtgtgtgaggacaggctaggaacagcgggactttgtggtctgaaaaggatatgatgaaagtctgaaaatcatgaaaggtagagctagagtaatacctacctatttatcacatcccacaatactagaatcaggaagtcaccttgatgtttgaaagagaatagataaaagggatagctattcaggatgatctcaaaggcacctttctactcaaaaattctttgtcaaattttctttactactttacatttgggttgtaaatacgtgttgctctaggaaatggaacagattgaaatataagactgagataagtgtaggtctgttttgtgttataggcttacaaggagacatctctaaacctttgtgttgtcttgtaggaacccctcatgcctttccatgggtaaccataaatagcccacagctgcatatctcactaatccaacccagaatgcttacatttgcatccttcagttggccacttctattcccttctcttcattcagtatacagaaaaaaaaataaggagggtcagaatttctaataggtaattgcactgggaggaatagagtccccacaaattcctatttttaaaaattatgtttagtgggttctttcaggagatatttgggagtttctaataaaactattagaaacatgtagcaaaagtcggtgctattcccccttccttttacaaaggtataagattcctgttagtaaagcctataataggtgacaaaagcatgcaaagttttgagtctcaaacactataataatgctcagaaatggaaacatcaaagacagtcttttaaaaacaactgtactggccaggtgcagtggctcacacctgtaatcccagtacttgggcaggccaaggtgggaggctcgcttgagcccaggagtttgagatcagcctgagctgcatagtgggacccccatctctacaaaaaaaattaaaaaaaaaaaaaatagccaggaatggtagcgcacacctgtggtcccagctacatgggaagctgaggtgagaagatctctcaagcccaggaggtcaaggctgcagtgagctgtgattgtgccactgcactccagcctgagtgacaaagcgtgtccctgtctcaaaaaaaaaaaaaaattgtactttattataatcacttctgcttccaaaagtatatactgtttctacttggttccttaatcccttattcttaatctcagttataaaaatatcattcttgttcccttttcaccatagtcttgccacttgctgcaccatgagctactttgagagcagggattgtgtctacttatgtctgtgttctcagagcccctagcatatatgctgaagaaacagaccttaatataccctgcctaaacaatcagttttaaatttttaaattccactaatctaactgattattttgtcttcatcttccaaatgatctgacttaatttcatcacttaatgcaattattttggcatcatatagtagtaatcctattataatagaaatatcggctcataaataaaaaccagacaatggaattcttaaaaccaattggttattttagccatcattttcagaagattttacttccttccttcatttcccccctccccaccccctttaatggttaaacgaaagaaaaacagactatctccaagagataaaagagagtgacacagaaatgcacacattactgtagttatacctcaacgacagtcataaaggcattttcaagggaaaaagtaaagacagagaatgatcccttggtcaccttttgcccagcatgaacagataaggcaatgattcagcatcttacttgtccactgttttaaagactaactccttatcaaaggaagtcaaaagaccataccggctgacagcctttttaaattactaatggcctaaattttgcggtacatcattttcaatgatgactggacaactaggaggcttcctataattttttctttcagaaataaatgattttatttaacttaaaaaaagaattaagcgcatttattttatatcctcagaaccactgaaactgcttttagccaaaactaaagcaacatgattaagaaattaatagatttcaaactactgatttcagtcaacaatatgacagtgtaattaactaataaagtgtcccgttaacaaacaaaaagagccgaatgcacatttcgtgatagtgcacttgcagaattactacatatactacatatacatatgaaactgcaagattactcagtaatctactgacgcagctgtcatttttagagaatattatgaacttccatatccttattaaggaaacaaatgctttcacaaatagccctgtgtttaaatatttatctagaattttagttttaaaattataggaaagctcaagaaataaagttaatccacaaccccaccacttcttttcatacataagtaaaaaagtaactcaaatcagccccctctaatcctttcccattcctcagagttaattgactcaaggaaataatttgaaatttcatatccttccaggttttctttctgcttatatcaattctatacatatatatacaaatatatatacattttacaaaatgggattttaaacacattattctgtaattatttttaacctaccaatatataatggagatcctttgggccaacatatagatctgccatatctagtggttgcatagcatccctttgttcgaatgtatcatggtatatttagtaattctcttataaatataactatgagaaaaactatataaattcactgaaagacttcaaatgagacctaaataaatagaaaaataacatgctcttggatagggaacaatatagtaaagatgtcatgcttcccaaataaatgccataaatgaatttgaaagatgagtaacacacgaaaagaaagctttgcctcacataaacagatcaagtattaatatccctgtaatacaaagagtttctacatatcagtgagaaagaaaagcaataggagaaagtctctattttattaatgttcctaaaatttacttgctgctgcttctactactggctgctgttgctgagaagtaaaatgttacatttatacaatgtcattatgcatctaaataagaaaggattttaaagtaagatgcaattaccctaagttcaaaatctaaaaatgtgttgcttaaaaagacagcctagactgattgcaaagagtaccagaaaaaaaaaaaaaaaagcaggtcattagcttgtagattttcatattttcatcaactatatttgcaggagtctgaatccattaaaacactcaatccagcagcattattatgataacaacttgaaaagatatgtgacagtcactaaaagtcaaagtaaaaatacataccgctatgaaagtcattttgaagggaagttcccaatttctagactttataaaaacaattaagcatctgaaagctacttttactaaaagttgccaattcgtgtatctagaaaacactcctgcattttacagcactgtctttaatgtagtgaaaatattgcaaatgaaactagcctaaagggcaataatatatcacagtatatctccagttacagtaattaggaatctattctaatcttacctgaaagatatgttagtgttttatgtttataaggatttcaccaaaattttttaaaaatagcttagtagaagagattttaaaagaggcagtgaatgtttatgaattatgcaagtctgaactttcattttaataactccattaaaatataaaaaccttaaaagcctcccatcaggaatttaactttatagaaatgctttatatgtgccctgaccttgccaagaggcaggcctaaggcatgatttaacagttactacaaggcaaagcctaataataaatacctatctgaaaatgccagcatttgtccctgcctccttggcctccagtggagttgcaactcagccataaacaggccctctcctgagagacagcagggcgcagcagaaagggagcagcaactggccctggaaagcctggatcggaagcctttaacctttctgatcctcagtctgttcatctataaaactagggtattagagacagccatattgttgaataaacaaatgagataacattaggtgaaagctccaggtagaaagcactatataaatattggttatttctaagcaaaagacagttcttggttaactcttaatttttgtcaccatatcctggctccaggagaatgtgtgttcctatatggctgatataaataatactgtgtgtgtgtgtgtgtgtgtgtgtgtgtgtgtgtgtgtgtgtgtgtgtgtgttcaaagaatgcctcttcattatttggatggcagttaactgctttggctaacttatgttggcatcctgaagctaacagcaaatcctcctcccatctcctgtaacttgtggccacaagacccagcatattttataagaaatcagaccagtagtatatttctacgatcttcagtttgttaagctatttatttgagttaagacaccgagttgtcttccaagtacttcttttatgataacagatccaagacagacacagctaatttgggcaacaagtagggacaaagaggaagaacagagcctctgtcatcctaattatcaagttaatgcctggttgctggacaaactctccctctctctaaaatgaaccaccgcaagttggaacctgctgttgcaatgttaatttgactagaagtggcaggacctggtcccagagcagctcctggttgtctttccaaataattttgccccaggtaataaatacctaattgatgcaatatgagtcagtatttgttgttcattgctacataattgagtggtcaaggtttcatctttcacctgtctctacaaattcttaatctccacaagtagtcaacattaaaaacaagaaagttacccatgtaaatttctacatgcttgcatccaaacaccctttgactctcttcagcttgctttcctctcgatgaaatttcattttccatattaaacatatctccaggctgtgcccatcttggcatttcaaaaaaaaaatagaaaaacctggttggattatacgtctgccttctccttaaatcagatgaattgctccacttgccggtaggataaatagttcagttaaagcatatactaagaatctcagataagtagctcagttaaaacatatactaagaacctaggtaagaaatgtgaaaaaaaaatattgcttattagtcctacagcagagatgatacctttttttaaaaaaaaaaattattattatactttaagttttagggtacatgtgcacaatgcgcaggttagttacatatgtatacatgtgccatgctggtgtgctgcacccattaacccgtcatttagcattaggtatatctcctaaagctatccctccccccaccccacaacagtccccagagtgtgatgttccccttcctgtgtccatgtgttctcattgttcaattcccacctatgagtgagaacacgcggtgtttgattttttttccttgcaatagtttactgagaatgatgacttccaatttcatccatgtccctacaaaggacatgaactcatcattttttatggctgcatagtattccatggtgtatatgtgccacattttcttaatccagtctatcatttttggacatttggattggttccaagtctttgctattgtgaatagtgcctcaataaacatacgtgtgcatgtgtctttacagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgacggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagcaggttgcaaaaattttctcccattctgtaggttgcctgttcactctgatggtagtttcttttgctgtgcagaagctctttagtttaattagatcccatttgccaattttggcttttgttgccattgcttttggtgttttagacatgaagtccttgcccatgcctatgtcctgaatggtaatgagatgatacttttataacactttgatttgtcattttactaattgctaaatttgcccatatcagtcatgttgaactgtgcctccctcaaacaactagcaagactgatctgaggttgaaccaattgcttaggaaacatcctctatgaagctataaacctgaaacctatctatattcagtctctggagatgaaagtgtcagagctggcagggcatggtggctcatccctgtaatcccagaactttagaaggctgaggcaggaggattgctggaaaccaggagtttgagaccagcctgggcaacatagtgaaaccctgtctctacaaaaattattagccaggcatggtggcatatgcctgtagtcctaattacatgggaaggtgaggcaggaggattgcttgagcccaggaggctcaagcccatgatcactcatactgccacactccagactgggtgacaaagcgagactctgcctcaaaaagaaaagaaaaagaaagtgtcagataaatttaagaggtacatttcagcctgatccatattgagattaagggctgctttctttttaaataaagatatgtttagtatttctacaataggattcaatacaatagaattgaaagtatgtgtaagtttagcccaaagctaaagagaaagatactattctcaagccaaattacatacagtatgtagatgtacctgtatctttatctttttttattttttttgagacaggcagatatatcttttaaaattgacttggcctcatacttttatagcacatgcagattttgattcttgtaactgtcacttgaaattttgttttttaaagctaaattagtccaatcatcttgcatgctgcaagaggaactagttattcaaactatgagaatttagtatttgcttacaagcaagataacaagaatggaatcttttttatcttgggtgggtcagtgagcaaaaagatatttctttttatttctgtgtgctattaatatgggtggttcttatcattgcctctctaactttccatttaaatttcaaaatgatttaatcttaaatgtaaaacaactgtgaaatcttattaccgagattatttatttcaaaaatgagtctccggcaacagagttcctatactctatgctgagagatctggaatattgcattcatttctgaaaacacacttaagaggagagacattaactttctgaagcaaattcagcaggaaatcagggtcatgcagagggcagatacagtctcagttaaggaacagttcaggcaattggagatgtttaagctgcaaaatacagaattcaaagaggacataactgtctgaaaaatgtgagaaaagaattgaacctactcttattaactataaagacctgaactgggatccatgagtataagtgatggaaatccatacttggttcttcccattttagttcccaaacaaaagctagaggaaagtttatcagaaatactgagttagggccgggcgcggtggctcactcctgtaatcccagcactttgggaggctgaggcgggcggatcacgaggtcagaagatcgggaccatcctggctaaaacggtgaaaccccctctctactaaaaatacaaaaaatttagccgggcatggtgacgggcgcctgtagtcccagctactcaggaggctgagacaggagaatggcgtgaacccgggaggcggagcttgcagtgagcagagatcgcgccactgcactccagcctgggcgacagagcgatattccgtctcaaaaaataataataataaaaataaaaaataaaaataaaagaaatactgagttagggatggtaccctacctacctgccataggttagggaattaacctattaaatccctccaatcttctaaagtttcattttaaaactctaaaagatcatgcccagcctaaagacaacatcagcccatggaagagcacatctattaaagacaaatgtatcctcaccaaaagtgattattttattttttccttaagataatacgaatgaaagactactactgctaataataattatagttataatctagtcagtgctttctctgctgtgcatttactaatttcgtcttgtttaatcctattcatactctcatgaggtaggtatggttatccccatatatgaatgagaaaactaaggtttggaaaagagactcgctcaaggtcacaaggtaaagaaatggcaaaggcccagctcctcactccagctgcatctgttacctaagcctgcccacttactcacagcttcccccacctagacagtgcacactgtaatttcaattggccataatccccaaatcatagaaacctcaactctagaagataatgaatgctcttgagcagcaaaatgatcatcagttgactcacaatgaatactctctatagattattttgacaaagtaacgctatccaactgtgcctgcaaatgccaacacatgcaaatccctgcgacttcataaacagcaaatgccctaatgagctaaagaaacaattgctctttattcattttcttcagtgtgtttcttatttctgctggaaaataatgtccagaaggaatttgtgttctattcaatgactataaaaaagaggaaggttagtgtttacaagtttacataatacaaaaaagagtggccgtgaaacagtgagctgtggcttcctggtgggaagacactcacatgcagcctgtgacttcctgggcagttttaatttacttttaatcatttcagaagtcatgcctcagaggtttgagataaaaagtttcatagcatcttacctttttcttttctgcccctccttttttagtttggtaaaatgtagtccagaaaaacaggtggagggggaagagccagtttaagtatttgctcctccaggaaacttcccacatatcctaaacccatctttgttcttctttacctttatactgtccacgttttttcacttgatcactgactgttgtgtttcttcaactgtgttctgtacataccttttctcattcatgagaatgaattgtttaatcatcagggttgccaacaccctcattatttctttttctgtgttcccatggtgcactggagttatctcgtcccatgatttatcacacactgtaggtattcgtggctctttctctgtgaactcctttaaggagaccaacttaattcacttttgcataaccgtcatctagcatcgcctagcacattgtaggcccccatgaagaaattaaattaaatgaaaactcgaatagttcacttaatccccagtgtttaacatatagtatgaactgaattgaagtaaagtgaattaaattcaatcagaacaaatcaaaatgaactgaaatgattataagacattattatgttggataaagttatccagattatatttataatttgtagaaaaattgattagcacagcctagctatgttgttgtgtgattcctatgatggacactcaggattgcccattatgttactaccatagaaaggtcagcagcctttaggcccaatattacagctagttctttaagctgaggccataagggtagacacagtctaaatcactgtgtattggctgagaaatgtagaccaaactccggaaggctgacagtatttctgaacaagcaaatgatgcttaaagtgaactgaagctgttgattatacaggaggattccccaacaagtagatctaaaatttcatttccagggctaagtcaccttcttggtccatggtttgctgtgatctcagagggagaggaaaccatacccacaacagcccctcatccctcccctctcttcttatctctagcttctaaatagttgtccatcagcacgcactgtgcaccccatctgagttcagctgtgtgttaggcacctgaaattcagtcaataccatgaacattatctctccacttttgggtcctaacttctcaaaaaggagaccaacaataagtaagtaccaaaaatattaatcataaatgatcacaaattctatcaggctgtgaaagagagaaatgacaagatatttccctcatccaaaaatgtagactctgatttaggagtataggcaattcttttctcaaaattatatctcttttcatcaaaaaaagtaattattggtaaaccagataaataagcattttgtaaaaatgaaaatgattgggggagagaggaatatcctctcctacaatttgtgcttaactagcttaggtttgtccgatgagatcagacatcttttaatgttgatgatgttcacctatcagtaaaactttgggagcacattcctctttatacatttacttgtaggtttgtaagtgtatatagaccactatagtaatataaaatggacattataaacttaaaagtcaaaaaatgtaaaagataaagcaaaagtaaacattttacaatttgctttatgaatgataaaaatgttattctccctttaaaatataattactaatttgttaataataaatatgcctcacttttctttaagatatctgtttaactttgtaatgtagcaattcacaagcataatattagattccatttatttcaacacttagttttatagatggtcacatcaaaaaaatgcctcacaaatgcacaatattcataatatttaatatgaacttagtttggaatttacagaaaatatgtcaatatatcacatcgactgaagttttttattttttttaaatcaaaacttttaaaagcttaaaacttttaaacttttagagaagcttttagccagcttctctaacctgaaatagatgatcatttttacctgtaggcatgactgacagagcacagctgaagaagaggtaccagctgggtcatattctcatttctcactcgtgtttgcattatcaagttttcttcaagccacagttgttgttcaggactcattttaggcaacatgctcattttgtgaagagtagtttggttacaattaaataacataatctataaaccaatttaactgggctcacataaagcgcaatacatagaaaaatgctaacagcaaataaagtgcaggcccctctggcaccccaccccacggtggcgcttccatgccaccctcaggaaaccttgagtactgcgtgtgaatcatgccagaacaggggcacctctgtgatactgtacatcagacctcagtaaatttccaatcctttatttttagaagaagaaaataaagtagaaactctggtattttcttctggggtgccagaagtaaatatttgaatttctactttattttttccacactggagatcagagaaactaaaggtttcaagtttataaaccaaaagtcggccagcaaatacattttcctttcctttctcttaccaaagagaaaaagatgatatcatgttgattaagttttgtctttatagaccaactattcattaaccagaaggacagatcattgttatttattaatgtgatacctaatttttattttaaaagggtacacattctaacaaatggtaatttcttcataattttcaaaaataatgccgggttttaaaaagaaaaacagatgatgtaaagaggcactaaaccagattagtttcaggacattcaatgtcaccagaaggataggaatggctggatgttgcacctataaagggaaacactggatgggtagcaggatggctgctcacaaggatttgaagaactaccctgtggacaaaagtatggaatcacatattcagcaaatatgtattaaatgcctacttactaagtgccacagtgaggagctggagagctggtggtagtgagatggattttgtgatacctgcctacaaagagcttggaacgagctcagggagatccactttaaaatactgtgtgatttagattaggagtaaacaaactttttttgtaaaggaccagatagtaaatattttaggctttgcaggccacatggtctctcgcaactaaatattcaactctattgcaacacaaaagcagccacagacagtctgtaaggagtagacatagctgtgttctaatcaaactttttatttatggatactgatatgcaaatttcatgtaattttatatgtcatgaaatattaatcttttttatttttttcaactctaaaaatgtaaacattttcttagcttacgacctacagaaacatgcagcagccagatctggtccacaggtagtaacctgccgggagctaattaacaggatttcacaagagctcagaggaagagtacttaacctccactggagatttcgtgggcgcttcctggagaaaccaagaaccgggttgagggattgtgcagggcaaagggataggccaaaaggacagtgagagctaaggcctggttgtacaaaacagatcgtgtagtgtagaggagctgctaagaaatgaagttagagaggcagagcccagtcaggaaagttgaactttatgttccagaggtggtgagtagccactgcagggatttaagcagggagtttgtgctgcaaactgtaacattaattccagctcaggctgtggaatcaaactgacatgattaggatcccagttctgccactcaccaagcatctgaattcaaatcattttcttatcctcttcaaatatcagttccatcatctgaaaaccaaagataatccctaccttgctctttgttattctctattcttgtacctgtctgcttcacttattgctcatagtgtcacaactggtaatataaatttcattgctaacttgttatttgactgatgccccctctagattgtggggccatgtcatcatccatataaaccaggtacctagcagggcgcctgactcaaaagtacctgatgaataaatggaaaaaaaaaatcaactcacaatgataaagccaaccatctcccaccttgtagttctatcactatccatgcttgcttcttgccttacaaggataaatatgttgtatcatttatttaaaacttggaataaagtcataaagaaaaatgattaatcatttctatacatctatcttatccataatgtttattttcttgagcaagttctcattacacttcattttgccacatggcttttccttcttccactgagacgcacttcctccaagaaactttcttaatctaaatgttacaggaaaggggtcccaatccagaccccaagagagggttcttggatcttgtgcaaggaggaattcagggcgagtctgcagtgcacagtgaaagcaagtttattaagaaagtaaaggaataaaagaatggctactccatagacagagcagtcccgagggctgctggttgcccatttttatggtcatttcttgatgatatgctgaacaaagggtggattattcatgcctcccctttttagaccatatagggtaacttcctgatgttgccatggcatttgtaaactgtcatggtactggtgggagtgtagcagtgaggacaaccagaggtcactctcggcgccattttggttttggtgggtttggctggctcctttactgcaaactgttttatcagcaaggtctttatgacctgtattttatgctgacctcctttctcatcctgttacttagaatgccttagccgtctgggaatgcagcccagtaggtttcagcctcattttacccagctcctatttaagatggagttgctctggttcacacacatctgacataaatgggcaattttctagtttacattgcagtgagctggaaatgaagcaaaatctttccaatgcataattcaggctaacttttaacttaaattcacaggtagggtaaatggcccatttcattaatgatttacaaacgtctgcatgcctccttatctaaattgccaaaatacctttatatttcactgcccgatatcacattataaattgtaaatatatgacttatctattcattagatttccagaactcttattctagggcaaacaagaaagcaataaaatccatgttgaattttagctcatatttctccttattgttcaatttcattcattcgttcaacaagtatctattgaatgcttactgtgtgccatgtattgttaaatcttcccttttagagatgtttatgtaacattttttgtttttttgttttgttttgtttttttgagacagagtctcgctccattgcccaggctggagtgcagtggcgcaatctcagctcactgcaagctctgcctcccaggttcacaccattctcctgcctcagcctcccgagtagctgggactgcaggctaccgccaccatgcccggctaattttttgtattttcagtagagacgaggtttcaccgttttagccaggatggtctcgatctcctgacctcgtgatccgcctaccttggcctcccaaagttctaggattacggtaacatgtgttttaaggtgtttattttctaaatagcttaaatcttaaccaccaatttatttttttcttctatatgtgttggtaattgtggcctagataaaagctctagcaattgtagtgacaggacaaaatataaaaattctcagggctatttaaattataaacagattttaagaagcactgtgtggtgtttctgttatccttctgctttccaagagaatatatctgcatcctgaaatctaatcacatttacttcaggcagagttgcttttggaaattcaggctttgcccatattgtctttgttgtataaacaacttagcttccctttctcccttttgttctagaattatttagtactaattatagattgagaatatccagggtcaggaagacctagtccaggtctagggagaatccaggttcaggaagagaggagagcatgggcttggttagggacatattaagcctatgacaccaattaagacaacaaatggagatgtctaatatgcagttagtccaccaaaattatattcttatttcttaagtttttcaaactgccatggaatagtccctttttcattatctcaaccatgacaaatttctcatatttatcactcccaatacatttaaaaggtgttagctagagtgtgtttctcacttattcctcatactatctaattcttaaagctcttaactatataaaatgcaggccataagccatggagttttcactcatccttatttttaattcacttgctagattatcaaattcaaattctcttctattagaaatctttgcctcactaactggaagaagctcaagtcttgattcctttatgcaatccttccaatccaaccccagtttacagatgtgtgcctttttccaggataaatttggaaaccttccgaaatatcacagatatgaccaacttttgaaggatcttctattgtggttatgtaatctgtgtcacataaacacaactcttaaaatttcaaagagaacagtccactggaaacaacctttttgattcttcttactaccaaacaggctagattacgtagcccatgaagccagtttacagaaatgaatttgtaaagaaaatcgcttttaaagaatcaactgaagagaggttagtttagtggcctcacagacttcattaaaaacaaatcttgctcctgatttggcagggattttcaaactattctgattcaagaaccacttgtgaaggtcaaaagcacaatttactagcctcattggctataaaaagaaacaaaacatgacccccagtggggtaaaggcttctgatgagacactagcattaaattgctaactcatgccaaaaacaaaagtataaagattggaatctaggtcagtagtgattaatccgaggaacaggctggaatgaaacaacctaaggaccctacttggggaagcattaaatgtcataaataaaaatggccattagatgaatttacagcccaaattaggaaagtttttctatcagttacttgcatacagaacttaggaaatttatggaagacgtgacagtgacttccaaaatcgatagaaaaattagtacatgtttgaaaacagactttgggtcaaagtgtttcttttcaaaataggggtgggagttggggatgtgttaccctctaaaatcttccatagtaatttcctcctgagaaaagaaattcatttcattttagtgttcctatcatgtttttgagaatttccatcctcattttctgttctgagagcatggtttagtaaatagtcctcagacccaataaacatatcaacagagaattttttagcaagttaatcaaaatatgaggaaaacaatgggatatgcttgaaataacaagtcacttgattacttaattaggttaacaagactgccacaaattgaaaccctgtcgttttttaaaacctcggtcgaaaatatttctgggtaatgattcaaggaatgaagaaaattggcctttttgaaggttaccaaaatgtaccagctgtgtaccattccaaggagtcctctgagaaccctgaaaatacatacgggtttttgttaatcattttaaaatctcaaagagcagtctgtgctacacaataatacacgaaatccacatgaagcctcccggtattttatggcaagtcctacttaggccaagctttttggatttgcttcagatctttatttccaagctcagtagcaaactcctgaaagctttgatttcaaataaacatctccattttgtcttttgcctcttcatgtagtaatcgtgtatatgtttatatactgaagaatcaatcatccaatagaaatctagctttgataactatgtttactaagaggatactaaaattacccataaggtaatttaagggaattcattacccaaataaaagactatgagcataaaaaactatagatattgctgagagtttacttactgtgcttaatacttcacatgtactattacgactaatttgccttcttgaaaagatgaggaaacaagcctaaggaaattaaataatttgctgaaggttacacccgagagcaagcaactgaaccaatcatctaacccaggccttctaactccatttgggtcatcttttctgatttgtggctctaaaaccccctttccagaaacaatctgacatttttagaaaccttcttttagaattgacgtattttactgaaaaagattccatttcttttgaagattaaccagagattttaaagctaatcttggcttttctttcaacatttcttcaccactgccacccccaccaaaaaataagagaaaatgcagtttctgtcatttagatattttgagaaaatattaactgcagaaacaaattagcatgctctgaaaaacaagtcccagagtttagagagactctgacaaagatgcaatttgagtgtgttcctcaagcacattcattgccatttataccttattcacaatcagcaaatctggctgtgcctgggatgaagaattttttgtttatttattttagagacagaactttgctctgccacccaggctgctgcatcctaggtgatgtagcctgctacatgatcatagctcactgaagcctcgaaactcccctcttgcctcagcctcccaagtagtcgggactacagatacacaccaccctgctctgctaatttttttaatacatgggggtctcactatattgcccaggctggtctcaaactcctggcctcaagcaatccttccacctcagccttccaggtatctgggattgctggcatgagccatcatgcccagctaaacaagttcttccctaaaagtgaagagggcttgtttaaaaggactgtaataagcttcccttgcaattccccaagtggactttgcaaaatgtcctcctcccctcaattcttccacctcctagaaacacctattcatgccttcttccttcctggaagccctaggagtttcctggggttccttgagctatggcaaccccatatgtatgattccaaatttagacagaggagtgtaacctgtgtcctagtgtgcaagcccaggaaagagaattagcaccaatatgtgatactaaacacttgacaatctttccctcatttaattcctacgacaaaactaggtaatactgtcattatcaacaatttgcagatagggcttagagactctgaaatctgaagtccatgcctttggctactccaccataatttctcctaggatttagtagtttttattccttgaaacattggcaacgaatggcctactatattattatgctgaattccctgattcctactttaaaacacaaccatttccattttcgaaagattatagatccatctcttgcttgcctgaaagtaacacattctttcttcaaaggtaaaactgtacacctaaactttgtaaaactctgtagttgagactgtctcaagttcctgttgaatcagataattgttatcagatccccttgaaaaagataaaaggaccaccactgttacaaagtacagagcaacaaaagccaaggcccagttaacagcacttcattgaaatgcaagaggcatctctgtgtacttacttcccatcttagacacaggagagcagggggtttgaaggatttgaattctgaatttctgttagaataacatctgccaagaataagccctgaatgtactacttttacctgtagagaaaaatgagcttatcactcaggtctttgtcgagataatacctacacctgttgtcaggctaaagatttagatagtcctggatgaaattccaggtctgctgtgtgagtgttagggagcatggttgagctacaaattgcgtggaagcaagctgattttaagttgccatggcaaagaaaatgcagagaatgagcagcttttacattaatgttttctacatcttgttaggataggattgtccagctgaggggtgctttttttgtgcttctactgacatgaacagataaaataataaacactaattatagagtattataatgatttctgggcttgcctcagaggggcgtctatctggctaggtaattacttccctgacagataggtttttacgtgagaatggagcatgatgagcctagtttattgcctgctgatgagaccacgggggaggaaggtcatgcggtatgcttattaagaccattttagtcaacgtgtttttcaatcagtcgtcagggtacccacccctggttaaagaaacgctacagatgaaaatgacacagtgattctcagtcgtgcgagtctgttgctttagggaagtgactaaatggtaagagacttctcaggttgaagtggaaggcatttcttgaaaatatgatgcctttgcctataatgctctaaagttgatccctagtgtgaaagagagtgctgctttctgtatgatacttcattccctgaaagactattttccccagctaagtcagattcaagttcctacacaattctggataatgtttaggaggtatcctgacttcaaggaatttatattcaaaaatacacaaacacatgcactcttctcccttctcccgtaacctaattgagtttgccaggaaaaaggggcaatgattttttccccttgttatttactaatagataataaagaatatatactaggggtaaaaaagacagaaaatcagagagtccagagaggaaaggaagttaaaaaaaagaaaagaaaaactaaatgaagcttttacaaaaatgcgatagtgtacacgtactgcccttcttgaaatgatccatcttattaaatgatgtggtttcagtgcttacctcttagtcctgctacacctatgggaatttggaagaaagctaggtttttcactttttaaatgatggcaaatgttacgtgctccaaacgctgagtagagattcttggattgtgatgaaatataaaaatatagtgcagtccccactttgaattactaaacaaactcaaatattgtaaaaaggcaggcatttcttgactgctcatacaacataaacttttctcccaagtagtctgtgtcgtgtgtgaaactgtagataataaatctaggcttgtttgccatgtcttctatgaatgctcgaaggaagtttatccacacctaaacgtaactgttgaaatatttattggcatgacatgctaatagaggccttatagtgctttgtggaacagacacatatacagtcacgtgggatacaggtatgttttgagaaatgcacagttaggcaatttcatcattgttgtgtgaacttcatagagtgtatttgcacaaacctaggtgttgtagcctgctacatacctaagctatagggtatagcctattgctccaaggctacaaacctttagagaatattattgtactgaatattgtaagcagtggaaacacaaaggtaagtaagtatttgtgtatctaaagatagaaaaggtacatttaaaacacatcattataatcttacaggaccaccatagaacatgtggttcatccttgaccaaaacattcttgtatttccacttcctccctaactatgaatattttcatgctgttcaatatggtacaatggcaaaataagtttatatagtatagatggctattcaagatatagttatttaaataaaaagtgggtttttttcctaaaaacaaaacaaaagaaaatctccttttgcttttctaactaccctttatgtccattttgttgttgtcccttgcagaatttacagtattagacaaaacacacagtggaagatcagaatttaattagatttgtttgttgttgaaacagctttcaaattctttcatcttatagggagtgaatccctagattactcacagacacatgaaaataaaaaactacagaagaatgttcacattgcatttcagttcttcatcatgtaaagcacttgggcctttctaaaagatgcaaatcactctttattattttgatgagctaacaagatgaattcatctctagaacactataaaaactaaattgtgaaaaatggcgccaaccatataacctgtccttgatcatacctattatttggtaactctgtggggaaactagaatcttttagaagtattatttgtgtcctaactatttaagtggatgatttaccctcctctaggaaacttaatattgagagtaggctgagaggtgatcacgttaatctggaaaatttttcataaattaaggaaattgagtttaatagttacagcaaattctccacatgcatcatgtttctgtactgagtgctgaactatacaataaacaaggaactgaaaacaagctttgaaaatatccagcagattcaagtattgctatttggcctaacaacctcttaaacatatgctcatttgcaactgcaaatataaaagcttttgtgtaaaaggctttatattttatacacaaaatataaaaaattttgtaagattagatttatatgccaaaaagaatctttcatatatataattctgtaattcttagatatcaaaaacaagactatttgaacagtttagtattaaaataagtgacaacttacattacttatgagggcacgtaatcagagtggctgtacctgaactaggtacaaaaatgcttaatactcagcttaacactagcatgtaaaatgtatgtgaattcagcaaaacatattttaaatgactttacattccattgctatgtatgttatagacacaaagttatggcactgagatgaatcactacttttgacaaacattttttgacactctcacctgggagatccggagcaccatccactgacagccaaaatgatctaaatttatagttccattgtttcaaggcttgaatagaagcatagcagaaaacaagaatgaaagctgattttctattgttggccgatgtgaaaaaacgtcatcacttattatatgataggtttggttggctttctcctgagttacgtaagatgttatgttcctgatctgtttatgtatgggtgtttaatacccaaatctttgaattattgttagattatttactatcttttgctagtagttattcccaccaagcaatttataataagcagctaatggaagggaccactggatttttttttttttttttttgagacagtctcactctgtcacccaggctggagtgcaatggcatgatctcagctcactgcaacctccgcctcctagattcaagtgattctcctgcctcagcctctctagtagttgggattacaggcacccaccaccatgcccagctaattcttgtgtttttggtagagacagggtttcaccatgttggccaggctggtcttgaactcctgccctcaagtgatctgccagcctcggcctcccaaagtgtcgggattacaggcatgagccactgcttctgggcaggaccactggatttccatatggaaaaaactactatcaaaaaaagatttttttttccaaactctacatagataaggattgtataatcagttactggaaatgcattcttaggattgtttgcataatttattttctatgtatttgtggatgctcaatcaagctttatgtatattcattgatttttttcaaatctgattgccctagttatgcgtgtttattccccccaaaattgtcagccacaattaaaattaaaattatgataccaaacttactggtggtagcatgctataatttataattcaagatggtatcagagccacattatatactaaactggttttgtatatgcagtttatcataggatttagaacaaatcagtgtattaggccagagttaccaactgaagggagcatcaaccaactgtggttatacaattacccattgttgttgttgttgttgttgttttttaattcaggaaaatgtgttgtatatgaatatactaaataaaggaaataaagctattaatagaatgtgccactggtgtcttaggtgaaaacatacaccaagattcataactcccctaaaattgttattgtcagttagctggataaagtggtctatgactaagttaaaaagctagaaaaatcttgtagtcaaaaggaaaacaaactttgttatgtatactcaggctggcccacagaaggtggtgcatggcagtgctggtgaatatcattgctgcagtctctaatactgctgcagtgctgcctagctgctactttaaaccaacactggctcatctggggccttgaattaccccttaaaggttgtatggtgcattaccctgctattttaaaattactttaaaccattcctaaagaaaggtaccacatccttctccagagaagaagttattagattctttacaaaaacacatatttatttaaataataaatttccaacaaaaaattcacaattataagattcctttgaaaattaccagggttttccccaaatacatttttgggtttttttttttccttccttagtattcattagttttcttttttctttttcttttttttatactttaagttctggggtacatgtgcacaacgtgcaggtttgttacataggtatacacatgccatggtggtttgctgcacccatcaacccatcatctacattaggtatttctcttaatgctatccctctcctagccccccaacccccacagaccctggtgtgtgatgttcccctccctgtgtccatgtgttctcatttttcaactcccacttactagttttctattgtatgaactatcttccatgcttattttgcttttattaaaaataagaaatctgtattcctggtattccctggtgtttcgatcttttacacacctattagaaccataatttctgtaacatcataacgcttttcaaaacgtctcagtgcctgttcctgaagttattagtttccaagtctcctcaatgcctagcctcgtgcatccatgggtctgtagttgcgcctatagcattctcattgctacttcagtttccctgtgacctcctacttcacttctctacgggtgtgcactctccttatctttcttgctttctctctcaacgttaaattcacatatatgaaagacattctatgggaagaataacctactccagcatttaatagagccattctaaacatatctgacatagagatgtccgcctgtcacctgcctattcaggaaatgagcttgagattggagatagatatattattgcaaaccacaatcaaggctaatatcttaacctgattttatcctaatttatctctgtttatcttcattttcagcatttctgctctttctaccctctcttacccaccttgtaatcttcaaatactatatctaactgatacccttcataaagggaatatttttgcacatattatgcactttcagttgaagagacagtaaccctccaagacagcaatggcccagaaaagagactagaaatgtagtgataattcataagtcaacatctgcctctcttttctaccttagccaagtttaatgcagagggcattacacttagttctagtctcaagtctaccataattagaaccataatcatgggcaaatcatttaacttgtctgggcatcaatctctcaatgaaaaaactaagctatttgacacatatggccccttttatgtttaaatcaattttattgttttttactaaatgaggtgtagaacattgacccatcaaatgaaatcactgtaaagaatataaaaattatagttaaataacatttcaaatatgaagctatttaaatgtcaactgtgcaggcaatttttaaatatttctagtcaatcataatcactgctttctcagtctttctattcttcctataagcatttgattaaagttgataacacagaattctcttttaatatgcattctgttggggataccaattaagatttctttaacttgtttattttagaaattgtttataacgccaggcaacagttgtaaagaggataacattcccagtagatggttttgaaaacttctataatatctaattatgtatagatccagactgtttatgtttggcatacaaataattgctgggagttagaatggtttgatcaatacatgcaattaagtgcacatatgttaacctttttctttaaaagttactttgttatatgaacatttattttttaggttatatatttaatcccaaatctttgctatctcatgaagaccagtttgtcataaacacttaataaatgtcattttgttcaattaaaacagaagggcctgtacatcctatgcatacatactttttcttctactgcattgtacaaacatttaaacctgtgtgtgtatagcttcaggaaactgtagctggagctgggccagaaaatgtctacagtagccttacaatagttttctagttccttggtcactactatgcatcacgagtgcctttacctatgtccttttcctcttcaacctatatacacacagactttttcctgcttctttaagggggaaaagtctgctaattcaggtgagggactatgtgtttgaaaaagtgttttcaaataaaatacttggccagtcacagtggctcacatctgtaatcataacactttgggagggtgaggtgggtggacaacctgagtccaggagttcaagaccagactgggaaacatggcaaaaccccatctccactaaaaataaaaataaaaaataaataaaaaaatagccaggtgtggtggcacacacctgtagttccagctacaagggaggctgaggtcagaggatcacttgagccagggatgtggcggttgcaatgagccaggatcgtaccactgcactccagcctgggcaacagagtgagactctgtctccataaataaataaataaattttgtagtggtagaagtttctaagcagggatttccatgttctactcatagaaaaacttacagaacaagcaggtactttaaaccccaacttctagggctaactacgtcatggaaattattctataaggacatgatctacatcattacatcacacatgagtccagccctctttgtctaagcctgtgacacatacttaaaccctgctgtttaacaaatcaactccaaagtaacccatctttgaatgtcattaaggatgagtatctgcaatgcaagaaactttgttatcccatgatgtttagaaaaatctgcttaataagtagatatattccacttgtttgttactctccataggtactctctctctacttacaacagaattatatgtaatcagttgttctcattcacataaacaaaccctgacaagaaataaaaatgtggtaatatcagttctctgcatcaaggaacatttttaataaactgtactatagaacgtcttactaatcagatcttttaacaaaacatatgttagccgtaatttctgtactaagacactgaatctatattacattgtaaaaatttgagtatgagctatctatacgttcccagcattgtatcctatgtaaaaaccctaaattaaataatacacccaaagaaattgagaccatttttagttaatttaagaaaataatgtcagatatttccagttgctaagcatttaatatgaatcaggcactgtgctaagaattttatagagagtagcccatctaaccctcacagtaaccctatatggtaggtactgtaattaatattattttacagaggaggaaactaaaatgttaaaagcttaattgtccataattgtaagtggagctagaattcaaaccaagtttttctggctcctgaattatatttttataccaccacctaccagtacatttatattcaggtttctttggctatctcaccataaaatgctgccaccccatcttaatggttgaggagattcaactctcagttctaccataagcagtagcatgcaattttagctatagctctagaagtatccaagattatttagctcaatttcccagctctgtaggttaaattcattgtctttaatgtgtttcactctagctacccaatgcaaattatgtcactaagaacaaaggaatagtcactacttgtttgtttccaataattcttttttttttttcttttttttgagacggagtcttgctctgttgcccaggctggagtgcagcggcgcgatcttggctcactgcaatttctgcctcctgggttcacaccattctcctgcctcagcctcctgagtagctgggactacaggcgcccgccaccatgcccggctaatttttttgtctttttaatagagacggggtttcactgttttagccaggatggtctcgatctcctgaccttgtgatccgcccgccccagcctcccaaagtgctgggattacaggcgtgaaccaccgcgcccggcctccaataattctttattatatactgtgctgtattgaattaccttggattccattattttgccaaatcatttatttataaggtaaattcctagaagtaacatttctgggtcaaacgacgttagtaatattgataggtacaaaggctttttgttattgtttgttttcatttttattaaagttatgcatacaagcacatagatttaagaatcaaacaattctacaatttttttaaaaggataagaaaagcagacactcccctcacagtgcttgcaggcacctcttttagctttttttttattttcaatttaccctcttgtctctagatgatacgctgcttggtgaattttgtttcagcgttacccactgactccccgccatggaaaatgagggtttagctcttttctatgcacacacatatttccaatatagttatgccataattttgtctagctcaatattcaattcacattattgggattatgtggaaactgcacaattgagccctatagtaacctttcaacacttttcctttctcatctagcattgtttaattgtcccattggcttaattttcatgtgtttattaccaattcaatcccaacctcactgctgattgtctaaatctctctcaaattgctcatccttatgaagtagccttccccagaacctgacttgctacagtctagactggttgctctctaactcatcctggagattcctgccatctgtgtgggagcttctaatgtcttcctctttcagtgttggctccatcttggtggcaaacatccagtagtaactaactgcctgcaaggtgactttgggaaagctgcttaacaactccaaacctcagtcctctcatctcaccttaattgtgtcactacttttaagattagtcatagcctcttgacccagtggttaaagcagttgttttcaattggcagaatgcattagaagttctggggggcatttgttaaaaatgctggtgcccaggcccaccccagtgatcctgattcaatagctctgaaatagggtgtatctgaatattaaaaatacctggtggttattctgatgcaaagtcctgaagaatcactttttaagaagcaccagctcaaagatataaaacaaaaataacaagtcagcagtgattttcaaagccaacagtaaaagaagctttcaaaaatcccttcccagttctaaaatgtatacattgggggatgccagaaatatattgcttaagatttttgaaaagttccctaggaattttaaaaaaactaatttaataaagaataacacagtccataggtcattaacttcaaatcatgtattaggaagatggcgaagagctaaagtggcccatttttattattttctgaaagtggaaaagatgttgccaaaagcaaagaaaagaagacattatcttttgtaatcattgaaatagaatttttagttgattcccgccccccaacagttttgagtagacagtaagaattacaaatgattacaccacttagaaaagccagagaaaggaataaatagatttatttttgttcagaatgactgatttgttgtgatcagaaaccaaaggattttaaaatactgagtacaaacctgcatatgaggtttgtaagacaatgggtagaatactggatgtcacaactaaaaatgaggccagtatcacggtaattttgcaagatgtgtgtcaaatatcaatccattgttgaaaggtgtccaattcatattgtaaaccttagtaaaaaatgtgccacatccacaccacatgaacagcacatatcatcacaaaaatagtgttctttgaagaatgcgtaggtaccactagacacctattattaatcattgtttctccaaagaaggaagagtttagatatggttttgggagagtatcttaatgaccaccacatttcaatatttttaaaatatatgtttgaaatatcctaaataggcaagtttccatggcaatatactttgggcaatttgaaagcaaacaaataactatgaaaaatgttatttaaaaagtttttattttctagcatatctacaaaaatcacatcaactctttgctattgtgaaaaactacatgtcataggaaaaacaagtaatgatataaacagatttcataatttgaaataaactatcagctgaacaaagattacattaagaacatacccaataatacagattgtagatgcacaagtaagaatttacaccggtttacagcaaatgaggacaggaggatggaggatactttactccccatttgatcccacatatggtatatgatttacttggagtataaaggacaaagaaaaagggtatagggagactatcaggagaggtaaaccaatttaagctaatgcaaaacgaaaaaaaagacaaatgtttatgtctgatgacataaaattaaaagattactagttcagtcagtttaatgaagattaatctggtccagttaataaagaaaactgagtatatgtattgtaaccatgtctgaagaggcaatcctgaaagcatttttttttttctgaagcacaactctttatttttctttcttttttttttttttttttagttatactttaagttctaggttacatgtgcacaacgtgcagttttgttacataggtatacatgtgccatgttggtttgctgcacccatcaactcctcatttacattaggtatttctcctaacgctatccctccccaagccccccacccccgagcaggcccccacatgtgatgttcccctgtctgtgtccatgtgttctcattgttcaatttccacttataagtgagaacatgcagtgtttggttttctgtcctcgtggtattttgctgagaatgatggtttccagcttcatccatgtccctgcaaaggacatgaactcatccttttttgtggctgcatagtattccatggtgtatatgtgccacattttctttatccagtctattattgatggacgtttgggttggctccaagtctttgctatggtgaatagtgccaaaataaacatacgtgtgcatgtgtctttgtagtagtgtgacttataatcctttgggtatatacccagtaatgggattgctgggtcaaatggtatttctagttctagatccttgaggaatcaccacactgtcttccacaatggttgtactaattcacactcccaccaacagtgtaaaagcgttcctatttcttcacatcctctccagcatctgttgtttcctgacttcttaatgattgccattctaactggcgtgagatggtatctcattgtggttttgatttgcatttctctgatgaccagtgatgatgagcattttttcatatgtctgttggctgcataaatgtcttattttgagaagcgtctgttcatatcctttgcccactttttgatgggattgttttttttctttcaaatttgtttaagttctttgtagattctggatattagccttttgtcaaatgggtagattgtgagaattttctcccattcggtaggttgcctgttcacgctgatgatagtttattttgctgtgcagaaactctttcgtttaattaaatcccatttgtctattttggcttttgttgccatctgaaagcatttctttaagcttctctgtcagcctccctcttcttttccccactccatccttctctctgatttcttctgccttctggggaagaaatgaagactgagcaatttcatcagtatatacccctctactaagcactagcatcctgtgctgttccctcctgggacagagaagaccagaaacagctgctatgtcaatttacaccttgtctctgactaacctagaagctatagcaggggctgcattaaagacataatatgtcatttgtctgtaatctgctctaatgctttggcatctggtcacatgtattacttaaaatcagacaaatacataaactcttcacatagcccagatagctcggtgatagcacctggtaaatgctaggggtatgtagccgggtattaacttgaattgcaatggaccagcagatatgaaaatgatttgggatattaccaaagcagttgttaaaatggaaataatattgctcttactgggaagaaaaaattgaaaacagtaaaaatgcagctacaaaaaaaattacaggcagaagcgctatagtattttagatttaacctgtgtaggcaactgacaaacactgataaagacagatggccatgacagcatataaaacagtcctcaggatgattcagtatacaaatgtgaacccatttaagctaataaagatcaataccaaccagaagttgatgatgcataacccaccctttattcttatgtctcattttaaaggttaacacatttcaaaatttatacatttaaagatgcttaacttttaagataggaattgatttggcttattttatgttaaagaaaactgtttcagctcacatcaataaaatataatacctaactagaattcatcaaaaacaggtttctactgcaacatttcaacaaactagatgatatgttttacgcttattaattactcaaatgctaaaacatctggactgtaaatttaatcttccaatgaaatagctacacaatacagttttttcactattaaatacattaggttattaccctgtttacctaaagttacctccataattaccaatagaattaaggttaagttgataaatttcatgagaatcccaaagtttgaaaactattttcacacaacacacacataattttattatcttatattattttttaaggccaagataattttaaagaacttgatacataataagccttaaatacatttgtcaaagagatgagagaaaaagaggaagggaaagaggtagagaggaagactggttgtagaagagacatgaataaaccatggctgcatttaaaaattcctctgaatgatttatgaattcattacagagatcaacttttttggttttttggttttttggtttttgtttttgagatggagtcacttctttcacccaggctggtgtgcagtggcgcaatctcagctcactgcaacctctgcctcccagattcaatcaagtcttctgcctctgcctcctgagtagctgggattacaggggcccacgaccacgcccagctaatttttgtatttttagtagagatgaggtttcaccatgttgaccaggctggtcttgaactcctgacctcaagtgatcctccagccttgacctcccaaagtgttgggattacaggtgtgagccaccatgcctagccccagagctcaacatttattacggattttgttttttggcttttgttttttgtagagacgtcatctcactatgttgctcaggctggtctcaaacacctggaatcaagcaaatctcctgccttggcctcccaaagtgctgggattacaggcatgagccaacatgcctgactattacagactttgatagtagtctacttgattcataaagatatttcctttcctagtctatgtgtagtaagcactttacttagagcataataaaagggggaaaagaatatagaaatatcaaagaagagaaaaattgatttaaactgatgcatatcatatcaaaataaatttaaaataacatactcagtaaagaactatccagattttcctaattttctaaattaataaatttagggagacatctttatagtttataagatagccattgactattttgttatcatactatggctgcaatatacccaataatactctgtatcctaaattagttactacacctgggaatataatttttaattgcttaatgcttacatacaaaattatctataaccatttctaagcagaatattttaatactttagaaattgagtgaggtatttagtatgctgaccattttataaggtccaaagagtatgctaatggagttccaggtgagaacaagaaatttttataatgatggccaattttcatctgggaccaccctcaatgcagaaggattggttgatgtcatgtctgccctaaactgaaactatttcacttgaatacaaatttagaaaaatatgttgataattcttcagcatattgcaagtaaatattaatttaaatattaaatgtataagtattaaattaaatattaatccagtctttctcaaccctcccagtacatcagaatcaccttagtggatttttaaaatacagatgccagggctctatcccaagagaagcagttagttgaaggtcataggaaataattattttttgaaagttttcccagatgatactaatccagtacaaaacaggattaaatgaagtcatcatagtccttttctgtcagaataaaggaatagagcttccattcaaagaatggaagttttataaattctatatctaggctaaggggacataatcataggttaagtggagaaaactgtgactcaaatactttgtgtgacttgattgaaggatgatatttttctgacagtgtgtcaacaaatatttattgagcatttatttggtgccaggcattataatgttggtactaggaatagagagattaacatgatattttcccttcagcaatttatattctggaagagagagttaaataataaacataaaataattttgggtgctggtaagtgcaacaaagaagacaaatagaataatgtgaaaggtaaatgaaggggtggacttagctctggtgaacagacaagtttctttaaaaaggtaacatatgaaaacctagaggaagagggtttcaggcaataagaaatgtgaatgctaaggtcctgagatgggaagaaactttatatatgttcgaggaatatccaggaagctggaatggccagaacttggcccagcactgggagagtgaaagggatgaggtctcagaggcaggcaggaaccagctggtgtagaggtttggaggccactggaagggggttgcttgtattccagttgcaccagggaactagccatcagagattttgttttattttgtttgagacagggtctccctctgttgcccaggctggagtgcagtggcacaatcacggctcactgcagtctcgatctcctgggcttaagcagtcctcccacctcagccttccgaatagctgggattacaggcctgtgccaccatgcctggataattttatttttctgtagagaggggagtctccctatgttgcccaggctggtctcgaactcccggctcacgtgatccttccacttcagcctcccaaagtgttgcgattacaggcttgagctaccatgcgtggcccatcagaggtttttaaatgaaaggagatctgcctgcattttggaatgttactctggttgctgtgtggaagttggcctgaagaaggaggtcaactttggaggcaggatccctgatgctgcaaaatgatggtacctgggtactgggaagattctaattgatgacctaagtcttacaaataatggtttttctttatcattcttttaggtcaaaagctctatgctacaagacttaaagatgtggggaggatgtgattcatataaaaaggaagcatcctgatagatttttccgagtatatgtgaactcctaatccaaacagcttttcatccaggaagtttccatcatgctctccactatccactgtaaattccatatcactatgcagaactgaggttcctgacatttttgtgtttctcagaaaatgttggtgcagctttttagtcttgtaaccgaatgaggttaggttatgttcatgctacaaacattagattccaaatcactgcttaaagctgaaagttaaccttctaattgaattaatttctacatatgtttttcctgttccaccaattatattccatttgtcatttgttatgtttcaggaaaagtgttcagtatgaaaggccagtctgatccacagaataagggtaggagggctcttgctgtaacataggctgagctcctctgaactaacagggaaaatgtgatcaaatgctattgaatgaattccatactttaagaagacagaatactaagggccatgctctgagttcatagcagtagttatctcatatttaataattgacttggcttttaaatactgtcttaaaatatcttctgaattattatgtttaattcttaatttatcctggctttgtactgttagccaacttaattttaaatttcctgataacaaggagtaggtattatatggggcccatgtgtgttaagcctattatgacataaaatatgtaataggaagtcagtaaataggtgccgaataaagtaaacgtttaacagaatatggtccttatatggtccttattatggtccttgactctagaagtcaagaataaggtccttatactttagactttaaaatgcatttaaaatatgataaatgttaacttatacaaatcaacatatataaaatttgtcaacagtagacatgtatcaaaacatttgcaaataggatttattgatgaggaaaattttctgggaaaacatctaaattgctattttagaaggaaaatgattgtaatatataaaatggacatgttttttaaataatgcattttgagtaggagagggtacagaatctaatatcggggccaaacaattttctattcaacagtaattccttttacagtatttttgccatggcccttgtagctgattcttctccaacccctgctccaagtcactgtccagctcaacacgaccatacgaataaccagtacagtagatgaaaataaatcatgtagtctcagaaagtcttctatatttctgtctgcttagtcagtcaatgttgacaacattaatacatagtccagtattgttgtccctggtttcctttgaaatgctacaattttagaatcctattatttcagtgacatttattttcttaggggattggattagggcatgaataagaaggaatattcatcttttccttgttcttttcaagttttaaaagggtttttaatattgttatttttgatgcagattgttatatgacattgaaacaagtcatctgcagtaatttgaatttttttttttttttttgcctttcaaaattccaatcactgtcttcagtaggtaatcccaaggaatattatgataaaagataacataaaaattcagatatgatattcctgttatttagaggttatatttaattttcctgtaagtcaaagtattcaaatatgtttcaaatatatttccaaaaatataattccaatcaaacttaaattggctttgtttatagtcggaacagtctatgttaactacgtttatcccatcttccataacatattaggggaaaaagcagactaagtgttgtcaagtatactcatttgatgattgctgatggatttagttttaaaggcaccttttaatatacaaataaattaaaattctcatgtagaagatattacagagtaaagaagtagctctgaaacattggggtttctgaataatctggaggtcttgttaaaatgcagatttcccttcccactcccagatgtctgggtggtgcccaagaatttccatttctaacaagtccccagctgatgctgaccttgctggtatagggccacaccctgagtaccacttgtaaaaatgatgctcatcagttctctgcttttcttaaggaataaaattgttcaagctaatcagttatatccacaagtacaatatcatttaagagaagcttctagagatctttaaccatattcatatacagctctgctggacaaaccaaattgacttgagttaatgcaaagagcttatctgagcatctttctctccaaagccaagatgactggaatatacctagtcctattcttggaacttcactttttctccaagaatacacaagtcattccctctccttcaagttcaaacttcctactcggctttctcactcctctatgcctaacttatcctttatgtttatggacatagtataaactatagaaaaaagtaggtactaggacccatggcaagtcattaagttgagccacgatttcatcaaaatgtaaaggtaatagtacctacttctggctattgtggatggaaaaatgagatgatatgcacagaatcaagcaccatacccagtattcaggacgtctcccctcctactgcctgcaaaattaagttttttcctatcttcctagaacttctggcttctacagttattgatctccctgtcaactgcattccatgaaattccctgctaatcctagagtgtatcagacggaaactgaaaaagtgaccatatcagacagcattttcagttttctagaaggcagaaaaacacaaaggggataatttgatggctgcttgccagaaagtagcaggacagaaattagagctatggaaatttgtaactgtcttaatcacctctggtgaaacacaacatccggcagaacataacaaatgagaccacgccatgtctgatagtaagttttagactgagggcacattgctgaaaggcaggtgttgttctgatcacctttgtactcactgttgcctgggctattgccatgttttcataagcctcagtagtgcatttggtttccatggagtccatccatgaactaaaagaacaaaacatctaatcccaaagcagaatacagatctcttgtagtttcattcacccttttaaacaatatcacagtaatttttagattcaaataatcattgagagaccctgtactagcagttagggacatgtcatctgggcattggctctattgaacaatatgatcttaaataaaccttttcagtgccttgggtctatggcccatctgtaaggtggacataatgctgcctggctaatctgcctttcattgttattataatacatatcaaattgcattgtagaataaaaatgtcaaacaagggccaatggaatactggtgacaaagttgaatagcactagtaactagaatcaagtcaattatcagctttcaaacataccgaatatcaagaaagtaccataaggccaggcacaatgactcatgcctgtaatcccagcactttgggaggctgaggcaggaagattccttaagcccaggagttccaggctgcagtgcactatgattgtgccactgcactccagctggggagacaaagcgagacccggtgtcaattacaaaaaaaaagtgtgccataataatctcataatgctttcacttcgtattcatgaagctagtaacataagcccccttgataatacagcctattacaaaatcaaagttggccccttctactttggaacaaatgtattttatgagtgctttggttggctaatgaatttctgtagaaagaattttacttttcagttttcttcattttgataaaggagattaccacatggaagaatgatattaaagataataattaaaactcaacaaaactcaaactttttttttttttttttggagacaaggtctcaccctgctacccaggctggagtgcagcagcacagtcatagctcactgtagcctctaactcctgggctcaagagatcctcctgcctcagcttcccaagtagctaggactacaggcaggagccaccatgtccggctaattatttcatttttgtaaagtcatggtcttgctatgttgcccaggctggtctcatactcctgggctcaagcgatcctcccaccttgaccttccaaagtactgggattagaggcataagccaccaaaactcaaacatttgtaggccaaaactcaaacgtttttaggaagaaagagattaagaaggtgggctgccctgggacttactgattgtgtaagccagcattgttggcctagtgagtgttttagcactttcagaatctcagagcccttcacagatcctctgacaggagttgaccctttggcttgagtcagtctacactccacccatcgcaagctcagatagtagaaatttctcccgtaaaaagtttccataatgctacacgcaaacctctagggaacagtagctcctctcttgcctggaagtgcaggctactttctgaagctgccatgtcccacgtggccagtaagtgctgccatgtaaacttgtgcaatttcccagtctcaatacaaaatcaaagcttcaagctttgggagataaaatctgggtttcaagtttgataaaatatttttcacagtagttatctaggattgatcaattctgaaggctctaatttctgttcttcaagctaatttaacacaaggcagcctgaacaataccactcttggatgggcagcctaagaaacagattttcgcaggtgtttcctctgtgctgcaaacctaaatagccccctacattcaatcacatcgatgccagaggcaggaaaaaaactgcaacaaaagaagaaaagagagcaagctcagtaaagctgaggactgctcaagagccgttttgatgtagagatctctgtgaaagctcattaaatcctcagtgtgtgaggcagggcttagggaaaaatagaaatagggataataagacaccatatccatccatactgacatatttgcaaagcattcattagttaaaatcctccaaggaaactccatgtgactcctcagcatattaaggacctgaatcagctcttctggttaaaccacagtccagattaacagttacatactggagagatacagttagtttttgttttgttttatttttcataataccacgaacaaacctattgcaaaagcaattcaaagcatggttcccataatgaagaaccagttgggtcctcttcaggaggaaagatagccccatataccatgaatatctaatacatctgaataaatgataataagtcattagatgacgggtgtatatgagaaaagccaaacttactaagttaggtccccactgcttttattttctggaagacattcataaggaaagatgtatcttcatgcttcagccaaaacccagatgggaataagaccttctattatacaggattccccagagaaacagaaccaatagtgagggggtcaggggaagaggcagttgggagagagggagaaagagagagaggctttatcttaaggaactggctcattcaattttagagtttggcaagtccaaaatttgcagagtagcccagtagactggagacccaggaaatacttgatgttcagtccaaaggcactctgctggcaaaattccctcttcttcaggggaggtcttttttctcttaaggcttctaactgattggataaagcccacctagtgacctcattgtaatttaattacttctttaaagacattgtctccaaatacaatctcattctggggtgctaagggttacaacttcaacatatgaatttaaggggacacaatttcacccataaaatacctcagtgggttttattatgatctagatattagaaagagagagagagacagagacagagacatggggaggttgataaatagcagatgtatttctcaaagcagtgattctcaaagtataggcccaggcccagaagtatcagtatcatgtgagaattggttagaaatgcaaattctcagcccctaccccaaatctgctgagtctgtaagtggggcccaggaatttgtgaataaaccttccttcctggtggttccaatgaaggctaaagtttgaaaacaactctcttagaagttgctttattaaaagaatgacgccacctaagaagttttccaacaaacatgggtgtaaatatcgtttaatctgtgtgttttcattaaatatatcaagataagtcatattttataagtgagccttggatctattttactcttataaattgaaaacaaagccagagctccaaggataagcaccacaacactgcaaagaaacttggcctctgagtacagatttcacagggtaaaagcaaaactgtgagtacccaataaagctaatatatcaaataccagagcagtctaattgctgtctgtctggttggaagcctccattaccttatgtaattcccatgaatggcagactaaattataatggtggtacttaataaaattcattctaccctcttcttaaaaatgaaaaactataaatagaactactgagtggccacttttgagcaagaatgtaatttatattatgtcccaaaacaccttccacaccctcacaaaagtagcatttgcaaatacaccagcattaaacaagcctctcccccatgttctttgagaaactacagtacacaggagcaagaagttttaattcacctgtgagttatttccaagtcttgctggatggtcagatctgtgaacagtcatacacacaaccaacttatctggagaagtcagcttcatccgagcatatattctacttagtggtcaagtacatgtaactaaaggtaaagcctacatccaggaagcttacgtgacttgcgacttgcgtagcgtaggtttcagcacataagatgctagatcagattgcataatgcaacgagagctaacactcataattacttatgtaaattatatggcaagaatttcccaggcctttagggaaaaaatgtttatttgcggagcctaattttttatatcagctatcacgaaaaagattgtcaaggagcatatttgactattggacttggatctagatgtaccctctttgtgacattgtcacataatgacaacctggaggttaatacattaaggcagcctgtatgtgagtgaagcttcagaactacttgaaaattgcattatttaactgtgtccagatggaatagagaacattctcacactgagcaattataccagcaggccattgattgggaagttgatgtttgtctttttccacatgaacaagggcagtcccattgctggaagctagtgctctatcatttttaaataaacagaatgtttgtcattagcattttctaaagtattggagatatctgatctggatttgcttttatttcttcttgatcaaatgaaatctgcaaagcctccatatactcttgtgcaatcttaacacttacttaaatcatagaagctcatagaatcaaaagtatacttttcataagaatttttaaaccccaaaattccaaacaggcagaaataaatattacctagagttcttgcagatttttcaatgaatgccttcctaatcaaaagattataatttaaatattgattaatttatctagaattttagaagatttagagtaatatcaacccagctatgggaaatacaaaaataaatcattaaacaaacattttatgactcttgctatatctcaggaattatactgaagtttgacaaataaacgtctgaccacaaacaatcatagacccctgccctcaaggcttcacagttgggatataccctaagcaatatctatttcagttaagaacacattgggctgcaagtaacagaaaatcctctgtaaacagtagagtaggcaacttgggaattacttttttcacataacaagaagtcagaatgcaacctttggtttgcctactctatgatgccatcagggacctgtgttttttccttcttttcagctcctctatccttagtatgttggcctctgtttccatgattgtctcctcatggtgcaattgaagacagtggctgtcccaaccaagtttttcctctttaccagtaaagcaaagggtttctcagaaatcccactcagactttccttagatcttattaactggagagtcaaagggccacttttatctaaaagactaaatgagaactaatgggacaagatcatcatggctggcttttaagtacaagaatgacaggaaagtaatggtttaaaaaaattaatatggaaatgaaagaggagaaagggagtcagtaagaccaagtggagcattgctaatataattctgtcataagaacaagaaggtctaggtaatggatcctcttatgatggcttagtttgtaatacctttcatgaaagaaaaaacattatggacaggtggtcagatacttcctaaacaacagtcacaagttgcactgcactgtggtgactggtatgtctgtagctgcaggttaagcactatctcaagcatagaggtgacccttggggcaagatagtgcctctgagcttctaagggttacatgttataggtctgatttccaccttattctatacactctctgaaacttccaaagattctgctacataaatcaacctcatgcccaagttggtggcagcagaaatgaaccttaacttagcccaaaagggtttgaagagaaccaagaaataaagctagaaccagatccagcactatcattattctcatgctactttttaaagtcttgtccacattagtcagtgatagaaaactgatgttaggaacactgagcacctaagtgtcactcactctgatctctagttgctgcttctgataaatttcaccaattagcacaggcttagagtcagattatctgggtttgaataccagttctgctacttgatagtggtgtaatcttggggaagtgcttaaattctctgtatttttcaataaaatattgatcacaatagcacctacctcacagaattgtagtgagaaagaaagtgagttaatatttgaaagtccttgaaaagtgtgtggcacatgtcagccctcccggaatgtctgctatttttattactgcagccattattattctggtgtagaggtgaactaccctgctttggaggtcataaagaccttgattcaaatcctgccattatcacttactatccctatggccctggacaagttaattcatggttctgagcctcagtttatttatctgttaaaaagggataataatgcttgtttcatcaagctatggcaagtattaagatggcatgtgacagtgcttagcacaggccctgacaaataagtaatttgtattcttttttatcctccatgatacactcttttctctgggtttatcactagaactcccccgggatgatctgttacttatgactaatcatactctgtgtacttataccactaatattatttgagtgaaacaaacttaaattcagcatcaggaactaccttgaaaggaaaatagactcataagagtagtctcttccagttttgagaagaaaagatgccatcctacaagtatggtaaaggtcttgatgagggaggtaagaccatgacagtaccaccatgccttcgtctcacttccccaccacaactgagtgatctagccaccctctagagttgctaccaccatttgttgggaaggcatgaagtcaaagaaaagtttgagacctgggatagttgtccccatttgtcataccattgggatagctctgatcgtcacattcttagaaatgcaaatactaagctctgagaagatacagtcttctttgtgaatcacctccatcccaatttttgacctcacttttaggtgggatgtatctacagcacagagtctgtgactctgagatacatcaaagactatttggtggcccctcctgaaatcagaagaggatgtaatttgctgtggtttttgcaactctcttacgcacagtccaagcaaagaacattatagttttagagtggatgtggctgtccttactctggtatactcacaggagaaggacattgctgtcttctttccttccatctttgatcacatcactactgtattgtgacctcttcttcccagaagaacaacagttttatcctcttaatcttgttcaaactgccttctaacactgaccaccaccaaaagatgttgcttcgagaagaggctgaatggagaaccttaaatgcatggggaatattcctgagtctcattgaaatcagtttatcctgggtattacacttgaatttaaagcaaatgtatgcacaggcaatcctgggtgagctactctgaacaggagatggcagtagcagccaaggatttgggcagccctttctagtcctaacagaggggatttcctattggttcattgtcgattctggactgcagttttgcctcaccaaagccaaggtggctaaataatatgcccaagatcccagaccttgctgaatttcacaactattgaagaattagaaattgctcaaattgaaggctgaacgaccaagtgaacactgtggggagcttttactaagtctcactacagaggaagggaggaggcctccagaaaacaaacagatatgcccacttagattggcattagtgggtttattggaaggagcaaggatcggagatacagtgcacattcttactgagactttgagcaagtcatttagcgaggtgattcagcccatgctttcatgtggattcagggaataaagaagtcttcctcacaggctttacaaagggttcagtaagataacagccaggaaaactcattttgtaaactatgacatgctataaaaatacaagaaggacattttggttggttttaggtcatttctttgaatttgtcctggcgcctccaaatttcctagaccacatttttttctttccttttctttcttttttttttttttccaagtaatatggtcagaagctgtttgactatgagtctattatttctctgataattataatttcccggagagttatggcacacaaattactttgtaatagctctaaattctttgctttatcctgagtctacaattatgcacttatccatgctcctgtcatctgtggtactgatttatggaacctctgttctctgatctcctcatttcttacctctgcctcctttaaaactcaagaaatgtggcagcaaggtcaaatttctcatcgggccagcattacattctcaggtgtaatcattaccgtcttaataaagcaagcagttagttccacaatggtctgtttaatccactagataattgctaagccttaattatataacccagcatactgtcccttgctataattccagaaccaccatgttgtggtttgaaacatctattaatttggtgcaaatattaattaaaaatttatttctagccaagaatatgatggatcaagtgccatgtattaaaaaaggaaaatataattaatcttaaccaatttcacttggagcaaaaacaatgtaactggaaagttttctggtaactgccacacactcacagacttttttcaaaatttgaaaaaaggtatgtctaaattttaaagtattgcagtatcagtttggtattatggtagaggatttataagccatgcaactgcacaaaatttttgatatcgttaataaggcaaagatatattacttcgctttgttctgcttgtgacctagagtgaattttattcatagcaaaattagaccttactagcttcttatacctgaatggcctagaggtagagaaatttccagaacagccttattagagagtggggtgcatgacaagaccataatctaaagccagttttcagttttattatttactttgctgccttgatcatttttctgcactcatttggcttgaaggcatagacattccctgttgattatctcggcttggcagtgggtttctgctacacattttgattcctaatatggtagtaggagaggattttgtatgagttccagcgagtttctctgggcttgtggaatgcagcaaggaaagaatcctacagagatgaaaacatgaacatttgcattgattaaagagaaaaaggaaagaaagaaaaagtatcactctaaactgttttttttccttttcttactctgttcacttcacttctaataatgtcttacacttttgggggtgggaggaattaatgctgtgtgttcttttattgctcatatcttcatggccatttcaaaaattattttgaaatgctgagtgtgtttacagaggcagtgttaacaaaatagttttcatcatcatcaaggtttgaatccctgaagcaccctatccctctgttctacaaattagccacatgaagaaaactgagagaataagtttcatgttgctaaaagagaataataggctgatcatgtatattcacagggtacaaattacattgtcttaattttgcagcaatatgaactattactaaagaaataccttacttgcctatccatctattgattgtgttggagttcaatacagtttttctctcagggtcataaagccattcacagaatcaggggtgttcaagggcgagaattcagtcatgggttcttagtttgtgtttctggttgggccagtaaagccccttcctcatctctcttttccacttatcactacagatgcagacttaaaaccatggcttcaggctgttcaaagtcaaaaaaaaaaaaaaaaaaaaaacagaacgacaataataacaacaaaataaagcaggttatacaagctcgtatgcatctcagatgaagaactttcctctagtaataggctccttttccctaaatgtatttactgaaggcctctgtattttaataagctatattttcactggttttaaaacttcattattttcaccattattcacatccatttaatgtgttacttttctataattaagcattacatttggcagttatgccctcaaaactgactatatcaacatttaaggtcatgtatttgtaggcttattgggggctgtatcaaaaaaaagtcactaatgagagatcatctacaaatccaagaaattcagcatgctagtgtagatgtgaaagtgtggttttcataatgctccaaatattttctttttctggataacttattttaaggagcccttcagtaaacagttctgatttgacagcaataaccaaccacaaacacaattagtcagtatattagataagcccgagattggttgaagaataatgcaaacctcaaaataacaatgatgtaaatgacatagaaatttatttctctggaatatgaaataatgtaaagataagcagtccaaagctgacatggggtcttcatctatcacaaggaacctaagctgccgtctttctcttctgccgtcctcagcatatggctttcatgccatggacctgtgtggcacatgaggctccagacaatgaagagaaaaagggaaaaataagtgtgaacctatgtcctttactgaaagtcccacatagtacttccacttacatctcgatggtcatgaatctagtcttgaccacctgcaagggaagctgggaaatgtagtcttttattgtaggtggcaatgtgcccagctaaaaattagggtgctaaaactaagggaaggaggtgaaatgggtactgaaggaggcaacacctagttttggtcatggtcaggttctctggctccttgacttgctatcattgtcagatcatacagtgacttagctttccatgcatattcatatttatttatataaatcaaaccttttgtgttttactaacataaatataaatatttgaaacaaacataaatatatgtgtttacatagaaatatatatgtaattgtagaaattttgaaatgtagataattagaaaaaagtgctaagcaatcataaaactcaccacccagaaataagtgcagttaattttatggtacatttttccaggttgattttcatatacacatgtgtatctatatacttctcttaatacaattgaaacatacaaagcacatcatttttaacctcttttttttttagcaatgatatattgaggcgtccttctgcaccaatattcttttcaacattgttttaaattgctatagatcatttcatgatatcattccacaatttaaccaacgtcctattgttggcatggcgagtctgtacaggtctgaaatgttacagtagatagctagtcagacatgaacagggcagtagaaagtttattaaaaagctttagagcagaaagaagtaaagtacacttggaagagggccacacaggtgacttgagagatcaagtccacagtttgaccttttgatttggggttttatacactggcatgcttcctgggtcttgtgtcccttctgccatgattcttcccttggggtgggctgtccgcatgcacagtggcccgccagtgcttaggaggagccagccacatgcagagtgtgtttactggagttgtatgcatgcttacttggggcactcttcccttaccagtcaagtgtccctataaggtaatataccagttaaactccaccatcttgcctcttagtttgcatgcttcagcccattcgcccaactcctgagatcttatcaggaagctgatcactagtctcaggtttttctatgtattgggagactactttccctggggctggctgcaaccaattattattttagagagtcagttaataattgcctgaccatcatctgatggttgcctgacattcctgggtgggggacgggacgatggtctctcctgtcctgctcatgtctgaccagccacctactgtaacactattgttaatcattttgagtttttctgtattataaaccacactgcaattaacatctttgttactaaatctttgttcatatccacaattacttttagaagatagtttttctgatcaaataatatgcatatcttaaagctttgatatgccaaattcctctccagaaaaattaacgttttacattgttaccctactatctgagtatatgccaatacttttgctcagcaataaacatcatataatttttttaaattctttaccgattcaatagaccaaaacatcagcctcaggttaactatgcctttgatcactactgaagtggaacatttcccctgcctttatatttagccttttttattattgtggaaagatatgagaggagagaaagaagctcatgggctcaaatttggaaacactaacttcagactgaaaggaaaaagcctctggttctgaagataagtcatgtatgctaactcagaatggcaacataaaaggagaggttatccttccatttcaagaggcagtcaatgaagttgtcacctgacctcttccaataaggtacccagatattttcctcctttgaagaaagaagccaccatgatcttggctcgcattgtgttgagtttgaaggacactgcttcatatgtgatttatgggttttctcccagcacagtttttcccttgacttgactgtcaagctcttgtctctgtagagtggcaagtgaaaatattccaaggggctcaaatttaattcaagtagtcaataaaccacaagatctgtctgctcaactattttcataccaaataggatactccccatctaaatgtgtaactgagctgaaaacaactttgtgcctttaaatatctgatgttgtgtcatgtttcactacatttaaagccaatacagtaagtagccagatcacaatatgccaaatagctgtttgtagcatttcctgatatttgctaagtagagaatttcaaataccctaggcacattctatttgtgaatgggatgatatattttcttgcttctgtgttgtataaaatactctggagtagttaattctttgcaagtttttaaacctttcctcatggtcaaaagctaaatcataaatcaagaattaatgtaagagaaagtttgaatactctctcttaattcccagttagattatcaggacaaaacttcaggtaattgcatgcctaaatagtaaggtacaaataaaaacaggaagaaaaaaataatcctctaacagcaaaatcaaaaattaaatattgaaccataactctcttttcctctataagcctaacagttcttttccatatatgtaaggaaggcaaatatgcattttttgtttacaatttaggctgggactgctacagtgactcacctggagtacaccccaatgaaaatttagtgggcaataacacagaacaccatgcccataaaattataaaacattattggggtttgcccatcctccaattgtcttgctgaagtctatttttcttcctctataggagaagctatttagagtcaagcatcattaaatcaaaatgcaaaggaaggagaaattgaatgtgggttaattgcattctgaatgcaactgaaccgcagttggtacaaattactggcctataagaatgcattgtgcctaccaggaagacaagtattttggtgaagccggagtatgggtgtgtaccaggaagtggcagcagatgaggattctgagtgtgtttgtgtgtgtgtatgtgtgtgtgttggcaggtggggacacattagatccttgtatgttgtactaagcagttggtactttgtcctgaagcatagctctcccaggagaattgcagctactgtccaggaggatcccagtctatgcaatttggcacactctgtgtaatcttctctcctttatcgcacaaagaagtcctatacctgcaatcttgctagagaagtaaaacctgtattccttatcagtagatctacagggtaataaagggaacactatgatgggagcagctgtaatggaattgaagacctctttcttcttggcatcaactgcctgaagataaaaggaatacaattaatataaataaagggcagaaaggcactgactctaaggcaatgaaattttgtaataggagtggaaagaaagcagagatgaatgagggctacaagaatcacaacaggctcctgggaggaggtgatacttgctgtccctgccagatgtaaagcataattttcagggtcctcaagaattaagtggcaataggactcaaaaaaccatttctccaaaaggaatatagtgatgtgcaaaacagacaaatctctggtctcatggctcaccacagaaaacacaggtacttgtatttttttgcagggccttgttaggttacctgtacccaaaggatttaggtaactcttcctttatatattttccattttatttatttatttatatagaattatttgcttgcttatttacaatttgtttgtttgtttaaattataaaagtaatatgtgtttatgacagagaagtaaaaacagaccagaagtataaagtttctctctcccctgccctacccagtccttccattaagagataaccaatgttaaagtgttgcatgtgcatcctttcagaaatttttcatacatgtgcaagcatagatttatgttatatataaatattatcacactattttactttttcatgtaactgctgtagtgatagcaccataatgctggtataaaagggactccaccagggcaatctggttggaaagatggtcttgaagctccattgcaaaacacttatgtaaaatagaatatcaattgttcatatcaaagaaaggaatgtgctggaaagtggagacagtaaagccccagcaagtaattccttggttttaccacttaaacatttttgtatgatagcacataaatagctgcctacgattccctcgagtgaatggaccataatttattgatcattccccaacagtagacatgcagattatatgtagagtttttgccttcataaacaatactattttgaatccctttgtacaaagcttatacttaggcaagggaacctataacataattcctataagcagaattcctgactgaaagggaatatgcattttaaatgttaatagatgttgccaaaattaagccaattttccagtttgcagttaatgggagaggatgttgttttcttaaggctttccttgtagaaagaaagtgctgagtaatgcggccacagaactagttctgctagcttaagtttcaaagtctacctacccatttgcaactaggatccaagccaggctttacatgttcagctttctctgagcttttgataacgaagctgtttacattagtaatccagctaaactgtggagtggcatagtcccatttacattgagaatcatttttgttttagcttgtgggagtgtaaattactattaaaggagttccatttcaaatccaaagaacattctattgagaagaaaactaataagagagagggaaccacgaaggccaagtctgagctgctgacagcaatgcagatagaaagaaacaaggcaaggcagagaaacaagttcagggaattgaataagaaacggtgtcacagtcacatgatcacagtcatatgatcatgaaacaaaaggtatggtagatatttgcctggaagtcccttaggaaatgatggcagcaagaccagacggcaaaaacaaaaagttgaacatctttgccattttcatttcatgtccaaatgcttcttagaaacatacaaccttattggcattaacattttgacattttatgtatagatcctcttctaaatagagtttaggtttatattcatattattgtagtaaaataacagatgatcactattttttcaaagattaaaaaatatgactcagaaaaatgcgagcattggtaatttagttttgggctttgtcaaatatcttttaaaaaactcagctaataatacactaaggcttctcatacataatttgtattgttgattaaaacctaagaatggaaagaaaaggctaagtctaatttttttgctaaaagaatgagtaaaaagtaatcagccatgttaatatttcaaacagcaaactatttgaaatgcatttctgctttgaaaggaaaatttgagatgaacaagttctattatacactattgataaagaaagaagatataaaaggtacaatatactcttaaaaatgattgcactttcaaggaaacataaaagaatagcttcttttttggccagtaagaaaactgaagccctgtgtagtcataaatagcaaaaatacaacgaaaatcctaatatgtgtgtgtgtgtgttttctcttcttcaagattcctataatatctaacaatgatatatttgtaacttactctgaattgcaaagcatgtatcaattgtcagttatcaaaagtgtctctgaaaatttgaggtagcaaaaaacaaagaaacaatgaacatgttcatttagtcttccctgcttttacaatttgtcattgaaacctgtgtcttcctcctaatcatattttcttaaattgtacttttatttaggatttggtgattgagagtttgcgttttctgtttgctagttgattgcttaggtggccaggtggttggtttctcttcatccaattgcatacaatgtatttctaaaaggatttttaaggaaatgtggaatatcatgtagtaatatgccctgttgctcattcctcctaaatctctctcttatctccacctctgcctcctttcccgcaacctgccttggtttaggccctcaccacttctctactgatgacaacagcctctcaaagcccagcccccttggctcctgccttgacgttactaccaatggcctcatcctaaagcaaaaatctcattatgcctctctcctgtttaaaatatttaattggttttaattagcttctcactaccttcatgatgaaattcgaattccttagaatgctctgcaagccctttcatgacaaggtccaggcctgcctctccaaatggcatcacttgtaaatggcatcatttaccctatgctccagcagtaataacactatgcattcacacaggggaggttttgtgggtgtcagtgctctccctgaactgtcatcatagtatccccccactcccaccccccacttcaacctggagaacctctaaagttgtgcttttctgtttttcttttgcatatcatgtcctgagaatcttgttaaaaagactttacttctgtgggcctaagatggggcccgatgttctgcatttctaatcagttcccaggcaatgctgggaacacatattgaagacaaagctgaaaaaccttactctaccgttactccctctgtgaaaaactctcctgcaaagctgatctacacaaagcgtcctctttctaatgtttatgacttgtatatagaacatgtacaggtcttcttagatgtctcatgtcttatttaattacttggttataggtctgtccctgtaatcacttgtccatcatcaagggctggaacagtgactgctgctccttgtagtcccagcgctaacatttggtccagatgtataggaatttcctagaagtattttgcatggaaattagcgaaaatttttcacttggtgcccgaatgatcatttcataaggtgttgttaaaaatgtccactggatggaaggttacactaactttttagctctcaaattcgtggtttttctttatgttattgacaatctctccaatggggttttggttagggggaggcttaaaagtaattgatttatgattcttttaaccaacatgtaagtcaagaggctggccaagagtttgaagagcccgaacctgttagacagtaaaccaattatctttgtgaccttgtgggtgacttcaccacccccactgcatagcacagccctgcctgtttccaaaacacctggccttgcacaaaagaatgaagaaagagccaaggcacagagaatattctccagcagagagtttgggcaagaagtcttaaagatgtctgagtagagagacaattagtggaaacaaacatctgtccaaggtctctcccatcatgtcatgaacttgacaagaaaggccagcagtaactcttccaaccgtggtaaccaatggccctgaaatgtgttcaatatcaggtatatcagagcccgagagataagagtggttttcaatgctgtatgcacgttagaatcacctgggaagtgatatttgtaaaatatgaacacctgaggccccaccccagaacagctaattcagaatttctgggggaatggccaaggggtcagtagattttaaaactcaggtgattatactgtgaagccagagttaacaaccactgatagagggtagtaccttcttcccctataggtgcctcagaagtgaacatctaacttcagcttacacatcccactaattgaccactgagtcttacttattttaggcaaaacgaaaccaatagaaagttttgccttttctctatgtagaagggactaatgattctataagaatttttaaatttctactcacatttcccatcacacagttgttgagaaattggtaagttgagaaaaaatgtgaggtgtagaaagaaggaaattgaattcatttagaaaagagaattccaaatgagcttaatttccttttttctaaatcttaataatctaccttgcttttcttctccttccactgcaccctttctccatgaattcatcagtcatagtggtaagctcacagtatccggcagcaggtcaggtgggatcacactggctaacaaaggatctgagggtacaatgcagaagttgccagataatgggattcaattacatttctaagcatagacttctccagtgttggctgttacactgcccaatgtggaaaagcactgctttatctacatggcaagtgcttcatacattttagttgaatctgactcggagtacctcaatttttttaatgaaatatttgaggtctacaatagtaagtataaataataatataatgaagactcttgtacctatcacactaaagaaataaaacctaacatctataatcaaaatagcctatgtcctctttatctcctttctctcattctctcctcagaggtaactgttaccttgaatttatgattcccaaccctgttttctcattttgtttgtcattccaatgtatgtttttatgacacacacagttttggttttgtatgttttcagccatataaatggcactttactgtatgtattttgtgcattttcaagctttatataaattgtatcatatatccttctgcaacttgactccatatttcattcttgggatgtatctgtgttgattaaagtaacgttgttactttttattgctgtataacatgccatggtaggtaaataccccagttggtcagctaatggatttttgaattgtttctaatctcttgctgtcacagacaatacaacatagctccttgtgcaaatgtgggtgagtatttctagatatttacataagagtgggattgctggaatgtagggtatgcacaatttttaaatttcctagatgtattaaataacaccccaaccagaagtgtgtgagctttcctattgctcatatccttgccatgttggcactgttagacttttaaatgttcagccaattttaactggtgagttttcccttaaaaaccctgaagagggcagcatatcctggtaattgctgcatcttatacctgcattccagtttatgggtccctcccttctttactggttgaaatcctttgacctcagttactcttcaacccactctctcacctcagtcagctctgggcagtatcttagaaggacagacaatataacactatctcaaagctgaaagttacctccagctttttcattccacattcctggcacacttctgtcctctgacaaggaggaggtagggaaacagaaacaagtcagtctggaattaaaacactttttccagttcaaagtagcacaagagagatatgatgtgagtagagagtagtcttccaccattctaaagcagtggtttgtaatctaaatagaagggcattgcacactatcaaaaactatgcttatgtaaatgggagaaatactgagaagtaggaaaaagtattgcaaagtggtagtagcattgtttttcttctagaataaaagatatttactcctttgccttctcagttacattgttcctggttccctaaggaaaaaaaaagtgttcagcttcagaacatctcctagaatttctctcgtttaataccaagctaaagtcctgccacttccagagttccacagtgggaatgcaaccttcacaaagatgctttcctttaaacaaagcagatgtgaaattgagccatgcttaaagatttgacatggctgctttaggagggaatttattgttagtactttcaaagtagacctaaaaacaccactctgctttttttattcctgaactggattttaagatcgtattgctttaaaataaatgaatgaataaataataacattttattttggggaggaggaagtagaaaaataaatatgaattgttttggaattgattgctattttgagttattaaattgttttcccatccattgtggtagatgaaacttcctccaaatgagatctgctgctttttcattactgtcttgaactcttttatatgctggtgtgttttataaatttctaaggtgcgccatttagagagtctgtgcttctgaactgtttgaccatagtttccttgttcaaggaacacctcactggagttcaaaggtcacactttggaaaaatgctagcatagctattctaaaggtggctacaccatcattactaaccattctggccagaaattcacaagacccaattatatgtcatcttgactgaaattctttcatgatagaatatctgtcttgacatgttggttggtatacatattgctcttgcattgaatgctgttatggagacatttgaagccagtctaatttttgctttatccaatgtgacactttttttgtttttttgttttctgttttttttttttattgttggtggtggtgggtgtttttgtttgtttgtttgttttctcaaattcccaaggaatgtctttatacttgaattgtaagtattcaatcagggctgtgttaagcattctgttaccagtatttcctagaacatggtatgttctttcaatctataaatgtggttattctttctctttagtgaaatttccttgtgtggtatttgtgaatacttttcctgttccatttattgaaacttctccttcagggacatcaatttcctcatgttaagtgcttttgaactccaatctgtcaccttctaattcctttggttcccttgtatttacaagccattcctcgaggccggtaattttatttgcagccatgtttattttgttccttgctctgtcaccttttaaaaattcactctataatattgtttttgtactcagcctccttagttctgtaaccttcctggggttctgtcaactcatctttgagctcttgtttttctgagttcatgttctcattaacttgattcatagtacaaagcacttctgaggaattttgttttgttctttggactatgttttctttaaaagagggagtttcatctttcttttgcatgctatgttcctttcttttaaggttgattggttttgtttattttcatttgggagcattgccttagcatgtttggatgtttgtcactgatttcccccatcttactcatacctgaacgctttatctggatcttctctgttctatctagtataggtgacttattgactcaatttccatagactctaacttttttccccaaagctatggttaaagaacttgattttggataccatccacttaactgcagcctaaggaaatggtgcagggagtagagagggaagggaaagctctgctgaagctgtgtgacatctgagttagaactcctgggctctgcacttttggttgctcgtgctctctctctctctctctctgggatttgttagatactttgaactacattttaatccctctctttaatcagaatacatatccatcctgaaggggaacactctaggattttttaaaatcattcagcaaatttttattgagcccctctcctttgcaaggcacattctaatctaggtgctggaagtaagctgtgtgaacaaatgagacgattcccctttctaatgagtttatatgcaatgtggtatctttaccgatacatgctctgtcagaaagaagcagcccacttctgtccaatagccaatccactacccttcagacaaaaatgagaaaaataaggatagtcatttagttagtttctctccagatctgaagactatagtgaggtcttgagagttcagtaattcaccagtaaggttccaggggcaggaagggagttcagggttagaagctacactgtaccactccaagatctgttcttttgtgagccagcattgtatgtgtgtgtgtctgtgcgcccacacatgtgtgcacacgtgcatgcatgctttgttttgttttaatgtccatattattaggttacagtcttttccttatttcattgctgacttattactagaaaggagggagctagtggttttcattgttggtatcccttgtttttagttctgagagaaagagaaagagagagactctataatctgctttcattctatcacctgagcctggaggcctcaactagttcttttaactctaattaagccttagagtctgcaagtataagacagctgtgaagtagctctgccctcagaattttgtaagtactttaagacatagacaaacacacatacacacaacaaaacaaaacaaaaacataaagctgaggtggtttggttgggttccttgccagcttagcctcttactcttggctaaaaaacatttcaaggacttaaactgtggaatagttctaagaaattgcttagtcttatccctggacactgcaaaatggattgcctcagatctaagaaacccatttatcagaaaaattcttcaatttcatgatatgttatggtcgagatgttattgcacaatcccacagaaatctagtccctctcctaaatatgccgaacacctatacagatggaggcaagcagagagaggaaggtgagagtgaacacttgttcctgaaatctcccaagataccggctctgggttagcattagaaggcctaagcacctggatctattaacctaaatagaaaaaagaaataaccaaatacttgttgaaataaccaacaagtatttggttatttcttttttctatttaggttaatagatggagcattacctaaaaatgagatgaagcatcacctacaaatgtccctcaaacaagtcatacttagttcagattataaagagagtatttgataaatgctgtacgtataagggaattcgaatggcactagcttacagcttcttgtgtcactaccatgcctctaatgcaatttcccccatctagaaatgtaaccctcagccagttgccttgaaagctggttaccgtggagatgattatcagtattatgatgacctatttagaagaatttctgcatcaccagaaaacaaataaccacagagagagcctttcaaatgaatcatgctctttctctgaaagtgcctttacaaacaaatgccatggatgtattgtgtttgtgtgctgtgtgtggatttgttcattatttgtatttgcaaaggttttagtgaaattccagttgtctttaggcatgccaagagtagagagggtagtacaaacaacaggcataagcatatagacatctgtcctcttcctacaatttgaaatgcatggccatggctgtattgatttctcagcaatgttaacatttctttcatttgtacagtttttcttgctcatccactgctttttgaggctttttaaggactgctggaatgtggttggcaggtggttggtaaagactggtttttacaaactgattggccattaatagttcctaaacacactatgactacttgatgactattttgattttctcaaaattatgtcatgaaatattctcttaacttctgtttggtctcccatttttctataaaatagttttgtgtgtgattgtatgcagacctagtgttttgttttttttttaagtttttaaatttgttatccattaatcattgccctgctccttataggaaagactgattttcagctgctgccctttttggttttgttttgcttttgatttttcttcttctttttttttttttttttttgagacatttaatttgcacttgtaaaaatttcagtgataaaaattaaacctttattatgttcatagaagcagcaaataacaatataagccaaatgttaccccaaagaggtcaaacagatctaatattttccttccagtctatgaaggtcgtgtattatggcatttttatatttgttcttattgtattttcaggcacactcctttttctactctcatccttccacccactgtcacttcttctaaggtaatggcaggaatgttcatattttctgctgttatttcatatcatctagcaaagtgctggataatcgatgtttaataaacctgacccctcatataacctcaaaagtttcaaaagttctttaaccagataaactccatttttgtctgttcatgttcacaatggccttccagtctaggaatctccattttttaaaccatgtacaggcagtctgttttccacagaacattttgggtttaagtcaattaactaattttggccccattttcaatttctataccatagacttgtccttatgcccaaaatcacattgctctgaactgagggcaaatatcaaattcatattaatcacctcactaatattcttaggctggtctgaatgctatgtaaatcccaataaaaatcttagtgtgaaaaaattttcttcaactaaatataactccttctctttcaatattttttagaagtacattgacattttaattaacaagttcttacttaaattttaactccaaagagtctagcacaatatatttaagtagtcaactacacagtcagtgtaaaatgttgacttctgtccatctaacacagttgtataggaacggttttacctgcaaagcactaataatacttattggcgtatggcctttgactcatttataccatttcctaaaagaggcatgaaggacacagagagcttttccatgtaactcagagcccataaatggtagctcctcttagaatattatgtctactctcttattcaattattcaataaagattgttaactctccctctaaagtggccttcaaattaagtaaaaagttgtgagttgtttgaatcatattcacatccagcactgtttgattaaaaaaaaaaaaaatagcctttctgaaaccagacttggagtcctaatcacccagaatagttccagacaagattcagaatcagaactctgactctgcccaacaattccactaaattaattcactctgcactctcttgaatggatttggaaggcaaatcatgagcttgctttagagtatttcctctttgtctaatcttcactcctagaaatgatagtgcttagcatttagcacttgcaatccttcccaccctgaagctaaactgggaagaatgagagcagagtgttctaaccttattcataccacaggcaattattcaaggaaaaaaaaaacatatttcacagcctttaattagataaacttgctttgtgaatagaacacaatcttcagaagaatgatgtggaataacttttctccagaaacattccatggctttattccctcttctctaagaaaattcatgtccttaactgctagctatccaaagcaaatgattaacaccccatgtgtcttgcaatattgtatgatagcgataatctaatattgataacctgcagaactgctcactccaggaagctatcaaaaaaatgataagccaagtgaaaaaagtacagccacacaacagaatgttaatatttatgtttctaataacattttttaaaaggtttctaattaatgtaaatatattatgatatggtttggctgtgtccccacctaaaatctcatcttgaattccagtccccataatccccacatgtcaagggtgggaccaggtgaaggtaattgaatcattgggggagtttcccccatgctgtcctcatgacagtgagtgagtctcaagatatctgacggttttataagcatctggcatttcccctgcttacaattctccttcctgccaccgtgtgaagaaggacgtatttgcttccccttctgccatgattgtaagtttcctgaggcctccctaagccatgctgaactgtcaattaaacttctttcctttataaattacccagtctcaggtatgtcttcattagcagtgtgaaaacagactaatacatattaactcactacagttattccagctaataatttttgtcatgttctatccaatctggaacagtacctgttagggtattcctgatgagaagctcagggagggcactgctggataaatcagctgtttacaagtttcattcaccattatgttagtgttcagtgagtaaattatgccatttaagatttccagggacaattcttatgggcctgtgcccaagaagtccccataaggtttagcgccctcactccaacatgctaagagaataaaccaaaaaccatgtattcattaaagaagtgatcattgaggacccactgtgtgccatcaggttctcagctagtgctaaagatatggtgggaagaaaacaataaaaacggaaatggttcctgtcttttgaggcttagagattaggagggaaaaagacatttataagtcacacaaatagaaagaatgaattggcattttataagaattatgaaagtaaactctgctttagaatgaggagtcaaaggagtttccgtgaataaatgatgttggagctgagcttaattgaagaggtatgggaaagggacatgaggaggaggcatcccaggcatgaggcatgaggagtggaacacattcaaagggctaaaaggtcactgaggctggagtggaggcagcaagtgggagcgtcctgagagaagaaactggagaggtagagcaggagccagatcattcaggctctatttgtctagctcagacatgtctgcatttaacttatggtataattactggattaaaaacaatataaggagttatacaatgttttaatccttctttacacaatgtgtataatctaagttgataatgcttatgaatgttgaattacaatgaatgttcaaagtcacaggacttctgtgataactaatattaactgtgtgactgtggagtgataacttttagtcttaagtacctcatctgtaaaatggaggtcatagtacctacctctcagggtagccactaagtcttcatagataaattggaaagactggatggtacagtgcctggtcaaagccttttaaaaattagaagaaatatgcagcacagcccttatacctgggaaagaatgaaccctatcctggaacccagagtttagagggccctattctggttctcgcctagctacactctcaaagggtggagagtcttcaagtccaacagaatacactcacctggaggccacactgaactctgtattctagatgatgctctggatacctgagaccccaaagtttcctaccaaaatgatcccatgatgattcacgaggcctttaagtgtcttttccccaagcatgcaccatctgaagacagatgcataccccatgtctgaggggtggctagggagcagtggtgaatagcacttgtacatacaggcagagtgtcctcaaatgtatatgtgaaacttcttgcaatgcacgttgtagcttagtgtgagaagaggagggggacgggacagggccagaaataaactttacccacactaccaggttctattgtgggaccacagtctgagaattataaatgtaaagctggattctctggtcattattaacatttatttgtcaagatatgagaacagaaaatacctattgccttagtccacttgcattgctataaaggaatacctgaggctgggtaatttataaagaaaagtggtttatttggctcatggttctataggctggacaagaagcatagtgccagcatctgcttctgctgaggacctcaggaagcttccaattgtagtagaagaaagggagcaggaatcacacaacaagagaaggtgcaagagagagagtgggaggaaagtgccaggctctttttaaaactcaaatttcttgggaactgatagagcaagaactcactcattaccataggatgacaccaagtcattcatgagggatccacccccatgaccccatgaccaaaacacctcccactgggacccacctccagcattggggattaaatttcaatatgaaatttggaggggacaaatatccaaactatatcacatatgttaacagttggattttttgtttttgtttttgaaacggagtctcgctctgttgcccaggctggagtgcagtggtgtgatcttggctcactgcaacctccacctcctaggttcaagcgattctcctgcctcagcctcccacatagctggaactacaggcaccagccaccacgcctggcaaatttttgtatttttattagagagatggggtttcaccatgttgaccaggctggtcttgaacttctggcctcaagtgatacgcccgtctcggcctcccaaactgtggggattacagaccactatgcccagcctggatttttattatgatttttttgtttgtttgtttttgttttttgagctggagtctcactctgtcacccaggatggagtgcagtgacgcgatctcggctcactgcaagctccgcctcccgggttcacgccattctcctgcctcagcctcccgagtagctgggactacaggcacccaccaccacgccctgctaatttttttgtacttttagtagagacggggtttcaccgtgttagccaggatggtcttcatctcctgacctcgtggatttttaatttataacttttaacaattagacatatggcacatggacttggatttgtagtgttaatctgggcaagtaaaacagggaggtctgagcctgtgatttacaaaagtctacatatcagagaattccatttcatttaaaccatcttaagatatatggatttcctatttatgaaaatcacattaggttaatcacgaatttccattatgcacaggaagactagagaaagccaagggaaatagtaagttcaaaggaagacagtccctctagtgacctctttccctctctacctaagcataccactatccaaatatcactgaatgtatgtcttatgaaactgtatatctctatgtagaggtggaaggagaaaaaaacatgaaagatgatgtttagaattaacaaaacgttagttctctagctgtaaaacttgtttgtactccctgactataaagcctcaaattcaaattgagcatttccagctgagtgaaaggtgcctgcctgctctgagttcctgtcacagttattgctgtacataagtcatttggcaagaaaacacacacggtcttaggctatctttcctactacaaaaaatatggactaatttaaatataacttttttaggaattgatgtcttctcttcccaactgaactataagttctttgaagaacaaattggaatctgctgttttctgtatgccttcattctcttgcagcccctaagagttgcttaggaaagccgggcatggtggctcatgcctgtaatcccaggactttgggaggctgaggcaggaggatcacttgagttcaagagtttaagaccagcctaggcaacatagcaagatctcatctgtactaaaaatcaaaagaattagccaggtgttgtggtgtgcacctgtagtcccagctacttgggaggctgaggtgggaggatcacttgagcccggaggttgaggcagcagtgagccatgattgtgccactgcactccagcctgggcaacagagcaagactcttgtctcaagactaaacaaaacaacaacaacaaaagagacgctcagtaggtatttatacttaactggttcattcaggtatctagcaaatattgactggattcccaccatgtgccaggctctgtgtcaagcatggggatacagagttgaacaagacactggctgaaagataaatacctggcacataacagacactcagtgagtgagtgaataaatgaatgaatgaattctgtaccacaaagttaagagaaaatatcaagaaaactggaatcaccatttaagttgtcttacatccgaagttatcaaggtgaaagatgtcagcctggcagaatgcccacaattctagaaaatctggggaaaacaagacagtcctagcatttgttcctctggatcatctccatgactatttagtatgtggtgctagaatcttgcaaagaattaaaacttttcatagaaaccaaattttctatataagaaatttaactaatacccccactctcacttctcagagacagagcagtgtatgtcaagaaatttcttttgtcaaggaaatcagtgtatacaaaatattattgtattttttactgagatctgaaatacgaatgtgtggtgattgactttaatcacaaatttgcttcataaaagtctgtggaatcagcacagaattatattactccatgtcattttcctatatatggtataatattaaagccatagtttattttattttattttattatttatttatttatttatttatttatttatttatttattgagatggagtttcactcttgttgcccaggctggagttggagtgcaatggcacaatcttggctcactgcaacctctgcctcctgggttcaagcgattattctgcctcagcctcccaagtagctgggattacaggcatgtgccaccacacctagctaattttgtatttttagtacagacggggtttcaccatgttggtcaggctggtctcgaactcctgacctcaggtgatccccctgcctcggcatcccaaagtgctgggattacaggcatgagccaccatgactggcccttgagccaccatgcctggccccatagtttatttttattttctccttctaatattgtaagaaaactagattaccaaggtagaagttgatctctccctcaaagctatttatctccttgatgtgcagtatgcaaactgattttaaacagaattttgcagctttatgaaagagaatcacatttggtcatcaatgaattaaaatgaaatatctctctggaaggataaggaaaatcaacattcaaatataaaaatttaataataaaccaactaacatgttcaaggtttctctttttaaaaaagggcctacattattaatactataaaatttcaaaccagatattatagatcttaaaaaaattgtcattttttctttttttttttaattattatactttaagttctagggtacatgtgcacaacctgcaggtttgttacatatgtatacatgtgccatgttggtttgctgcacccattaactcgtcatttacattaggtatttttcctaatgctatccctccccctgccccccaaccccacaagaggccccggtgtgtgatgttccccttcctgtgtccgtgtgttctcattgttcaattcccacctatgagtgagaacatgcggtttttggttttctgtccttgaacattatcactttttctaatgggagaaaacaactgcattgttcatcctcttccaagtccataggctcaacaaagtcacttaaggttaggaagggggtagcacagggaaagaaactcccttaaaaaaataagtttcttttcttttttttccagagggagtcttgttctgtcacccaggctggagtgcagtggcacaatctcagctcactgcaacctccacctcccaggttcaagcaattctcctgggccagcctcctgagtagctgggattacaggcgtgtacaaccacacccggctaatttttgtattcttagtagagacagagtttcaccatgttggccaggctggtttcgaactcttgacctcatgatccgcccatctcggcctcccaaagtgctgggattacaggtgtgagccaccatgcccagccctattttcttttttaagcagagaaagaagcactgagacgttttcagctaagaaaacttagaagcattacccaaccccctaggaaatatactcaaaaactttgaaaagtactagaaatagttcaaaatgaggaaatgagagtgatttttttcactttttagaagcatttccaggtctccctcagttatcctaagattatctcagtccatacactgcctaattcttagatggcagaatgtttaaaaaacatgcagatatcttaaagcaagtgcgttcaaggaatagagagttaatgaaagtaaaattgattctggccaaaccaattgtagaactgagtgagcctgagtaagccactgaagaccaggaacccgtgtagtcatatgacgtataagataccctctattctcacattgttttcattttgtactcatgttaaattgtctggggactctctctatgtggataagaagtagcattaatttgtcatattacatgtacatttattaaaaatcctagcagcaatgttaccaagtaacagtgttactgatattatttcatcaattagaaatgctgaattatttttaaagaaaaatctcgctagtgacctttcatctgacgtaaataagaggcttaacctatatctcaaaaaaaaaatcaagtcaaatttaccacttgtaattttgtttgcattactgaatcatttgacttgtttttgtctctgtgtttgttagtcagctcatacaaacagtttatcctcagtcattccaccaagctctttgcagtcatctagaaagaatcagacattattactaccattcttgtttacccttcctgaaagattttccaaagaaaaggagaaacaggcttgaattatacatgaagaatttcaccataaaatctgaacaaaaaacatccagattatacaaacgtattgtacttgcccctctactaagggtggtgctccaaccctcacactgatatgtcaactgcccataaccatgccccacctgagaattctttctttgccatatccttgttttccagcttttgtatatgcatccctacatttttagtcaagaagctggcagtcacatgctgtccatttgccaatgttggaaatgactgttggaattcaatggtttcccccaccactaagaaaaatgcttttcatttaattcataataacaacagtttgcatttatgttttttatctgtttcaaagcactcctctgccaccattaatgaactaaatcagcctttgctattttatgatctgtctcattaaaatggagttgattttctctgtggtagtcacttgcataatgttgttttcttctagcaaaccctgcacttaactaatgtaaattcatttttaaattgtgtgtttacacagaaaattttccccaaatatatttttaatgctgcatcctttcaacagcattacagggagtattttattctatatagacattttaaactataaagacacttaaatgctttaatgtagtcttctctaagtacttgtaaattatttataaagaccccctcaagtaaatgtgttgaaactgccagtggtagaaacagaaattgtttgctctgtgagccctattaatacttaattatttgtatagtattaaatgattggcttactgatgaactaaggcttaataagtgaacaagaaaacttgcagttggcaaagaaactctgaatgttaaatttattatggtttaactctgtctctgttactactggaccacttatacaagtgcctgatggctcattcctagggatttgatctaatgtgggaggaagatgtctctctgcaaataagtgcaggcacacacaagtttaggcagagatggtgttctagtgactctaggttgagaaactataaatattggttggttgccgcccaccttccatcctgccttcttttaggtagagacttctggcttctgcttgaggaaccaccctatcctactctagccttgtgcttagaataaaattgagcttacccccaattccaaaggtaggtctacctggccttcctaatgatttaaagatagacacataactcaacctagctcatcacattcttttagacacagggattaatatagaataagcatttcatctatgttagtccaatcagaatacacttaggacttgccctgggaattctggatgtagactgtcttttcccttgggtggtatagtgtgatgatataagacttgtagctggtgcagtcatttgcatccataagaggaaagcctagaatggctggaaagcaatggctgggaccttgctgatactgttggatttatgttagatagggaacagaccaaactgctgtaacaaagagattctaaaatacagggactgaaaaagataaaatttcctttttagattctttttttgtcttttgttttccttttagtggagaatggggtcttgctatattgcccaggcagatctcgaacttctgggctcaagctatcctcccacctctgcctccctaagagctgggactacaggagtgagccactgcaccctgctaaactttttattttccttacgtctctgtctatctacctcataactatatggctggccaagagtgataggcagtttggggtcatggggtcagttagggacccaggatcttcctatcttgttgttctgctgtcctgctagggtattgtcttcatgttgcaaagccagtgatgcttcaccaccctcccatcacagccttgtttcagttacaagaaaaaagaaaggaatagtggagggcaagaagcttcttctaatgcagggcttatcaatctaagctctattgacattttgggcctggtaattattttctgtttggggttgtcttgtatattgtatgtttagcagaatccctggcctctagtgcctaatgcctatagcatccctccctctctcctagtaatgacaatcaaaaatgtctcagacattgccagctgtctgggagggaaaacagccccccgctgagaacccctgctttaaggatatctatggaagttatacatatcacttccctgtaagagtcagaagataacatgtggacacactgagtcataagacagtctgggagaaatatttctagctgggtgaacttttgcccaggtacaatttcaggggctctattgctaaaaaattagggaaaatgaattttaggggacaattcaaaatctcttccacacagctgtacttttgaagctttctatcatattagccagtaagttacctttacaatttaaacaatttggaataggtttttcggtcacttgaagttcagagccctaattgataccagtattattatctttatccaacactgtaagttgaaaatagtgaacattatccaaagaaaaaaggataaaaggaataatacctgaagatactcagaagctgggtactggctgagaagggattgaacaaaacagcagaaatgaggctgtttcttatcaagagaaatatggtagaaacggaaaggccatggtcacaggagcccacggtcactgtagtagttaagaaaaaaggcaatataattatgctaaattaccaaaatgaaaactgcaggcatcttgcattatttggctttgaactgctactttctagttctcattgtaaatacaaaaagcgtttagtggctcccttatatctcacacaaaaggatcattgcttacagccagctgtttggcaattatatttctatgaagttagcataatttgagattagaactgcctgagaagaggggggtggtgataacattctagtgtattgaagtagggtatggaatagtgatggtggaagctctgattttagaagtgaatggcctttccaaagttcatctcgaagccaacagttctgaattcaaaacatattttgccataggaatcttatttttttaagttattagattagcacaggagtcctccaataccagaaaagaaagagacatgtactttacggtagtacagaagaaaatgctgcagggcaaaggaagatttgtctgaaggttcagactgaggaaatcattagtaaaatcttcagggaagtggtgacttttaaactaagctttagatgaggaaagagagaaagggcctttcagggtgaaggacggccagttcaaagacacagtatttaaaattctccatgaggaatagtaagtgcctaccatgagtacagcataaggtttatggagatatgacaataagttaggacggggctgtgaatgtatggtggagtttggatttttttagtccacaagccactaaagagttttaatgaggaggatagtatgatcaaatatagctttaataattacatgaagaatgctttgaaattgaggacattactgcaagagaattggatttctgatcttgagacatggcagtgggttagaaagagagaaatcaccagagaaacaacgtgaaggtaaattggcatgggaggtagagaagaaagaatcaaatatggctccaaatttttaggtctacgaggttggaatcatggcacaaggataggcttaaaaggaaaggaatgagctcagtaggtatctgtctgcaggataagagaagagttaaggtggtcatggccttatcgtatagcatatgggctacatttacatttctgcaaagcttgcccattggggtccctataattggagaaaaatcacttactgaattttgtacctagttccagtcttcctccaagtttactttatattatttgtttgggatatagctccacatgttgaaactgtgcctctaacaccagtgttggtgaagacattgcattccagtgccagattctgtggtcagaaattttgtttaacagaggtagcaataatattggaagcataggttgcattgtagagtgtctgagaaaaggggtgcagagaaaaatcctatcaaacatgtgttaaaataatgtcaaatctgatatactcataaaaacatgcccttgaacatcttggggcagaggaagggatgggagagaataaaggaggatcatctcatgctcaaagagagaaaaagaagagagcaaaggagagtttcgcaggaagggtactgtggaaacgccagcaaaggtgggatcaggaattatctggaaaagagagaatttctggggtgtcttttgatccacatcctacttccttatttctattccatccaggcagttgaagtcatcaaaccaaccaagcctttgtatagcatggtaggtgatggagaaggacagtaattggaacagtaaggaaacagaggcatatctcatatgccatatatgcctgtatatcatatatcatctcctcttactccctggccaaaaaaaagatggcagattcattgtatccaggatatactgatggaggcaagtaggatggaatgccatgcctgaaggactaggtggaggtgatagttcatgccacctagagctagatattggagcatcagggctagatcaacgtgctaggtactgattgctggaaggaacccttcagaaatgaaactcctaccaattaatatgagagatctatgtttcactcaaagtttatgccagaataggactaaatgaacaaaaaagaatggcaccaggccgcaggtgtctgccccatgaattgtattcagaaggggctgcccatttggcagagttgtagaattgctagttcatctttagagttgctcatagactggagctgatcaagtaattacaaaaccagtcaaacaaggtctatatcctcttccttgaaaatagctagtgagaccaaagtagtcatctggtcaccatgctaggatcctctgcttccctctcacatggcatagtcagtgttctaggtctccactgtcttggagctgaggaacaatttgatttgatttggtaagtcatatccccgtagctttaacacagtgacttcctattcctcattctgaataggaaagagtttggggtgcagggtagttttacagctaagtggaaaccagaaagaagaaaacagacagtatagagttttctcagagtagaaaggagtcacgagaaaaagtaagggaagaggtatggatattacctcactccaacaaccaatacatactaccacatctctaacaaaaataaacctcaagcctgagggattccttttctctaattcctcattttcagcagaataaggaaagtagatacttcaggcataatatgcctaagtgtatcaacattagctggcctcagaatctggaaagaagctcagtaaatcagttttgatttacactatcctacagcctcagtaataagattccacctggaactctgagtttaacttttcagctgtgtgtaatttgatctattgatgtcaggaacaggagcaaactgtacaggatgttgaatcagtttcccatctcacgctgcgagaccacctcatataggtggtaatgaaagaaatgttccctttgtcttttatctcatacatgatgacattcttcaaaatgaaccagttgtttagagcgggtatgcttctttccagaaataaattggtactgggatagcttggcttacttgtgcagcaaatgggaagactctttcccatttgctaatggtggttaccaattcagcaaagtgagttgaaggagagtctgattcacagatgctgacttagatgttagccctctcataaaaccatagtaataattaacaatgaaatgtgccagccacactttgaatcactttccatgtggtaactcaatttaattttaacaactttatgagctaggcattatcattttcactactttacagttgagggagttatgccacaaagaggtgaaataacttctccaagaccacacagctagaaaaaagcagagccaagatccaagttaggttggctctagagtctgtacttgtaaacactgtactaaattgtctctctgacatatcacaaagagcagcaggtttggagtcaggatagactggcttgaattctttaaaaaaaaaaaaaatcagcctttctggctgggcacaatggctcacttctgtaatcccagcattttaagagtccaagacaggtggatcacctgaggtcaggagctcaagaccagcctggccaacatggtgaaaccccgtctctactaaaaatacaaaaattagctgggcatgtgcctgtaatcccagctacttgggaggctgaggagggagaatcgcttgaacctgggaggcagaggttgcagtgagccaagactgtgccactgcactccagcctgggtgaaagagcgagactccatctcaaaaaaagagagagagagactcaactacttttttaagataagttaaacaaaagaagtgaagtgtcccatgtcttgcatctatttcattggcaagaaggattatctaaatgacattgaagacggggtgtcagtatttagatgatgaaggtttccatgagttcttgttttggggaacagaatgaatccatacatgagttcctgttttggggaacagaatgaatccatacagttacagagatatagagtgcctagagacagtagcccaattttttggttgcaggtttcctatgctatttacatgtttcagaaaacctagtgaatgtttagatgctatgcatgttgtccagcagctgtactcaggaaaagcaagagcaacatttgtgagtttcattacatcttattttattatttccataaaattgtgttttattatgcaatcacaaggacttctaagccaccaagagactgacaaggatttcgctttgcagaacaacccctaaaacagaacaaattcaattatccagaggcctattttgtaggagaggtaatctttgctttagaatttttaaaattgtattcttaaagcacaaatgtgactcataggcaggtgtatttccatttagagaactcaaccagtagctgaggatataggagcaaggtctagatctcagaaaaagttacgaacaagctaagcaagagattagggatatcgctaaagggacccaagttcaggacgagacttcaatacagtgaaagaactagaagacacttagttccttggcaatcaagactggagaaaatggagactcaatctaagacttcagattgttgggctaagaagatgctcaaatgtgcccatcccaggtacataacatatagtctaggcttatcgaggcacaaaagctgataaagaaccctaagtttcttccagcttttgttttgactaagttgggaattttgcctgcaacgtaagtgctttggtacctgtatcagggtcaatctgcgaaggcaaagaccgagacttcccgtttatagcagttccaaacctgctccgctttcagccctgttttgttgttgttgttgttgttgttgctgctgctgctgttgttgttgttgttgtgagattctgcctctgttgcccaggctggagtgcagtggtgtgatcttggctcactgcaacctccgtctccctggttcaagcaattctcctgcctcacctttggagtagctgggatcacaggtgtgcaccaccacgcctggctaatttttgtatttttggtagagatggggtctcaccatgttagtcaggctggtctcaaactcctaacctcaggtgatctacctgcctcggcctcccaaagcgctgggattacaggtatgagccactgcacccagcccccaaccctctgttctcttttttatgtatcatgaaatagtagaatacatctgagtcatcagaactgacagcctctgcttacaaaagcaacagatcagcaggtcctaagttaacgctttgacctcaccgtctacctctcttccccctgccttcattgtttctcaaacatgcagaaggaggtgcaacttagggcctttgcaggtactgctccttctggctggtacaagcatcaccatacagccaaatgactggttctttcttgtctttcagttcttggctaaaatgttgccttctcaatgaggactttcctgatcaaccttttttaaattaccctattctccccaaggcattaataacatcatgtcagagctcttagcaaaatctgaaactatcttgttgggttttaatttgcttactgaaatggcagatgtgcaaggttttttcttatcacttattgtgttaaatgaatcaagatactcagagtgcttctcttgagaaaacctatgcctcacttaggttgacaaagtttcaacacatgaacacaggaggcatatatagtatatacatgtatttcatcagtcccaaagaacaactggcgacatgactagctttataaaattgcaaggcgttggatgggggagctagggaactttacaaaacacacaaggtctctgaaccaaaaatcaacattggctgtgaacagtaacatggattatcagtgacattttttgcttccatttacaactgtttacagtggatttttttttaactgaccaactctttagtttgtggagttggttttacatctctaggcctggtttttaaagatattcttaattttgatgaaaatcttcattatgatctcctggactggatgtaacatttaaaaaaatctcctaacaacatatatcctagtaatgcagtctctggggtagtgggaaaaagtcaggactgggagtcacaagacccaggctgaggccctaaataagttccacttattcaacaaaaattgaatatgtgccaggcactgttttagcaaattcaaatagtgaatatgacagacaaagtgtctgtcccttaggaattatgttctactggggatagggagagggtgataaaaatacccttttttcatctgcagttttctcttctaaaaataggtgggcattagactagatcatctggaaagtttctcctagctctacatgttccgagagagaggaaagaaaatttgaaaggcttcgcagtagttattttagggaagtaaaatcctagatttaaatttttttttctttttggtcatcattgctttctgatattttttctataatgaacatgcattacaatatgaaatgaaaaaatgtttaagaaaaacagtagagattttcctttcaaccgtgagcattggtttctagtgacctgaaggtacaacattcatccattagtaatgggagctgtaaatgggaattgtcttgcctctccagtgacttattaatctttgcctaatggggctttagggaacctgctcaggggatctttatgctccttttcccattacttcagtgtgtaccggtctcttctcttttcctcgaacacttgaagttcttctccacctaggaatatttaggctcagttggcctcatctcacccttcaaccttcacatctcagcttaaatgttaattccatagatgccttaacagagcaatctaaaacctaaattcccttcctactttactactcaccatatcatccttggtatttcctatattatctctattctgcttttctcttacagagcactcttgtcaacttgtagtttcatgtcttttgtttctatataaacttagtctattttcccccacagtctgaagtttcattgtgaagacagggatagtctgttgtgttgaggctatattcctagggcctaacagtgcctgtcacatcatagatactcaactaatattgatggagtaaatgaataaatgaatgaatgaaatggctcctttgtcctctctctgttaagtgttttattcccatacagtgttgtgctgcaggcaagccctttgccagctcacaagagtgaacggttaatttttcagggattttgcaagccaattgttaagcttagtggcttgacattggccttggttggggtatatatataccatagacatagggaaatgctgcatgttaagactttttattcccacaaagagctggtttaccagcatacctctactctcatcttctaaatcaaactataaatattgagctatcatgcaaaatcatgcccataggttatttaaaatatttcaataaaaaagtattgaatttaaaaaatattaaatacatgctatataattatttacctgtgggaaatagttcttttataagctaacttataatctaaaatatgtgtctctgatctcctaaagtttgtttcctgtttttcattcagatccttatgtgaagattcatctgatgcagaatggtaagaggctgaagaagaaaaagacaacaattaaaaagaacacacttaacccctactacaatgagtcattcagctttgaagtaccttttgaacaaatccaggtaatgtcaaacataactttgtcttcccactcaatttcattccttcagaccacataaattatacacacagaccttgtaagttatcagtgcacatgccttcattagaactgccattctttctccccatgcacatttgatgcttgagctacatcaggaaggataaaatatacagcacaggatgtgctgactcatcagcccaaaacagctggcactgtgttgagcagaaataaagtaggaaaaagaaaatcaacagaacaactctgctaactcaaaaagtgcatctataaaagttaaaaagcccagagaaaactatgagctttcactatttactcccaggccataaataagtctccccatgagatctttagagcaaaaaatagtgataagagaaatatttttggttgatgctaaatatgcagcatattgagtctttattaaaagatgattaacaatagaaaaattaggctaagttgtgttttcaattatttaaatccagcttcctgtgtctgagttggaatggatggctattttattaaaaatggagccttaatatgccagacaataattatgaagggaaatattctattaaatatccttgtagttaatatgttcatattaagttgctatatgtagccacaatgataacatgcaatcttatcatttaggggtttttgaaaatatttacattttctcaccccatctccatagttagcctataagaatctaaagataatatccaataattttgggccatttcttgcaaatctttaatgggcatcagagagtcaaactgcataaagcaacactatttttacattttattaaataattggcgcaggtgtatattttcagtgatacacaagtttgcccataacttgaaggaaaaacaaagagcagacatcaaacctacaacaaagaaccttctaaaggtccagaataacaaatactctttatttattttattttatttattttaattgccaaatagtagttgtacatattcatggggcacatagtaatgttttcatatatataatgtattgtaatcaaatcagagtagttagcatatttatcatctcaaacatttatcatttgtttgtcttgggaacagtcaatatcctacttgtagctatttgaaattatatcatatgttattgttaactatagccatcctgtagtggtacagaacactagaattcattcctcctatgtagctgtgattttatatccttaaacaaatctctccctaccttccccttcccagtctttagtatcctttgttctaccttttatttctatgatatcaacttttctttagcttccacatgagtaagaacatacagtgtttactttctgttcctggcttatttcacttaacataatgtctgccagttccatccattgccacaaatgacaggattcattcttttttatggccgaatagtattccattgtgtatatgtaccacattttatttatccattcatctgttgttggacacctaggttaattctgtatgttggctgttgtgaatagtgccataccactcttaatatgccaaattgtgtcttcatttacctttaatctattcttagaagacagtatcttatgaattaatcacagctttattccaagaagaaagctaatataatagctacacttattttatatatataaaatatatattttatatatataataagtatagctatataatatatacatatataaaataagtatagctattatgttagctttcttcatggaaacattaatccaaagacatatatatatatatatatatatatatatatatatatatatatattatgcctaggtccaagttaaccactttatgtatgtaatctcatttcatacttagaagaactttatgagaaaagtactattgttattatcctaattttatatgtgaaaaaactgaggcttagaatttctttacatgtaaaataagaatgataacagtccttgtcaaagtgacattatgcatataaaagcacttggaacagcgcccaatacataggaacacacagtaaatggtcctgtcatcatcatcattattattcacatgctaatgtcctctctttttcaagttaacattttattagaaaatagatctaacaataagattaaatcagtatataaatcagtgctgtctaatagaactttgtgatgattgaaatattctatcatccatgctgtccaataatatgatagccacagctggccaatgagcacctcagtcactaatttgaccaaggaacgttatttaacttccatgtatttaaatttaaattgatatagctagatgtggctggtagctactctgtagtatagggcagtcttaaatgaccaaaaataaccaataactctaccatctttgtattggttgatagttttaaatacaacctttatcatataaattttcacatggtgtcaaattatacatacttatttactttcaacatctgttacataagtaaatgcagaggacactggttccctgttcccaataactttttcactagcctgaaccagcgggccccctgctttggacccactcacaaaccctcaagacatcaattttttccaacgatttattttgcaatatttattcagtgaacttttttgagttctaagaccttattcctatggaaactaacacctcctggcatttaatttttttaattccacaaaataaatataaagcaaggcattgagatgaaaactcccattgagctacaattctatgcctttaaaataaatatccttttcaactacaaactgcagaaaatgcaggtatattgaaagtgaagcacattaaaaataagacacatgctaggtttctggggcagcatttcagaggcaatagcgttttgtcaggacagacagaaactatgcccaatatagaatacattagacatggaaataatgagcattcctttgactgtatccctctttctctgctccttgagtcactttgttcttttttttttcctttttttataggaggcaacttttctagtcttcacctttttctagaaaaaaataattgagtatttcacatgctaaaatagggtcttaagtttgccttatcctgaggttataagacaatctgcctgtccttctgtctttctctatccctatgaaatgtattatgaaagaagcaaaatatgctaatttccaaatgcatgtgagaatgtaagcccttctcccccaaatgtagaaataaactacatatgcagctggaaacattaatccaaaggcttcacaaggatattttgtcttgaatgctactaatcaatgcattcctaagtggaataatcaaactctaaaaacttctgttacctttgtgtgtcatgtcccccaccccattcattacaatatgattgcttcctgataaatttgcttagaacaagctctaagaatcagtatagccctcttctttgttccagaaactatccagtggatagttaattcctttcacaatggaatcactccaagggaagattgtccgttttattgacaatgtgttgcatttcacattctaaattccacttgcagaagtgattgttttctctgctctgaagctgtatatcaatgacatttctcatttcattaatataataaaccagtctccagcatataaagtccactaaagggccctaactcagctggttcttaatctggccctagcttttataattacattttctgctactttcaactctggcaataaatgttacatattccatttattttaaactcttacctttacactcagctgctagattgaaaccatcacatattctgctaagtaaattcattacttaggaagtagaactgaaatttgcttttaaaaagtatatattttataccataatggtataggtttgctttcatcagttcaatcattcagaaaaggaagtcatcaaataaactttcaaaatctgatggaatcattgaataaatcccgtgtagcctaaactgatatttccatttgatatcaatgccagatacattgtagttactcagtaaatgtttactaagagaacgtatggatgagaaaaaaatatctttattactactttttaaccatacttttcactatactatcatgttttatgctcacaatcatatgattagttgaaattctatattaattctatattaatttttttgtaacatgctgtccccccacccttaaaatcagattattgcacatggttgccttgggaattgtaatcaaatagagtgggctgaacaccaatgccagaactttcactgataagacaactgaagcaaatgaatttagaggttagcacaagttgacacagactccatggcatggaggttcacagcataggctctgaaaaccaaacaactcattccttaaacaacctcagacaggttatataacttctcagagcttcaagcatccttacctgtataatggcaatattaataggatctattatgagaagtaactgagttcattcatgtaaaagacttagtgcaaagtatataataaaaattaacgtttgagtattaagattcaagtcattttcatcctcatcctagtgcttggagattgattcttctatttccaattctttagcgctcaaggacgctttatagtcgggccttatctctagagctagatgattcatattcatttcatggcttctttcagaaagtgcaggtggtggtaactgttttggactatgacaagattggcaagaacgatgccatcggcaaagtctttgtgggctacaacagcaccggcgcggagctgcgacactggtcagacatgctggccaaccccaggcgacctattgcccagtggcacaccctgcaggtagaggaggaagttgatgccatgctggccgtcaagaagtaaaggaaagaagaagcctttctgcatttgcccatatagtgctctttagccagtatctgtaaatacctcagtaatatgggtcctttcatttttccagccatgcattcctaacacaattcagtggtacttggaatcctgttttaatttgcacaaatttaaatgtagagagcccctaagtccttcatcataccactgccctccaaatctactcttcttttaagcaatatgatgtgtagatagagcatgaatgaaattatttattgtatcacactgttgtatataccagtatgctaaagatttatttctagtttgtgtatttgtatgttgtaagcgtttcctaatctgtgtatatctagatgtttttaataagatgttctattttaaactatgtaaattgactgagatataggagagctgataatatattatacggtaaatatagtatcgtctgcattccagcaaaaatatcaactcgtaaggcactagtacagttaaactgacatcttaaaggacaacttaaacctgagctttctattgaatcatttgagtaccaagataaacttacaccacatacttggtgggtgaatccaattttgtagaattcctacacaggcaaaatagcatgatctgagcagcagcatccaggctgacctcaaggaagcatagccacaaaacagaatagcacctgtctgtacatatttacaaagctaaaataatggcttcactcttatatttgaggaagcaactgaacaggagtcaatgatttcatattactgcatatagaataacaacaaggtgttccgtgtgtgtgtgtgtgtgtgtgtgtgtgtgtgtgtgcacatttgtttggggatgggggagaagaagctaaggggagaagtcaacatttatgaaatattgcctgactatttaaaaagaaaaaagtagctctccattatcacctttatacaaaatgtacatcctgtgaattctgttccagatttcacacctacaataattccaaaaggtttgcacattagagtttgtaacaaaatattttattatataaaaccaggttagaaggaatgcaggatatttttaacacaacaatctgtgcttattacacaaaattactttgtggtaaacagacagtattgtaatcccatcaaaagatgaaagaaaaacaaaaacaaaaaccaacaacaattagccatagttctgaatgcacttcaattaagccaaaacagacagctagtgatctttttatatgctctttttacttaagttttaatttgtcctttaaaaaaaggtgaaacaaaccaagaacaagttctagaaaactgaagcaacctcttatgtatactagatgcttgatttaggaggagtttttaaacgttttcaatgttattatgtagtaaatgacactattatgaagctactagtcattccataagagtcttaaaggactgctctgtgtaacactgtgactgccgtgtgtgcttagacccgtagtttcctcagtggatagcactcaatttattccgtagtgatattgtaacaatactgccattcccttctactgcactgcccaaggtgtgtgtagcacaaacagttctcattacaaaggaccaattcagaactgaaaagctatgcataggacaaggaagatacatagaatggggtggaacacagcattttgtcaagcactgtgcaatattccatatttttccccactatggtagacaaccatttcgtggaagggcagcctattatcccacactgcatctagccttttgtcccattcacttctgtgatccattttaatttccaggccacaagacagtagtgatgctctgaaatgaaagtttgtcttcacaaatatcaaaacaaaatggaggaaaactaagcattggcctcatgttcagtcttcaggatatcacaccacgtcttttcaaaaactaaagagaattcaaaaagggctgatggtaggctttgaacatggggttggctgtttcccagtaaaactggaattcctgtcgttactgtttccttatcaaagaaggggcaagctcttttgccttttaggccagacatagcaaacgctttataattggcatagacataaaggataaaaggaaaataaccgtctgccgatggtccgtacttcttaaaaaacataggtaatagaaaatatacacaagtcagaatgtgaaattaaataatggtttgaacagaaaattcaaacaagactctttccaatttaaagggccaaaccctaccaaagagagggagttgactggcttttaaaaagtatttaaataccacaaatgacatttaatttcactgtattcagctttaagttgttcacaatgaaaccacactttcaaacaagcaggttcaagctgctgaatagacattatttcttgcattaaaataccactaatgcattctcttgcaacactgccagacatgggattgtcaccatagaattagttggtactatgccatctttcactctttcacaagtcagtgatggaacctgctttatgaccaagattcatcctcaaataagccacatgtacccttctgacaaagctgtgtaaagtattagaatctgatgctctagaaagatcctagttgcctttgtgtatatttactgcctgcttgagtgtttctatgtgtgggttttccctgtatcttgtagaaatgttggggtgttttcctctgccatatggctcgtggcctgcgagccaactatttcagctgtattttaccttcatttttgatgaggtgatttaaattttgtttcactttgtgtagtgaattccacagtagttttctgattgttgttaaaaatgacttaacatattacacagatattcaataaaaatgttttatttcctgttga

SEQ ID NO: 2427 - DNA, 13362 bp, Homo sapiens
ctccaagagcagagctttaacttcagaattttagtgtatgtacaaaagtccacagctccagctgaaggccccattgttccgtgctcgcccctgccttaggacagttcagcttgctatgtgcttgtccaggcagagggcacaggagtgccaagtttctattagtgtaacatgattgatttaaaaacaaaacaaaacaaaacaaaaacaaaaaaaactgcttatgcactgtgaaaaaggctcagggacgaaccaggggcccccgagcagccttgctggtgaggacacccaaaacgggcatgaggcatagcgtccctcatcctcgcaaaccacccactcaggctcttgagcccacggcgcacctctctccgcgcgcacagcgctgactgtcggcggcgcgcaggcagctgagaaaagctatgtacatcgaggggttagcaccaagtaggcggctgctagctcctgcttgcccctgcaggacccctcctttccagaaaaaagtggggttggaaggcgatctcgcaggacggtccttagagctgcccgcaggggcgcagcctcatctgagaagactgggcgcgggcgggagggcggcggggccgcaaagcgcctcctcgatgtcctccaggcagcccagcaggtccatgtcgcggagcacgcgtcccagcagctccagcgtggcctcgcgccgcggcgtgcgccgcctccaggtcgccagcatgctgtattgcgcctcgcgcaggcagcgcccgttctgcagctccagccgatcgatctcgtggtcgctcagccctaggcgccgcacgaattccttccagcgcaacgggggcacgttctccaccacggcgtacagcgtcgcggggtcatcagctgcggggacgcgggccggtgagcctcgggcggcaaccccaggccccgccccgcatcccgcgccctccgcctctcgtggtcccctctgggagcgcctcccgcgctcccccggccctcccccagcctcctcgtctccagccgcgggagaaactcactgtctaggctctgtggcttgtgggcgctgtcctcccacttctgaagggggttggggatggggtcggaggcgagggctgtcgcaaggatggggtcagccccctgatagggtggtgccacctctctgcggggagccgcaaagttgggacagtcaccgggggtataggtggagctggaggtgaaggtggaactgggcacgggactgaagcccagggtgggggtgaagcctggagtgggactgaagcttgggtttggggccaggggcttagtagtagttccttcaagctccccctgaaagagagaaggtggcgcaacattagtgcggcagcgaaaaccagccccggccctctttattctacgtgggggttgggacttagagggaatgaggcgagcccccggaaagtgaaggatgattccaggggatctgagcattaggcaattataaggaatggtcagggacatttgggagtaactctctcatttcatctcacctctttttcaggtgtcgatttcccacaaactgaggaaaaagaaagaaagcatcataaatttcacttcctctctcagccctggcaccctggactcagctggcagtggggacttgtggtgacatgcctcagggcctatgtggccccagggacgagagagctactgatgcagctcgacatctccccagccatccagggccaccttctgcccagagtccccagcggtatgaactgaggggacactcctcacctccctccacacatgtccatcgcacccacccatgtcctccctcacccccaccagctccctctccctcccaaagcccccactcaccaatggagtagagcttggacttccaccgttggtagcgatacattaaaccaatgaagaggagggataaaaggcaaagaccaaagaaaatgaccaggggcaacagcactgtggtgcctgcagacaaagcaggtgttggtcagaggagcgggcagaggggggccgcagggatagatggatgggtgggatggatggacgggtgggggcaagaagagggagagggcaggtgagcatgggcaccaggtcacttctcctcacctgagtcctcagtgcccttaacattctcaatctggggtaggcacaacttcgtgcactccaggcttttcttacagctaaaagaagagacggcactggtgaacagaggccctaccattggaggaacacagaaaaacaaccacacagattgttggacatcctttctttacaaatatttttgctgtctcttgatataatttgttttgggaactgatgcagaagaatgaaacacagttaatcatagaatcatttaattttagaattggcagggatcttgaaaaggctgtgtagaaaatgtgaaaagcagtcagggtcagggtgtaaattccagttcattccttggctagcagtgtgaatctaggcaagccattaacccccaagcctcggtttcctcatcaccacagggatcgcccacctctcaggattgaggattaagcaaaatcattatgcctcatttaataagtgcttgagaaggtagccagctagctgttatgggattgttgtttcatcactgttttgctgataagaatcctttggcaaagagaggttaaagggctttttcttaaatgacactgctagttacagtacctgacttcggggagtcggggtcaaacatgcatgtgaaaaatttaaaaacacatgttactggggcagccagagagcaccctgtagaactagcagatcttccatgttgggagttgtcactggacagtgtggagtgatgggaactctatggggtggtgctggaaggaacttgagagagtgagttcccagcaggaagctgaaagcagggagaggcactttagcccaccactcaagctcatggtgagaaccacatagaatggtataaaagtgatttcaagaagagatgaagccggctgggtgcagtggctcacggctgtaatcccagcactttgggaggcagaggcaggtggatcaccaggagtttgagaccagcctgaccaagatggtgaaaccccatctctactaaaaatacaaaaattagccaggcatggtggcacgtgcctgtaatcccagctacttgggaggctgaagcaggagaattgcttgaatctgggaggcagaggttgcagtgagccgagatcgcgccactgcattccagcctgggcgacagagcaggactctgtgtcaaaaaaaaaaaaaaaaaaaaaaaagaagattaatggaaaataaatagttttgtgtcagacgtgttgtaggttttgtttgtttctttgtttttggttctcacaaattcaccaaatgaatgtcattatgcttactttaaatataagaaatctaaggcccaggccaggcgtggtggctcatgcccgtaatcctagcactttgggaggctgaggcggaagatcgcttgagcccaggagtccgaggccagcctgggcaatatagtaggaccctgtctctacaaaaagtaaaacattagctgggtgtagtggtgtgtgcctctaatcccagctactcaggaggctaaggcaagaggatggcttgagccctggaggtggaggctgagccacggttgcaccactgcactccagcctgggtgacagagtgaaaccctgtctcaaaaaaaaaaaaaaaaaaaaaacaccaaaagaaaagtcaggctcagagatgttaagaaacttgcccaacgtcacatagccagtaagtggctatgctggggttcaaactctgagagccctcagagtttattctttgcaagtgagtgacaagaacagcctctgtggagccaggagtaaggaggcctggacagtgactaatgaggaaataccatattgcatcaaacctaagacgccatcaagaataaaaggcacttttctttacattactacccagacgcaaacagagctgccaattcaaccatgatgagtcaccagttataggaggtttgatttcagagctataagagtgtatgtcctagaaccaatgagctatcgtagatccaagaatctacatatctgagttggaagggctgccagcccttggggcatgatcttccatcctcaaagacttcttcagatttgaagagcaaggggaaggactgcctggtgtcttaacgaagtgtctcctactcagccagtaggaccctgagcactctggggcatcctggcatctgttgcccagctaatggttcccaccagtcacccgtcccaacccatgccaccatccagtgcccagcagctctcagagatactcacttactacaggagacacactcgttttctcttagaaagaaacctgcatggcaggtgcacacggtgttctgtttctcctggcctgtagggagaagtgcggcacagctaaaggagaagcgcctgcacccccaccccacaggacagaggaagtgacgagggacagggtgggggcggccagagaggagttggttgtcagacccacagaatacaggagggggaaggaaaggaagtgccaccgcatggggaaggggccaacccctggggtggggagagggcttggcctcaggagagctgcgctcacaggagaggtgcacggtcccattgaggcagaggctgcaattgaagcactggaaaaggttttcactccaataatgccggtactggttcttcctgcagccacacacggtgtcccggtccactgtgcaagaagagatctccacctgacccatttctggtgaggggagaagatggggtatgagtcctgcatcctcctgtccctgcatccccttcctgacatacccctaagtgtgtgtctctgtaatacacactcacatccatgcagtgtcccaccaaaacacacaccttcctgcccacacccaccagcctgcacatagacaggcacccacacaccactcaagacccgcctgactctcctgcctgtgcacactcaccctttcggcatttggagcagctgaggcagtgtctgaggtggttttctgaagcggtgaaggagccgctctcacactccctgcagtccgtatcctgccccgggcctggacagtcattgtacaagtaggttcctgtgaatggggccgcagagttaggctgcgggtgagaacacaaggaaggagccccatgctagggacaacagccagggccgattccctgaagtctctaggagaggagggagggagaaaatcccagcccaggagagacagcaaagttagggaagaacaactggaagaagcagagaaagaagcagcaccccagacctgagggcattcaccgtttccacttgcccctacctttgtggcacttggtacagcaaatcgaattattttgagggtggatatattttccttggggacacacactatctctcttctccctgtcccctaggtgagggaccagtccaataacccctgaggggtatattcccaccaacagctccaggagcacctggggaagaatcagatagaggagacaccatcaagagagggagggatgggaagcttaggggtagcagatctaaaacttccctggctcaagtccttcctcagtgaaacattccgcccaggccacgccactcactaagtttagagttcttccttgaaacttagacagttggggccatacaatctgatgcttaattgttctctagttgtcctgtgtgttcatttttgttccctcaactcaaagctagtaggccccagatctaagctgtatttttttttttttaggcaggatcttgctctgttgtccaggctggagtgcagtgatgcaatcactgcaccctccaccacccacgctcaagcagtcctcccaccttagcctcctgaatagctgggactacggccgtgaaccaccatgcccagctaatttttttttatttttagtagaggcagggtcttgttacgttgctcagactggtctcaaaatcctgggctcaagtgatcctcccaccttggcttcccaaagtgctaggattacaggcgtgagcccagccctgtattttatccttactgtgaaatcccccacagcagctaacagtgctggacacagggcagatgttgaaaggatgtgtttttgattgggaattggcaggttacttcagtgatggccccttcttccaacaagcagccctaaagattggggcggtgtttctccatctgggtgctgggttcaccgtgtgatcgctttgcgaacattcacagaggtaaacaatgaggatctatgcacatcccaggaatatgttacaccatgaaaagctttctgaaaaagtcagctggcggtgggggcgagtgatgttcccgtgagcaccactcctggggagtggacagaagaaggaagtttatttacatgtttgtatcaaacctcaatctgcctccgccctcacattccctggcccatcccctccacctcaaaatttacaaacacccggggttggcaaggacaaatggggaggagagtaaaagggaaaggttggggatcctgcatgggtagacgggggacaaagttgagacgggggcaggagtgggcaaaggtgtgcaggacataggcaaatagagctggccaaggctagcgacccagcttggatgactgtcaggtcagagctgagggcgtgctggggagtcctggagccccctgcacaccatggcattctggaaggtgtgctttgcagtctcaggccaaccccacagcagctaaatggcttgtcctgttccggcatcagtgccaggaaagcaaagccaggagtgaatatttagctctaacttggactttgatctctgccagcttcatttctggttttccctgggcttcattttttttttctactataagagacactttgtgtaaagataagagggtgtcctcaatgtctgttaaacactggggagcaactgactcaccagatcacagaaaccctagggcagggaaggagggtcaggcagcccacagccacccagcctcaccaactccacatttcggagcaggaggccagtcaccctgagtcagccacggggagacgctgcagctgtaagctgtgcaggcccggaagttcaagcctcagccgcaaacaggggaagccacacacagaaacacaacagcagcccccgcaggtggaggcgtgtgcccctgctcagaggacaacaaccttcccctgcccgcaccagccaacaccgtgccacctctgctgagaacaggactggggcttccagggcaacaggaagggtttggggtggtgatgggaagaacttcccagtcctgaaagtgtggttcctttccccgaagaagccactggagcacctaaggtcactggtactttgaatcccatccagggggcttgaggcagagtcatgatgaagaactgggggacgccagccccagacagccttaaagggagcttttcagggacctctggccagtgggggatgagcctccctggagggagggagggagagaggctttctcaggccacgtgttcccttctctttccagcactctgggggttaagtcagatccgggaaagggaaatcttttcccagcaactccgccccagtgactcaggccagagggagggagacctagggaggggagagggaactagcagcttccccagctcctcaagggtcatgagtcagcagaaaggcagaaggcaccagcctgcatgcaagtgggactccatctaatcccttcttcctatggccaagtccctccttcccatccccactcaacccccatccatcccctccccatgcaaagagccaggccacagacccttgtcccacttggcccacatgttccgggaaatgcctccctctccccattccatcccgaagggaagtctccctcgaccctggcttccgcccatcaggtctgtgccctcccttccctgagggccacttggctcctcctagcccctcagcggcctttagctgaggccccgccccagctcctcctcccagttcaacaagtctccaacagctaaacccattccgtgagctctcactccatcccccaacactccccagtcccagcaggaagcaagccaaggctgccctcccaccctgggttcaccgcattcccacagcctggctggttctgaccagttgtgctgggtttgggggcctccctggggtccccagacaatccttaggaaacaaggccagttctgagtctccacagaccctccccaagcccactggcaatacaggaaagcctccagagccctgaacacccacttccaggaacgagggagcaggcaagaagggatgccggatggaagaaccagccctgcttcctaggcttcccctggcccccagaatgctccaggtcagccctctctgatccctaggagccagggccctcagactccccaccactgggcaccactgctggcaccagctggccccagtaagcccagtcctcagcagttgcgtaaatgaagcaaaacaggagaaacaggaggtgagctctttaggcccagactccagcctggagcagaagggcaggaagctggggtgcctgtggagagacagttgagggggtggcccaacacccctccaactcccccacaatttccgccagaggaggctttaaagtgtgacttcctgtgctggggctgcagagtggggaggcgacgctgagatcggccttgtggtctgaccccgatccagccaccttgcagggacccaattagtcttcctttccccctcattcatgtgtctgttcatttaatgtcaaggtgttgggggaggtcgtggcagcttctcctccaagggcccagttgagatcccatctccctcccgtgaagccaccattgacgatgtctgtttcctccaccccggctccttagacccatagtccctgtgaactcgaagcacgtgaactgaccctatctacttttggctcttatcataatatggttatgttgggtgacagatatgatctccccaaagtgaccacgaaccttataagatgagagatcaaaaaatgtcttggtcagaaagtgtcttatcctcccctggtgtcctctcagctcccagaaccagacctccagactgggagcagataaatatggatcaactgatcgatctaatgatacatctgtcttccactctagtagaagccagtgattcccaaagagggaggtgaggagacagcacccctggtaggaatatatttatctccgggggagagttttcagaccatccccccacctccccacacacaagcacacacacccttacttaagagtctggtgtgctcctctccttttgagaaccactgatgagtgaacacagtgtgtctgaatgatacaaaggcagaaagaagttgcagcacctctcctccagcttggtaggcgcacccttccacatgaccatttccctgacccttaacatgccccagacggaattcatccatctcctcacctagacaaatgacacaccatcgacttcccggacgaatgctgagaacttgccacgctctctccccagggccccatccctatccctgccgccatcccatgtgtcagttcatcttgcgaggcctccccctgtgatctctcggtcctctccgcattcctgggttgcctcacacctgggttattgcaagtgtcttctagcctctctcctgctcccatccgtcctacacactttttaaatcttcattcaggctttaacttgcacgcacaagtgtgtgaaccttcctctccatctccagggcctggctccaaacagcatttccatggtcatggaaatgatctgaagacttccacagatgcctcactacttttttttttttttttttgaaacagggtctcactctgtcacccagggtgaagtgcagtggcacaatcatagctcactgcaaccttcaccaccaggacggaatgtagtggtgtggtcagggctcactacaacctccacctcctgggcccaagccgtcctcccgagctcagtctcccgaatagctgggatgacaagcacgccccaccatgccccgctaatctttgtattttttgtagagacagggttttgctgtgttgcccaggctggtctcgaactcctggactcaagcaatccacacacctcggcctcctgaagtgctggaattacaggcatgaaccacagcacccatctgagatgcctcacctcacttctaatcacagtctgggcacagaatgtgccctaggagaacagcttctgaataaacgaatgaatgaattcctccacctggaaccatattcaacactcttcctccatcctctcccccactccctctaattctcccattcacatttcttagtgtttctcaacatggtttttccactcccgaaccaaggtgtctggcttcctgccaccctgcccatcaacacaaaatcccatctctccattcctctcctcttcctcacatcagtatccaactctgcttccctcctttatagctaccctgacaggcagtgacttcagatgtcagctccacatccacttttctatgaggctttccctccgccatcccatctgacacatctcttgttccttaattccttcagcaaatagttaaggggcacagttaatgtgacaggtcccgtatgggtgctagggatgctgaggtggataatacacagctcgtgctctcaagagctctcacttgagtcaaagacagtcagttgtaggcactgagatctatacagggagtgctgcagttgcacagtgaaggacactgaagcagcgtggggaagctcctgaattttctggagctgagcgcaggagctgagacctgctaagcaaggaaaggcagtggactaaggctcacctccttccccagttcctcctcctcccaactggtgctccaggacaccacatcacaatgcatttgtggatattttcctcgggattgctctgaaatcatttttcactgtaagccatcttggttactaggctgtaagctctttgagagcagcaaaatcctgtttgctttgccacagtctctcctgtatcattcttccctactcccctaccccacttctctctctctctctctctctctctcacacacacacacacacacacacacacacacacactgtgagctctgcattgcccactgaatggtgagaaattcagaaggatgttgcattccctttgttttccctttcctccagctccaggccaggcttctgtcccttaggagacataatcccacctgggctgaagcaccccaggacgcaggcacttccctttacctgttcaggctacctttaccctctgttttcccaacacaggtagccacccagtaattactactagtcacagcaatataaaaactttattgagtgctttctatttgctacaacctattcccctgatggactgtcaaagctgtgggcagggattttgttctctgctgtaatcccagcacctatcacagtgtctagcccagagcgcacacttaataaatcaaatgaacacttaacatgtatcagtctattcaatcttcaaaacaacagtatgaggtcaagactgtgacacccattttggagataaagaaacgaaggcatggaaggttaggttatataagctgctcttgttcatgcaggaggtatgtgagggagccaggggccgcccccaaacagaaaacagaagcaggatgtcagggcagctggctggtggggagaccgtgggggaaggacagtgggaagaagggaagagcgggtgggactaaggaggcaggaggaggcagaagaagaagagtgagaccctgaccagagacgtgctgcctggggacctggggccgggaccagagcggagcagagaggaggggaaggaggattagcgagaaaagatttcaaaaaaagaggctctgagaagtctgaggagagtctggggagattgctggaagaaaggaatggtaggagaggaagagtataaggcactaaagagaggggaggtaggcgcagccttcagaggccgggcagggcagggaaaatctgcctgactagatgggcccaggacatctgaacaggatgattcccggaccaagacgtggaggacgatcaaggatacattgaaacaaggctgaggccagagaaagggacattttccagtgacgaaaacaactttctaccaacttccccaaactgaactgtagaataagaaaccaagggattgttgtttaggtctgtgagaagcagcggggaggggaagctggaggacaggcccagggacactgaccaggtgggggtaggactagctccctgggaaggctcagtcccacagcggctacctgcctagcagcaggcaaaagggtaaagaatgtccccaggtgagaggccggggcttggccagggcactggggacactgtccactgggttgccctgccccatccagtgtcccagcccattctcaaatacctcccaccatgagcatcccaaacccaccacaccagcccatccccactcctcaactcactcccccacttcaccagccgccaaaatcctgccctacagggtgtgctccaccaagttccacaggcagcctcgcctccccacggcccaacaccctccaggccagccagctgaccggagggacagaattcagaaccgtctggactccccgagcactaatcttcctactcccactcccttcttttccccgccaaatctgccccaccctgggcctatctcctgcccacattcccttggccgcccacaaacttccaccgctgtcaggggccagggcttccttttactctctccctttcaaacttctcccattcccctgcctcagcgcagcccctactccaaaaggcggatgaatggggaaccccacactggcagtggctgaggttaggacctgcaggcctgaggctggcgccaggaccaggcccgggcaggagaggctcggccccctcccggagagggcccacgccagccggaaggtgcctcgcccaccagcccactcttccctttgtccctggtctcaccagtggcagcagcaggtcaggcacggtggagaggcccatgccagacagctatggcctctcactcccccatttgggctcagggcagtgtggcagcggcagtgctggggcttcccgggactcggtctgtccaggacgtcccaagtgccttggggtgacagttgagggttgagactcgggcatagagatcacggcctggtcccagtgatcttgaaccccaaaggccagaactggagcctcagtccagagaattctgagaaaattaaagcagagaggaggggagagaaggtgggaggggaagagtgaggcagtgttgcaacagcgggacaggaagagctggaggag

SEQ ID NO: 2428 - DNA, 287832 bp, Homo sapiens
gtatattttgttaacatttttattggtacgtgctctcagtacaacaaacagcatcagtagtgtacactttgataaaaaggaatttttagcttagtagaaaagaaagcccaaaggtcagaagtataatgaatatgtacatctttatggaaactgtttgtgtgaccatctttatcttcccctgtggatgagatgtatgcacacacaagtaaactagagagaattttattctatgggaatttttaggaaaaaaaaaagacttaaggcttagggattgttttactatctggaatttgcctaatttgaccttcaaagttcttgcacaaagtagcagcaattctttagaggtatagagtcaatagtttaagctgttagtttacaacgattaaaatgcaaaagttcttgcacattctgtgctttgagaggttaattcatctacattttagtttgtataatatatttttagacagctcaggtactgacctcaaaatcattatgctgatatcactatctcctctcatgtacatgtaattcatgatgcacttatctctttcaaaaacttttaaaaatgtttctaattcacaatttcattgaacagctagctgagtccatacaatttaatgtttccttgaagggaaacaagtcatcaacttaatatcaactactaaaaatgcaagatgtttgcataacatcaaatttgttcagttttagcttttgagttggctgtagtagtttgcttaaaggtctctatgcacagaacaaagcatgcatctctaattatgtctctctagtttaccaaaatatgtaattgatattagtgtaaatatttagtacataaaaatactatcaagaaaaaaaatcaacttttaataaatatcttcagttctgaattctatgtacaagtactttacatctactccctggagagagcatttctggctttgctgtgagcaaggtgactactgacataaattattagcacattattgcagtcagatgcattgtggttgtgaacatttgaacatgaaccatatggaaaataaatatctcaaccatcgacatatgctttcttgaacctgccttcaaagccccaaagctctactatactcaaatatcaattctagactgatgatatttttctcagctaccaacatacaaataagttatcccaaaactttttcctttgcgattattacagtacattgagtataactgtttgtatctgtcaacaatgcgaaaattaaaaaagaacacacacacacaaaaacaaaggacacctcaacggtgcctactgaggtcctggaaagagggtttcagttttgtcttgcacgagttcattatttactattcgttgatccctgtgaccacaagtgtactaagacaccaatcctttaaattataagtatagaaggcaataggtaagctgatatctgtatatctatagcttttgtgtttcttttctttttctataatttacgtatcacattgttgattcaacaaaaccctttatattgtcagtagctgtaattctaacttctcttttgtaatactctgctttgaaaattaacctatagaatgtcaaacaaggcaatactcaacgacaggcacctagaacatccagaaatgtaatatagtaaacaatcatttgagaacacatctcttaaaataatactgatttttgcaatatacagtatttacacaacagctgcaaatttgctcatacaatatttctaatatagataaataggaatacaagtctaagaattctttgttccatatccaaaatttcttgttaaagtgtaaaccattggtatctctttttaatttttactgtaacttttctaaaacaaacaaaaagtcagctgatatgcacaattggttccagtcccttttctgcttcagagagcgaccaacacaatcttagcaacatatttttcttttgtaataatctttggtgatttcttccaatgaattctggtaaatgagtcaatgcagaacaaaaggaggatgaaagcaactagaaagtgagccagcactttctgttcttccaattacagataaaatgagctgacgatctatagagatttccactttaaacaagcatatgcaccatgggaagagagaggttgtccaggttttcctctggtttctagcctttttggttcactttctcatctttctaaggtggatgatcttgtcggacgtctgttgtcaatgatctttccatctttctttgaggttcttgcctgagaagaagcacctattgaatcactggctgcaaagaaggaagcagcagccatttgtgaagctgaactgaggtggaccctcttggtgggtggggaggatggtacggtgaccagtctcacagtcttacttcctgcttgctgagcactcctctggcgtaaattagcaccatcaggtttactgtttggcctgaaagcagcatatgcatttggacctcccactgaagagatgctactcaaagacatcttctttgcaggggtctctgaatgataaggaaccaaagatgtaggcatcactagagatctagggaggtcactagggttagagatgacatcatcatgagtttcagcagcttctagaaggtatggtggtggcagggtgctactgcgcttgctgcaggactcacaacataacttgttataacctggtatggagcagtatcgtgccaacacttccatttgacagaatatggacttgtctcccaaacatggttcatctgcaaaaataaaaagaaaataaactaacactagcatctaaacataaaataaaaggaggaaaaaaattaaaatttttaatgaatgtaaaaagatttaagtgcaatctgacactaacgggagtgatccacacgagcttttgcattaaaaatatgaatattagaatgaattcactaaaataagtagttctttgtctacaaagtccttgtgatgatcattattttaatatttccaccaggagtcttcagaccacagagggtatttttttctccaagtaggaacctatatctgattttagaatgggcaaagataatttatttaacgttgtggttaaatttttaggatgcaaaggggcatctgtatttttattttatggtatttctgactttctcagagggtactccctacattacgttaaaatgtgaaatcaaaataaatactaaacacttgtaaaaacaaaacaaatcttacaaaggtattctccaaagaataatcaaaataccatcttgatttaaaaaaattctccagtttgagatcgagaccatcctggctaacacagtgaaaagccgtctctactaaaaatacaaaaaaaattagccaggcgcggtggcaggcgcctgtagtcccagctactcgtgaggctgaggtaggagagtggcgtgaacccaggaggtggagcttgcagtgagccaagattgtgccactgcactccagcctgggtgacagagcgagactctgtctcaaaaaaaaaaaaaaaaattctccagtttgaataaaatagtttcatgtttatcattgaatattctcagattatttgttatttgaatgcacaaatttgggtaaagtatgccaaatttcttatgaataattcatggttcttacatttaattttattgaattgacagtactttatgtttaaaggatacttagtaacactcataaaatgtaatttcattgaattgacagcactttgtctaaaaattactaaagtaatactcataaaacacttgataacatctaaagtaacacttctaaaacacttcatactgcatgtgtacacattatttttattactttaaaattttattgattccaggttacaagaattggatttcagataatccaaatattaagctcataaaaatgttaacttgtgcatagttttagtcatcctgggtataccttatgaaataaagacatatcctgtgcctctctgataacagaaccagtgcatagagtagcatccctgcatatgtgcaacacagaaacactgatccatgcccaaagaagaaatgcaaagaactgtcaattgtggcatttatgtaatagaatcacttaaagttacagcctattattgggtaatactatactgctaagaaagaggcctgctacataactccccaaaaattgaaaaaatcctttttctaaagttagaaacaaaaaaagagagagtcagctggcgaagccaatagaggactaaaattaccaacattgagctgtaatacgatgtccacttcccaaattgtgaaatgactcatatatgcttgacatgtgcaggtctattatatggtataatgtgtctgaatacttcatataagctaggtcatcatctaattatgttatgaatgagcattatattaatgagtttcaccttaaatattttctcatgtgtgaattttttttgaaaacctgtatcttaaaataagaaaaatgtcttctttctgtatgtgtcaggctctaggtctcaagaggagaggacattattcgatcttgtcctctctttttcctctaacccctttccctcatcgcccctgttaggaggcccctcttagaagtacgacctgttttctctgagttagagaaggagtccaaccaaaggtctcccatgtctaagtgtgagcactttggcattgcagagtcctgttcataacctgggtttcattagggccagaatttacttttgtgtggaggagcaaaagggagagatattctgagaaaaataagagcaaaggaatacattaaccttatgggaatttgcctactgataaatgagaagagcttacaggcaaaaaaaaaaaaaaaaaatggtacaatcaatcaaaatatggagtcacatgaaaaaaatcaatcaattacaaaaaaattaaggcaacttttcagacttctcgttccacccccaaatcattataagaggttctggaaaagagattcacacatggtctcaaaaggccatttgattctaatagcagtttgagattctgatagaaagtattacttattttacttcaaatatggtagaaacatgtgaccgttagaactcttaggattgccctttgggcctcaattttagaacaacagaacaactaaaagggatatgaaatcactatgatagttaagctatcttattagctccctggttttatattcaaaacaatttcttctggctaaagaaggagaatcaagaaaattcttgctaaccattgggcacgtctgtagaaatgcacagctgtaccagctccaagatcaataaagcttacttacaaagtggcagcctcttaacaggaataactacataagaataaaatattctggtgacagtatatgttaaaacttctgagtaaagtttgttcttttggttttgatttgtattttgagctcttacatatgtcaatactttccaaagtaaaatgattaaatatataagtcctatgtctccctctcatggtcagatatgttcttgctataatatatttcagatgaaaatttataatgaagtaatttataagggttgaagacttaaagcctgaaaatgagcttcaaaaaataaaacatttgacaagatagtgctttgccaattttcttgacaaaaagcaccattcagcagatgtcaatattcaaacaatgtcttacttatggtgttggaggccaaggaaaaagcaacttctttaggcctgagtcttctaatatgtgaaaacaacgtccacagttgtcactgtcgtggctttagcagaactgcatttaagagaagggttgtggtggatggggatgggtgggctaggaaaacaaggcaggagaagaaaatataacggaagagagagtgcaacaaacagatgggggtggcgagagactgacttggggagagaaaatgagacaggaagagaaaaagatgtcagtggaggggctaggaagagaaagataggaggagaaagagacagacacaaggagtaaaagatggaggagtagagaaaaagaggctggaaggagaggaaaaaggtgggtatggcctgaatgtgtgcccccaaaattcctttgttgaaacctaatcctcacggcaatggtactaacagggtggggactttgggaggtgactaggccatcagggtggagcgcttatgaatgcaattcatgcccttataaaagagaatcaagggagctccctggcccttttcaccacatgtggacagaaaaacaaggcaccatctaggaagccctcaccagacactaaatctgctgatgccttgatcatgggcttctagacttagaactctgagcaataatttttttttaataaagtacccagtctcaggtattttgttatagcagctagaacagactaaggcagtggaggagataagagacagggagagagagagaggtggaagagatggagagacagagacagacataccaagttggagaggaaggggaggataaagaaagagaaagggagagggtgaaggggaggacaccgagaaagagaaaatgggagagaaagggagacagacacatggaacaaggaaagaggggaaagagagagccaggaagaggcaggaggagagagaagatgagagggaaaaagaatgataggaggtacagccagggagactaggagagggagagggaaggacagcaagaagaaagagtaaggcctcgaaaaagcatgtgtggctgacatagaaaatgagccacatacaggcagcaggtgacagctcatcagagacagagcaagacagacaccaaaaataagagagagacagaggacagcaaatggagacacagatgaccgagcacaggacagacagagatgtggatagagagctatggaaatggaggcagaaggagacagtgatagagcccaaaaccatccaatatattttgcttgttttatttacttatgttttgaaatggagtctcactctgtcacccaggctggaatgcagtggcgtgatctcagctcactgcaacctctgtctcctgggttcaagcaattctcctgcctctgcctcccaagtagctgaaattacaggcatgcgccaccatgcccagctaatttttgtatttttagtagagacagggttttaccatgttgttcaggctggtctcgaactcctgacctcaggtgattcacccaccttggcctcccaaagtgctgggattacaggcatgagccaccgcacctggccccattttgctgttttaaaatagcaaattgactaaataaagaaaatatactctgcttttgccatacagcaagttggcaggtcaggcaaatgctgaattttatcctatgtgcaaggtgtctgtttgaagttactctatggacagacagttattggaaatggctttagggttgagtaacattacccacagatcaaaattgaataattttagtaaaatatttcaaaatctttgcaaaattatgcttttaataaagatgtgaagttatagttaaatataacaaggaaaaattaagtggttcctattagcaacacaaattgatagacgttacatatacatggcacagccctcactccaatgccaccagccagaaatggcagggctatagtgatcatgataattaaaaagtgtaggacattacctcaaatgctgatcttaaagaactgaactggactaatatttcacaggtgttttcctttggttatttatcagtaaacaaatataaattctataacttctctcaaaaggaaattctgctttttgaggtttaaaaacatcagagcagtgaagtcaattggtgtgacacctaccattacaaggaggcagttgacaggctctgaccgactcaggcttttcaccatcacagtggtccccagccctgcagaggacctgcctcacctccgttccttcaccgcaggtcactgaacactgcagagacaaaggctgtggttacagacatttattgcaccaagaccatgcacatacacacacacacacacacacacacacacacacacacacacacacaaagacacagagatctggagtgggttctctattaagtaatgctgcacagtggttttgaagacagatactactgagtttatattctgactccattatttaccagcctgggagcattgttttttctacataagattcaccttccttatctagtggaaagctgggataataatacctgtcttataagattgttttaggactaaatgaaggcaaaggaacaaagtgtataaagcagtaacaaaattcctgacacctagtaagcatatcatatgaaagaagccatgattaataacaatggtaacatctgctgtagtttctaaatacaatgttgatgatgtctgttctcagggacccaatcatagtattgacagtcctcacttctttcttacagatagcagaatttactgataagttgccttggatggttaattcaacatccttggaactactatttctctgtgctcttaagttcatttctctaatgaaaaggtttactgctctaaaactaagctcagaaagttccatgtaatggccctaggaaggtgctgtggaggagggacttctactgagactttgatatgtgttatcattatcatcctatgtgggtgacctgcacttgtactatggtttgaatgtcccctccaaaactcaggttgaaatttaactgccattgtaacaatgttgagagggacctttaagaggtgggacctttctgaggtgatttatgggcatgggttaatgctattatcttgggaatgggttagttattgcaggaatgggctactgatagaaggatcctctgtgtctctcttgcatgcctccttgccatgtgatgccttcagctacaggaagaccctctccagatgccagtgccatactcttggactctgcagcctccagaaccatatgccaaataaacttttgttctttataaattacccaatctgtggaattctgttaaagcagcaagaaatagataagacaacttgcttgtttcttcctttctgggcttattctccacttactctttagtcttctgtctgctttttcatgccctttcctcctataaactattctcctatgaccccaagatttcttattttgagtctttagaaatatctaagacaggtggtaatagctgacaatgcaacattgagtcagccaattagcaaacaaacatcatctggacaggtatgctaggcactagctgagtgctgaggaaacaaggcatactatttttgagaaatgtgtgtactagtggcaaatatagattcaagaatcagagttataatactctgtcatgaacagcatggtaaagttaagttgtactgcatttcagatatacaggaggaactgccaggaaaggtaccacctggaaggtggtcatttggactacggagatgaggtttggtggagaaggagagattatcaggtaggaggagggggagtacaagtcagctgaaaggtaggaggctcaaacaagcatggtctgtttggaacagtgtgaagtttactcgaactgggacaaagagttggaatgaagaaagaataagaggagttagtgcagtgccaaatggtgctgggccctgcattcaatatcaggggtttggaatttatactgaaggaatagggaagtcaacaaaaatattagacaaaagaacagtcatctttcagacttcttctctatgttatgaaacacataaacatggtttgcccctaacatgtactgtcttaaagcattaatttttcctaacacctccaggtaattacaaaatatgcagtagtttctcagttcacacaaagcctaactgatgtttaagccaaattaaaatatctacacatgcttacacacacactttacttatgcatgcacggaattcacacacctacctcactccagggtcctgttttccactgtgcagggcagggcactctgttacagggccggcggctctcgggacggtcacccatgcagtatttgctgtgcacagagcggttggtgccatcaaggagtggctgaaggcagcgtacagtgcgaagctgatagccagaacttccacaggttttggtgcagtgttcccattcttctgctacccagctgtgggtgcggggatttaatattgcaattatcactggtatgtatagtgtacacatttctacctgcaaagcctagacttttctgctctctaagtgacttgcaacctagtgggcacactgcagttcaggaagtggtttcagaaagatggatataatggataactttttaacaatagtaggctgaaacttttattttattattattatactttaagttttagggtacatgtgcacaatgtgcaggttagttacatatgtatacatgtgccatgctggtgtgctgcacccattaactcatcatttagcattaggtatatcttctaatactatccctccccctccccccaccccacaacagtccccagagtgtgatgttccccttcctgtgtccatgtgttctcactgttcaattcccatctatgagtgagaacatgcggtgtttcgttttttgtccttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatacgtgtgcatgtgtctttatagaagcatgatttatagtcctttgggtatatacccagtaatgggatggctgggtcaaatggtatttctagttctagatccctgaggaatcgccacactgacttccacaatggttgaactagcttacagtcccaccaacggtgtaaaagttttcctatttctcaaataggatgtggctgaaacttttaatgccctatttttttctgcctctcagtgactctgaaatcttcttctttcctaaaggatgatctacagagggtttctgaaactcatcttaaagttgccctgttagattcaggcatgaaggcagttttcaaggatagcaccaactcactctcagttacattgcctaatggtgttaaacatctgacagtgaatctttaaaacagaatccatctaatggttgctaagacacacttacgatttctttacataaccttctgttttcactatggtttccttctctcttggtcatgtctattatacatagttaaaaatctggttcacattctacagaggatacacctcatgtctttttctgggttggacgagggcacatttttataaaatctggagagttcactcatgtttaaatattttaactgatatgactgttttatttctacagttgttgctatgaaggctacttgacatatctatactgtttggataatgcagttcttcttattggcccttactgggcctgacaagaggtaagggtggtgtgcattggggctgggtaaaaactgttcacacaaatgcacccgatagaaacatttccagaggcattttccaaaatattaaccaggggacattcccaaattctaatgtcagtgtcagtgtcccaagcactctccaaatcagctgtggatacaacattacacacagttctccagtacacatggttaccaagtcccaaagggtggtcaccattgactccatctggttatgcaagctgtctgtatgtaattcaggctaaaatggatttgccttttccaaagttactttccctctgcaatttatttttctttccatatatatgaggcaccaaaatataaccatgctaaaaccttggcagtctttggtattcacagtttaagactgctttagcttgtcaaactggtggtaaaatgaatgtctcaaggcaactggactgaggaattttgctcaattttgaagacttcagtgatgactctcttttgaagacaaatattatacttcacagatataggtacttctgattacctccattccctcctaagatctcagaatgaaagtaaatgacaaaaatgttataaatctagaaagacaaagaaatttgagaggaagtcacagcaacataattttggaacctagaagacagatggacatatggaaactaactcagcagatctaagaagaatgaagtccaactcagcagtacaaggtgatgagcaaactgacttgcactgtagaactttagaaatatttagggattagaggccttagattcagtgtgagctgtgaaaacaagggtgaagccaagactgaaagcaggataactaatgaaaagtctgtttggaagcagttagacctcctgattcttaaccatacagggtgatttgccctcctccaacgcagaagacatgaggtttatcctctgtagaatgtgaaccagacttaactggatacaatagacatgatcaagagagaaagaaaccacagtgaaaacagaaggttacgtaaaaatccatctgtgaaatggtgagatcgctttagaaacctatacacatttccagaacagcctttaaactggcttacactccctaggcaagaaattgattctgttctatggaatcttttttataagaaaaacactaaatatacaattaattgaggctctttcaataaaatagctgagtcagatcaccctatagttgagcccacgagccacgactgtaaggcaaacttctaatcagccttctaaacactgcatttttatacacgtatgaacatcccaggattaccacatagaaatcctctaacataaatgatggaggtggagtgggtgtggagaagtggaagaaaagaactcaaaagaaattacttagaaacaggaaatgaatccttgatattccagaagagataaaagaatacattgcatctgtgaaataaaaatcaaatgccttgaaaaagaaatacttgaatagatctcttgaatattaatgatatgatagcaaaaatgaaaggttcggcaagtgcaacaatggacaataggagagaaaatccaagctactaatgtcccagaaagaaagaacactgaggaacacgggagaatttttttcaaaacaaaaaaaatacaagaaaatcttccagagataaaagatatacattttatttatttaaaagtttgtgtcatttgccacaacatagatgaaactggaggaagttatgctaagtgaaatgaatcagacacagaaagacaaataccatgtgaccttcacttgttttctagattccatatgtggaatctataaaagtggaactcacagaagtggagactagaatggtggtgattaggggcttgggtgagggtgaaggagtaatggaaagatgttggtcaaggggtacaaagtttcagttagaagaaacatgtttttgagatctactgaacagcatagtgtctatggttaataattatgaaactgatatttcaaaattgctaggagagcagatttgaaatgtgtgtaccacaaaaaatgataagtatgtgatgtgatagattggttaattagctgagtttaatcattccacaatgtatgcatacatcaaaacattacatcgtaccccataaaaacatacaatttttatttttcaattaaaaaactctataagtacacagcacaacgatgagtaaaaatgagcaccaagtcaatttcatcactgggatttcaggacactaggaacaaaatgacggtcctacaaactttgaaagacaaagagaccaaaacaggtcattgagaaagaactgagaatcagaatggcaactgacttttcaacagcaacacttgagtgtagataataatagaacagtatttttgagtctgagggatgatatattatagtttggagtaacagtaaatcccagagaagagaaacgtagtaggaattccaaggaggatgatgaaaggaaaccctaggatgaaagctggtaaaaagtccaagctggagctggaacacagagaactctctgttctctaagactcttccatttctatggagactaaagtgacaggatacttggatgtttagtattttgaggggattgatactgagaaagagagtttgggaatgaattagggaaaagtagtagaagatcaaatacataaaatcaaaatattcatttattctggaagaaacgttacaagaaagaaaccataataatcaatgcatgctgtgtgactcaggtattaagagagatacatgttaatacaaaccctgaatattgcgatcagtaaaaggtatgttaggtcagtaatgggagtagcagggaaggagaaagtgtggcctctgggtgtgcatttgcggagtggtcataaaataatacaatcttcagatttcacagtgaaaattcaatgtataatgtctaacccacctcccaaaaaaagtcaaggaatagaagcaaaaacatttgacttagatggaagcaagtaattaccaaatatcaaaataaatataacagttgaaagtggttgtttttgaggaacaagaatgtggtgaaaggcacagaactgcagctttatataattcctgtgaagtgacttgactatttaaaccatgtctatatagagctttgactgaaaataaaatcaaaactaaaaagagctaaaggcagtgaagtcctgattttgacctccagatatgatagttaaaatagatgcttacagtggatgtgtacactcttgaatattgcacattcgtctaataggtttcggctttttgttggcctcacagaagctgcgatggaccattttattatcacttttcctacggcatccatatttagtgtactggaaacctggaaaaggaaataaagttctttggatttaatcacttcttcatgctgatagttacttgattattcacttactcattcatacatttattcatccattcaataaatatgtattgagtgcatacaaaccggcacttcaataggtgctgaaggtcccaaagaacattaaataaacaaaaacttttaccttttcagagaatacgtttgataaatattgcaactgcatgcatgttaaagaactagactctaaatatacacagtctagcatgagaggtagatacgaaaaccactgtgacaatacttagtgacataggcttttagaaaactatgtaaataacttacagtagagggcaccaaaggaacacagagggaagagatctgtaacttggaggggaggggaaagcttagaggatcagtacttttcttcagcagaatactgaagttcaaatagtatggggtaatggaaatgaagcagaattattctccaagcaaaggaaataacgtgtgaaaaactgcggtttcttcatgtggctagaggatcatgtgtgaagagtgcacgagttagggaaggatcagatcttgaaagccttcagtgtctaacaagtttctggacattatcctgaaggttatagggagttactgagggtctctcaaacatcaacttttatatttgtaattatgtatataaatttgaaaaaattcaaacctatccaaaagttgtaagaaaaaacaatatttgtataccttgcatctagattgatcttttgtgactatgtcacatttgctatatttctttatatatgtgtatgtgtgtaaatatacatataattttgctgaaccatttgaaagttgaggacatcctgatccttcactcctaaatacttcagcacagatttcagaagtacattctcttatataactataatataattcttaaaatcaggacatttaacatagacatagtgctattatctaacatacagacctattcaaaaatgttcagttgtccctatcatgttatttatggcaatccttttccagtcaaggatcatatgttgcgtttaactgttatgtctccagcctccatcaatcagaaataattactgaacctctttttgtcttacggcatttactagttttgaaatttaaaaactatttgttttataaaatgttccgaaatttgggcctgtttaactgtgttctaatgatgagattcaagggattcatttttagaaagaatgctacataaagtgatgttgtgtcttcagggcaacatgttagaagactgaaggattttaatctgggaaataatataattttaccattcattcatgcatgcattcaagaaaaattaccctgtaaattaaggaagagaagaacatcaatattagttgactagttaaaaggctattgcaataatcgtccctcccaaagtggtgactggagtctggtgaagaaggaatagatgtggtagatatgaagaaggtatatctgacaaatattatgaccaagtaaatgttgagagtacagcagaagggagggtccaaattaaataagcatcttgtaatggataaagagatgtcatttaaaatacttaactattgtattcttccctcaagaaaacactttagaaatacagccttgaacttaaaattataaaataaataatttacacaagcactgcctaatacaaattttgttctcaattatttgctgtcatttttgtaacagcctcttgccttctcctgcccatggtgggaaattggtaatggagcacttgtttagaactagaggaatggatgatgggagaaattgagagacattaaatccagcttaatggactctggagagggaacggaggcagcacagtgcagtgagtgagagcatgtgttcagaagccaggttatctgggtttgaatcctatgggctctgggcaattatcttctgtgtgcttcagttttgctaccactttaacagagataacaacagtaccaactgcgtagggccattgtgagtattcatgcattgatatataaagcatttagaacagtatctggtttcaaatacatagcatagtcagttacacagtcatgtaaccaatagctcttttgttattaactctggtagaaatgcagagagatacagaaagcaaaagtaggtaagaagaaagatgaggaccagagtacactgaatttgggagagttttggagtttgggaagaataaagtgattaagggtaccactacagtaaatgcaagacaaaggacctgagagaaaagggcaagaggattttaaggtctgtcactgttatgaaaggaatcctatgatttggtgattctgagatttcagtaaaaatgttttgtattgatgttttgatggttatgtttggtgtttctcagattgtggcctcgattagagacagcaataaaggtagaagcaagattggtttttatatgcattacattttaatataataaatgtgttcaatggttacctccaccacagggtttggaacactgagaccagctcttcaaagcccactcaaaagtatctaattcttcctggatgacattgttgctgttgattgtaggtacagagtcttcatggatgatgtacttatatgtcaggctagagcgggtatcattttcttgaggtataatctaacatacacatgaaatcaatatgtaaatcacctgagggttttaaattttgagtgtaaaattacaaatatttcagaatattgctcttattaaaactgaaaactttcaaatagtttcaaaaattataatgtttttatttctataaaccatagtgcaaatgtgccctgtttaagaaaaagatgaagtatctataaaacttttaacataaaagtgttaaaaaatacatacactgaggagtaagagtttgtattataaaaataataactttataaggttcactgtaggtttccttaaattatatcatctcctttttaaaggattttaacttttaagtgtaaagaattataattaaaattaaaggattaaaatttttaaattaaaatttttaaatttttaaattttttgaatttttaaatttaaaaattttggtgcattttaaaattgtcttcaacggaaattgttgtgttgtgatgataaagatagtaatgttccctccagaaaatatatacattatggaaaaatagaaagaaaacgaaaaatcataattctacctaactagagaaaaccagtcacttttattattgtgatagtccctcaagatatttgcattctgtgtgtgtgtgtgtgtgtgtgtgtgtgtgtgtgtgtgtgtgtgtgtacagacatatttactttcctggctttgtttatttcatgtaacatgcacatttctcaaaatattctttgaaaacatgcttttggagtgtggaatgatggtcattggagactcagaggggtcagagggaatggaaggagggctgaatgatgggaacttgcttggtgggtacaatgtgcattgctccagtgatggatgcactgaaggccctgactttaccacaatgcaagatatcaatgtagctaaattgcacttgtacaaaaaaaagttaaaaaaagaaaatatacttttaaatgtcagcatagtctgtaatcctaaaattgttatgtattattgttaataagtgtgtggtaactcttcaatatttgttttcattagaaattttcccaacctttgtggggatttctggcgtttcttagtagactgaagggaacaaacactttttataattctagttcttctgatagactggtgaatggtcctccggaacagttagaacaattgttactttaataatgagagtgtatgaaagtggccatttgacactacatgttacataattttcacctttattaattggatgggaaaaatatcatgattttagttgttatttatttgataactaataaagtttaattttcctaagtttattactcacatattttaaacactgtacattgcatgactgtcctggtttttattggaactgtacacattttttctctcctaatctgtgcactaaagatatgaattcctttttgtaatatgagttgcaaatattttctcagtttgtctcttgccttttaattttgttcagggcaaagctgcctttaaaaaaattgattttcatgtagctttcataggattttactgattatgcaaagagagaaatgtgcaattcattggtattccaaactaaatttttagaactaccttttgtttgagaaatgaggtgatactaaaatcagtgggggtagaggatctggttatctggcttttattctcttttttctgtctttttttttaaaacagcattaaaaatcaagcaccattcgaacaacccttacactctagccagatatctaattctctttgccccagacagcctagccaccatgttccaggactcagaatggaaaagcaatgtcataatgatagaacattgcttgtctacaccctcatctcctagctacaaatctccctcttgtacctccagcccacaccacttgctgtggtcagattataatcagtgggcaagtcttgaagcatctatcatgatggttaagcatcaggtctctaaagccagatactcatgttgctagaaaagaatacaatgtaattatatcagcatgaaatacagcttctggcctccaatcattcatatttaaaataagctaaataaaactttgattaacatatattttattatggaacaggatgagagtctagaatagacccacataaatgtggataattaattttgacacaattgaaaggcattttaataaaggacagacttctaacaaatagtgctaaaacaactggacattgtgatggtttaagaaatgtagatacattaggtaaaaaaggactgagaattccgtctcggtttcactgtcccatgttctcgctcacttgagtcacttgctgtagtggaagtcagtgccatattgtgaggatgtataagcatcctatggagaggcttaagtggtaaagaatcatggactgctacccaccacatggaaaagctggggaacaatcatctgaggcctttcagcaccatgtgactaagcttggaagcagagtaacccccagtcaagctgagatgactctagccacagttgacagcaaactcatcagatactctatgccagaactagccagttaagtggtgtccagatacatgttccacagaaactataagtattgcttgtgttcagccactaagtttgagggtaatttgttttacaacaatagataactaatatagacatccatatgcaaaaataaggacctaacacttcatacaaaattaaccccaagtgatacatatacctaaatgtaaaatgtataactctaaaacagttaccaaaaaaagtaggagaaaatgttttgatgctggattagacaaaaaaaaatttcataacaccaaaatctttatccacaaaagaaaacattaaaaaattggacttcgataaagctaaaagattttgctctatgaaagaaactactaaaagaatgaaaagacaacctatggactggaataaaacatttgcaaatcatgtatttcacagaggacttgaatatacaaagagctctcgaaactcaacaaaaagaaaatataacaactttaacaatgggcaaaagatttgaacagatatttcaaaatggaactaattttcagagaagaaaaaccctaaaaattgagtggagcaatttgacttaagtataatattttataggaaatccaataaataaaaattctgtataaaacagaaactaacaataaatttcaaatcaagtagctgtcttctgctttcatccatgagggagtaatggagttgccgtcttgatattaaaagctataaaactgggcaaaatatttgcagaaactttttttttttgtttggcaatgtatgtcatgacaaaggacaccaatccttgtaagaagagaaacaagccagatcttattcctgacaagggccaggttctggacctggagctagattagagtttggaactttcagagccggccactaaagaggggcctgcttagagagatcacctagaaatctacatgggtccatgactgagggttggtctgtgtatgctcaagccaagacaccaggcagtccacagtgggagtgctgggggtgggacagtgataccagaaaccaggcagggctgagcctggcaccatgaaaggccacaccatgggaagaaggacaacactgaaatagactagctgtaaggaagaataaaactaggccttaaaggatcagaatgatctgacaataacttaaccgcctgccagaacaaaaccagacaccttacaatttatcttccaaaatgtcgagtgtacaagaaaaaaagaagcaggaaatgtgatccataaaaaaaattgacaatgtgaagacccagaacttaaagggtaacttagatgtaatgagtgaacattatgaaaaattcagccgaaaaatggaaataaaaaaaaaaaaagaaccaaatggaaattctataaaagaaaagtgcaccatcggatacgaaaaatttactggataggctcaaggacagattggagatcacctaagagaaatagtgacttagagctcaaaaggaataatccgatctgaaaaatgtattttaaaaaagattataaaggatgaacagagcctgagacttgtagaacaatttcaactgatttaagtgagtcctaggagtgaagaagagaaagatggggtgggggtgagggtttgggaaaaacaactaactagaacacatcatgggaaatttacccaaatttggtcaaaaacatcaacctacaaagccaagattctcagtgaaccccaagcataagacatacaaagaacacggtaaactgagtatatcacagtcaaactgctaaaccaacaagacaaaacaaaaagatgaagagaaaaatcttaaaaagcagccagagaaaactgacacattacatgcagtgcagcaatataaatgaggcttctcttcataaatgatggattctggaaggcaagtgctgtataaatgagtaaaagagggctcctgtatattggcccctaggttctttcttcacagcaggctgaggctgagatctgttagctcaaaagccctctgatgccaaacacaaacttttatacatccagttgtttttaacgctgcccaaatgagggagttttagccattcagggactgcttgctttgcacagctctaggaaactacatccaacatctgctagatatgaataagaccttctggctataaggacctcacgcagctgcctcccttggagccctctgacccacagactctcttctgtgctgctgaatgacaccacctaggcacataaaccacctcagattcccctctttctcagaagttcccttgcccttctctcctctaggtagtggccccacttgcaaaccagctgaggcctagcccaaataaagtgtgtgtgtgctactgccaccttgtggccatatatttttctttgatcagcccccaaacccttggaactcgctgcaagatcataaaaacacagtgctgaaagaagggaaaacagggaataaaaaaccaaaaaactagcaactcaaattctatatctagtaaagatatccttcaaaaatgagggtgaaataaagatattttcagatcattgacagatgagagaattacttgccaatacacccacaccacaagaaatgctgaagatctttatattgaaggtaaatgatactagatggaacgtcagatgtacaaagtagaatgaaaagcatacaaaatggtaaatatgtgggtaaatacaaaaatctacttttagtgttgtctttaaaagatgataactgattatttaagtcaaaaatcagaatgctgcattattcagtttataatgtctatataataaattacatgaaaatattgcacaaagagtggggggaaagataaatggaattattttaaaaagcaactcatgtttcaaagttcaaagtacacttaatgttcaaggtaaaagtgttttcagataaattaattataaagtaagctgagctaactataccatgagcccataatgccacataccaaaacaataacaggatcatgtaaaggtccatcggtgtgaagactttcaatgtcatcttcaatgttataatcccactccacaccaagatctatgaaggtccgcgacttggcttcctcccctttgccatttaaaatataatggcctgtagcctggttcttaatagctaaagggagaaaaatgagtaaccagcatacattttattttatcatattaagtgctgaagattcacagcaagtatatcctttctacaaatcaatgaccatgtttctttattagtagcaaggaatcaaaatgggtgttagttctgatattatttccattgtcttgattaggcattcaaaactctcaagaagcattcctaactagtcaaaaatacagcaagatggttaaataggcaaaaataatgtttgcaaatattcccatttgaaaacatcgtcaaagaggttaatagtttctaaatcatttatcctatatatttccttagaaaactgggaatatcttgaaaatgatagctaccttttcaataattaatagaaacaatttatgctaggatagcatataatgtaacggttaattattgcatatattttttaaagttggtcaaaatatttatagtcatccaacatagttgaagtaatttttcaggcaacaatttagttctcatgattgtaaaattccagagccatatcacctactcatatagttagaaaaagctgcttactgctaatggaattcttaatgtagtatatatttattacatattatacaatgaaataaaatgctggcttaatgagtaaaaaataatgaatgggattttaaattttagatttgtttatcagcatataatgttacattagaaagcaaaatttcatgttactacaattattgaaaatgtgtgaaaaacatgagtaattttaattaaatgtatttattcctcttgggctttaaactggtctattttttccaaggacattaatatgaattctaggatgaaaaataagggattttaaatgcttgagagagaactatagctgactgctagactattacgacatttagtagtgaatataaattaaatgtgtttaaaaattctatgaaacaccataaaacaatgcactttttaaagtcacaactgaaataaaacaatttgctacaaattttcatggagttgatacgtgatgtcttagcttcagaaattatcttagtgttcttataggccaaggaataagtaagttatgtttacacttgtctatacaatttaaatgtaaacctctttaaagtgacatttccatgtaatcgtctcataaaagaaaaaaaaatcttcttgtggaaattataatcagctctccgtggcaaatggatctgcatgtgccagtcaaaaacctgacacatgtcagatattagaataatttaagattagattagtaaaattcacctgtggttgcttttcaaagaatgtgaaatacaataaaaataaggatacgtacagtattggatcaatcaaaatatcagaacttatttgtaaacataagtatgatgaatttttctgatattccttgatttagtggattttattaacatatttattttcttattccttagagcaaaaagtgtataagaaatataagcttgtcaaatgatttttccctcatatagttaggaaccaaccccagtttctatacaaaattaaagctctactttttttatgtttcttgttttaaagtaagcatagttgggagaaatgaccaaaaaaaacctacataacattcaattaatgcatttatatattattttgattcttacatatacgtatgcacatgtatgtacatatacatatgcacatgtacacacatatacacatgcacatgtacgcacatatacgcatgcacatcatgcacatgtacgcacatatacgtatgcacatgtacgtacatatacgtatgcacatgtatgtacatatacgtatgcacatatatgtgtacatatatacatatctatatttaggatttctttgacatttcaatgtttcagtgcatgttaaagcagagacagcagacagaaacacttaccaagaatatgaggagaagcctcgtcttcttggattaacacatgtctagccccagggggtatatcaaacatcttaaggtaccctttgcatgtgtagtaaatattgtaggaagcaaagaagaaaacaaaagcaacaaccatggttagttgagcactacattcttactgcttctgcgtgcagaagagggcatccataaatttaaagaagcagtttcggaaattaacttcaaagcattggtagcttttgtgacatccaacatgaaattagaggcaacttttttttttattaaagagggaaaaaagttaatcttgttaccaacgtattagtcacttatcttgcgttgaccttcaaatgatgtgaacaacaattcaggcaaatactatactttcctgtgtccctctgtgtgattctagttttctaaaccatccttttgaagtggagtcaatttttagtgaaagttcacttaagttgtaaactttttgggatatgttatctgcttacatgttattttaaaagtctaagagggaagtatagacagctaaacttctaattattaaaatattttcatatttaaagccttctttattctaaaggagttacaacagaaaaatcagtgctttcatttttcttgtgatcagtattaattttaaagctttaggcaagttttatgatgggactattttaaccaaatcgacaacatggattttaaaccacttagttggaaaatgtgtgcaagatgtgttatgcattgcctttatatgcaccctaacctcaaaacctcctaagccagaaataagaaaatcaatatgcttaataggttgctttgtgttttaaaatcatatatcattcctattactgtaaatgtcatatatcacatactatgttgatactatcacatgtcctaaaaattatcttacaatcatttagaattaagattatgaccataaatcataaatattatgacctgacaatagtcaggtcaattagaacagatgttatacatctcattatcatacaaataaatgaatataaaatgattatgtaacctacaccttcaatacattatgaaacatccaatacatattctatggagaatattaacagaaatccagttatcaatccacaattattgatgaaataagaaaaaacaagtgtttttgtcatttgtatatgtataataatatacacctatgaatagatttacctaagtttttcacaatatttattagtgtcctaactaaataaagtggtccttttgggatcagggtgttcagcactttagcctggggtaaagtctaacacatgaaatgtaccatgtttgcctgagtacacagtggctaaaaggaacatgcttaagatgccaagtacagcaaaacagcttgatgccatttatggatgcccatctttctgcagtttgctacaacttacccagtacgtttttagcttctcttgtttcagcaagagaaatattacgagctcctttgggtaaagtgaaagcgcctcttgtcttcccttaaatagaatgtctttaattagtggagggttcatgtttatcaaagtcttgttgtttcattgactatcccataagtcacatattttattaggcaagttataaaatatgttctgtaagtttatgtgttgaagtcacaatgcatttgtaatagataatgccaataaactgttaatagtcaatgaaagtaagactaagcatgaaagtaagactaagtagatgatttgaagttgaatacttgcagatttcattttccagcaacttcaattctttatggcacctcttgcttaaatgttttcctgttggaaaaggttaattagtctattaaatcactatgatgacaatattagtgcaaagatatggaagttagattatctttgaacagtttgaattggtatgacagatgaaaattttctaatgttcttttggccttgatttgcaagtttagcatgatgtttgaactctctgaaaaacagtaccaataccttatattatacataatatacaatgaatgaacatggcaaaaccttttctttacattattcactgtggaaataaaacaaaatgaattattttacatccaaaagaaaagaataaaatgtaactccaagaaagcacagtatattatttcacagcaagatgaagaaaattacatttgactccactgaaatataatacacgtatataattatatttctctttgctttaataatgcaatcagtcagaaatagcaatatttgctttttaacaattttcaaagtacaaaacatggtaatttataacacaggaatagcaaagacatcagtaacaagaaaaacattagaatatagtctcctagtaattgagttaggtatcaggggtataatgggaataaaaaatacaaaaactaagagaattatttcatttggatgaagactaacttttttataaaaggaaaagttaccccaatgacaatttacttaacgtaaaccatatttctttgtttttgttttactttcatgattttataagataccaacggctctttggaagacatcaaaatcttcttgagcaaacaccacatcaaatttatctttaagtgctgaattcccagaaacatttgccaaataaatccttattgaataactgaatagtatctgatacaaactcaagaaattattcagtaataaatgtctgtatacaaatcttttatgaaaattccaatgaatattattaaactatggataattttgcctattatttgatgcatgaagacagctttttgttccacctttgaaccttcagtgtatgtctaagttcaagttattgactatgtaacaagcataaacatttatagagatgagcaattacatctcaggttagtttttggttgtacctcaattttgtttaaagtaaatttttaaaaattatgtgaaatacagatccaagattcctagatttataaacaggataaaattgttcacttttaaaataagtaaaactaatgtgatattttaaaagttgtatctaaaattttgtaatttttaaactcctgatcaataatttatatgcaacaagaattcaaaataaacaccaattctaataattcaatctgcattttattaaaaatgcaaaataaaacacagattttagctagctagtataactgatactgattttacttgtttcttttctaaatttagtatgtatttttttcatcattgacgctagggagtatgaattcattcaaagtgatttcttttttttttttaagttccttaaaaggtaatctgaataacaataaatcagcagctaaattttgattatgtttatagagaaaatgctgcatttctaaaggaagaagcctcaaaaagtacaaatcacagagaagaatactaaatccatgagagacctcatcttaccaagcttcctgggagttctggtaaatgtccccttcacggttcggcagtgggaattatctcctccacagacaccacacttatcctcaaccttattagaaccaatttctttatcacagcccactttctggagagagaagatgtcaaatgtggctaattttagtgtgcccagtagtggtcaacatcccagagaatgatgaaccctttgttcagtcatggcccacagtcagccaatttatagcaaactgccactgtagtcataatttttaatacctcagttttttaaaaaaaataatgggaaaccaaatgacttgtaccctaagtaataaagaatatatttcctccagtccaatgaaatatttacaccattttaaattgtcatagtcatcaaacacacatgtaatgaaaacagatgtagctgatgctgaggagacaagaaaacaacaagacagtgcttttcccttgctgctctcacatttatgatgatggataatatagtgagttgtatattagtgcaatctttaaaagatggttatgatgtgagacaaaacttcaccagggtggtgaagattttcacaggggccaaagaaacacagaatagaaaagcatttcaggaaagcagatgagttacaacaaagccagagaagtatgttcatggaaagtgggtgcagaggtcaatatctaaacccatatttaaaccaatggaaggttagtgtttcatgataaggaaagaacagtgaaaaatctgcattgaatagactgcagaagacttgaataccaggaagaatttacattttcccttgaaacaggaaaatattgaaggttttctgaaccaaggcatgttcttaatgtaaatcactgtagaataatgatacacaatacactactgcactcaaaagtatgggatgaaaggtggcagggaaaataaagacaacacatacgtttaatgtactaggtactgcggcaggtaaaagctgaacaacacatactatgctttcaggaaaatgtaagctcaattactttagactcattaatacagcacttcagttttgatgaagtataaaggaaatatatgttaggagcagtgtttcagttaataagataatttcatatcgatttaactatgaacacaagaaataaaatgcatttttaacctgagattaaatggagcaaaaaaacatgtttgcttctctactacttttgttctaatgtgaaatttagcctttaaacttagaattgattggaaggtgagaaagaaatgtcttattatctttacaacaaaagattaaatatacttagcactgattatttttaaaaagaccttgtattttaatagcagatggctactaaaatacccgaagcaaatgcattattaccaatttgtattcccaacctagaggcctcagagttactcagaaaaggcatttggctggaaattaggaaaattatttaaaccttgattctgccagtgaccaaagtttgatttgagaaagtacaatgtctctcaaatttattttagctattgaactattcatagacacttactataatgtgatttcaaagataaaatagtttaaaaaattaaaaatgtgcagatgaatgacagtaaacgtagataacgtagaaagcctttggggaagcaatttgaacttaccacacactctcctcgcacacatatgctatatggatctttgtaagaacagtgcgttccatcatgcaccagttgtttcatgtaagcaacatctccagtctccttggactgacagtaaaggtggcatcttttcttggctgcataagatggaggataaaattaactatttacataaaatggaatgtttgaacagcatagtttattttatttttaaatataaggtttcactgtgatttcctgaaaacaaaaggaataccgtataaacaaataaaataaggagtaaggaggaaagtatgtacatttgacattttttttttagctaaggtgaccataaaatttgtcatctaaactagaaaaggggttctagtaataactgagcaggaacaacaggtataaactgggactgccccaggcaaccctagatttcaacatagctcttaaataaatcttaattcaaaaccagtttagttttcgtaatattagagcactgaaagaatgtctgtgatttgactcaatcatctaacatagtttttgcctcttacaggatgcaactcacttcaccaaaatagataaaaacaatgcatttcttcttaatgcattgcaactttgaattcttaacgtgtattcctctttcctttaacatggatttgaactgaacccagtggtgcatgtaatcatataactatttcctttcattcactcaaataagaagtatggcaaaaagttgccattggacatatttaaccaaaaattcagaagtaagaagtgaaacattaaaagaaaatttccaaatatatctttaaactatagtaaaaaagtaaaaggttataaggtatcttttgttattaaattatgatctttctcttggtcctgactcaattttcaaagaactatatttttctctagttcagaaaggaaagatcacaatattccagaagtatttcctagtagagggatttcggttgaatcaggaattccaacatctctcccaggcgttcctttccactggtcttttcaccgctgatggtgatagtgctgcttgccaggaactattgcaccattcttacctctttagagaaagggtatttaagccttattcttagaaacccaggagaacttactcctataagcaccaagtttcctaagttaccacatagggatcaagagtccatggggttcgtgctggcaaagcttaaactgtgagtaaccatccacacagcaggaaggagagcacgaggctactcacggtcaggatgttcatatggcaaccagtggtgtttggtattctggtattcaaagtgggagtttcgctgctgacactgctgtgctctgaagtcctcaaagtgtttttggcattcttctgtgttacaaagctggtactcaaaattaacaccaggacaatcctgaccaccattgatgggcctaaagaaaagacaacatttaaaaaggccttttggcttctgtctagcagttgaagcttgcagacacagtgcttgagggcacaaagccaaagtttctgggctgccagcacaaagtgaatgaactcatacttcctaatttcagtccctttccaaagcacccttctctccctgctgggtggaaaaataaaacaaaacacaaagctcaacttaaatcagcttttcaaatcatatattttaaatgcatggcaaaagtgtgtaagaaaaaaaaagcatgtatattgaatcaataaaatgatattttgctaccatgtataaaacacacagatgcagctcaaagaaactttggtcatcgctccatggctcggttccctcatatgtaaaatgcaaataataatgtatcttcctttgaggaaaactgtgaagattaaatgagttgacattatttaaagcactcctaacaactctggctcataatgaactttagctgatcttttaatttttattgtctttgttacttctaataccaccatcatctcttactgggaaggcaggtatgtggcatcagatagtcttacaaaagacgtgctcagagacatcctgctgccagaaacagagagaaaaagctgctcacatattaaaccctagacaaggcagaatcctctaaatgtgagaattcagttgtttttttcttcgtaaagattgctgagcacacaatagggaattcagtaattgtagtctgagtgaatgaatagataactttcccccaacagtcacctggccttctatcacaatctttcttttgccttcctctgaagcaatcacattccactccctgaagagagagagtctgtatgcttggtaccgctctttcctggacactctcttgtttctggcagtcaatctcgcagtgcccatgcccacgcccttagggcacagtgacctactttccttgttcagcttcttaatattcctgaacagcaacttctttaaaaatattcaatcttcgtttgatcttcttcatcactgactgcttgtcacaagattaataaatggagatgtatcaaaaacacagactggtttatgaactgtgaacaatttattttcctgccctgtgttttacatgcactttataaaacagaatactaataacataatattgaagtattttctggtctctccaaaaataacaagagttacaaggatatactcacatgggattattgcactggcgtgttctgaaacgaacaccagttccacatgtccgagaacaggagccaaatttagtccatgacccccaattgccatcttgtttttgctgattagcattcttccacatgcaatgacccttatagcaccacttagaaaaatgacaaaaggtaattattaaaatcacgcatacactaaagctgaagttgttatacaagaaccatctagttgaagggctttcttactgctcttttttcttccaggtggagatgcatttaaaattatccaaaagcaattatgtcattaatataccctattaaagggtaatttagacttgtatttttcaagtagaaaattaaaatggaaaaacaacattcactcagacaagtttttaaatgatacattcaccagtaagcatcaaacactataatcaataagaactctttgagcacccagcttgcacagttggtaagattttacccttcatctgtcactacctatatcataccagaatattttgagggctacatgatctttttaaaaatgataaaataaactatgtcttggtttagataataatataacatgtctaaaacatatgcagctttcaaagcacttttatttaacttttaaaatgtttcattaacaatgattctgagagatagatgggtcatacatatatcatcaacaattagatgaggaaaattgaggcccagaaaggttcataagtagttgaaggccatctgaccaagaagtaattaagtggggctaccagaaccctaatactatagaggcacctagcttacagtgcctggcatggtgctcaagagacattagccattttcctctctaacattttgacttactttttcacactacgtacaataaaagcatttgttaaaactcaacttctataaatttcaatataacaccaatatatttaagaaagttgaatgttaaaaagttaattatataattttttataaagcaaaaatgaattaactcgttatactcttgtttttagtcagaagtttatgatattgaattttcccaaagcaaaacattgtatacaaggtgctttgcatagtgcctaatataatgcaaacacttaaaaagacaggttttattattattatgcatataatccctgtcacaagtacagtttatacacatttgaaattgagctttaaaagaagtaaatgccatataaatcttctgtaccaggttttggtcctgcctacaatttcttatttctaaactagtcaaagcttttcaacttgagttcttaacatgcctttgttttgggatctttgcccttatgagtagcatagcttggcactcagccaatttctgagcattcaatcctgactacacaatttgagatttaaaacctctgggcatccttccctaaggaacaaggccaaatcttctgtataagttcacatgactttatttctgggcaactttcacaaggaatggcatgccagcaagtcaatcagatcccactaccagggggcagatagtctgctgagttgcttcttcctattctgccaacagtgggctgaatggtagtcccaaagatatcaagtcttaatccccggaacctgtaaatgttaccttatttggaaaaagggtctttgcaaatgtgattaacttaaatattttaaaatggagagattatcccagattatccatggggtcctaaatgctgttacatgtatccttataagagaggggtagaaggagatttgacccataaagatgaggaaaacgcaatgtggccacagaagcagaaactggagtggtgcagccacaaatcaagaaatgtggggtggccaccagatgctgggagaagcaaagaaaagattctccactacagcctttggagggagaatggccctgcccacacactgatttcagttcattgaaattgatttttgacttctggcctctagaactgtgagggaataaatatccattgtttcaagccaacaagtttgtgaaaatttgttaccttagccacagggaactagtacactattttagtacattactttaataaagccttgcatactatggttttcataaaaatgacagtgcagctgtgtttaccattttccagacctttaaagatgataattatgcaacatatcttacatatttattgtgtaaatagatatactcacttttccagcagcacattcagtcccatcaagtggaggtccctttttagtcttacaaaagtagggattatcaggatggctacaccacagctgtttacatgggtcaaaggttcggaactggaagatagataatcaaattgtcagtgaactctcagctagcatgacatgcaccaaaaatatattctatacagtttcttctgtcctgtttcttggatgtgtttatttcaagttaatagccaatgttttgacatgttgaaaaaaaactgcataagaatttcaggtagaaaatacttttattctgcttttctaaaataacaatgataaacaatgatttgtctgagattatctggttgacttttaaggtttttgcttgctgtttttatgttttgtttttcaaatagacaatgttgaaattttctaaagacttagtaattatcatgaatattgtaaatatgaaaatataatggtttggcagctctcaagctatcaaaatgtcttttctttatctctgtaggtatcagatagatagttgaatataaataataaaagggctgggcacagtggctcatgcctgtaatcccagcactttgggaggctgagatgggtggatcacctgaggtcaggagttcaagaccagcctggtcaacatagtgaaaccctgtctctactaaaaacacaaaaaaattggccaggcatgttggtgcatgcctctaattccagctacttgggaggctgaggcaggagaatcgctggaacccaggatgtggaggttgcagtgagccgagatcaagccactgtaccctccagcctgagtgacaacagtgagacactatctcaaaataataataataataataataatcataaatacttataattaattgactaaaagcagaaaaaaattgtcaaactttctgtgtaagataaagtattctaggtacaacaaaatatcataatacattcatatagtttatgaaatattttccatatatttgattctcataccaatccattgctgagaaatatgggttacaagttagggctatagttatggttataagtaagacagcaacagcacaagactagagtcttggttttcatactcttcagaatggtttttattttctgaacacaccacattataatatccaaatgtttgtataagcaaacatgtgtatttgtgtgttctctttgcttgtttgctctttttctctctaaatgtaaacatcttaccaatcattatatttttaaaaatatcaaacaacagctaatccacatatctattgcctatactgctaattacctacatacacccttatgtgcatagaaatttttttattagtacacatttttagatgtgggttttttgttctaatccttattatcgaatgtggaaattccacttttccatgacattaagccaaagctttagaattctctgatttaaaacattaatgcaagtaattaggagctcacagtgtataccttatagacagaccaaatggttgtatatggaaggtttcaaacagcagatcaatttctttctagccccatgaaacacttacgttccttgctctaacacccaaagcttgctccaacatagaaaaaggccttcttttttttttttttttaatgaattactaaagaccaatgtggaaatttaatgaaatatacatctaatgtgaatagttacaggcaagactggctttaatggattccatttaacatatatacgtgcctttcttgtgctaagcactttaattatattatcaaatttaatcctcacaccaatcttatcagatacatactatcattatccacatattacacatgagaaagtagtccagagagattaaatacggtgcccaagtttatatatttaaaaagcatcagctgggcacagtggctcacgcctgtaatcccagaactttgggaggccaaggcgggcagatcacaaggtcaaggagtttgagactagcctggccaatatggtaaaaccccgtctctactaaaaatacaaaaaaattagctggcggtggtggtgcatgcctgtaatcccagctactcgggaggctgaggcgggagaattgcttgaactcaggaggcggaggttgcagtgagctgagattgcaccactgcactccagcctgggcgacagagtgagactccgtctcaaaaaaaaaaaaaagaaagcgttagatccaggacctgacccactgtcctgacccccatggtatgccatatgattcttttactagactataccagcacaatccttccctatggtcacacatacatggaatcctgccatcaagctaaagaaaagcaataaatctaaggcttaacagtcatcttctctgaaggtcacaaaaagcaggggatgcaaagaacatgaagatttgagcctggcagccttggtttcaaagtccagttcccctgtttaccagctgtgtgccttaagcaagttgcttaatctctaagtcttggctttatcttctgtaaaataaaagtacatcagctctctgctagtctgtcatgagaattaattaagacaatatatttaaagcatttagctgtagcacacagcaacacaatgaacacaaaataactgctagatattattatacttgcaccagtgagtctgtaaatctcaccaagcaggagctacacaaatagatttcgagctgcaaaatctacatcaactgtgagcaacataccgcggtgcacattttatagccaacaccaaaatcaaaacgacattgctcatccatagaataattgattccaggaagttctgggagtttaggccaatcatgatcaaaagggtcatcaaggagacagtcataggaactgtaggaagaaaaatattgcatgtagttaaatgttcacttaaaaaaatcatgtcctgatttaaaaaaaagtagtcttagcttatatactttagaatttcatcccagatcatacagcaaatttgcaaaaacatgtatttaaggttttggttttggttccatttagaaaaagactctttacctgtattcatgccaggaaagtaaaccaagcatgacttaggaatgtagtagagccacgattatttgagtcactaattaaaccaccacatggtgtggtagggcacatcctgacacctatactgtagagcacagctcgtatcatatgcagaaaccacatgaccatcctccccccatcctcaagtttgaccattaatcaaagattcgataacaatttactaaaggaaaattacattacagttaaaagtttacttatattctagacttatggcttcaagtattgtgactccatgataaaatttttgtgctgaatgttctaagtcataagaaaatgtttatcagtaatagttttcatttactgggaattttgctatgatcaagtcctaagagtcagtttcatgtctgtaggctataaaataaatactttcatgacatgcagcaggggacatactggatatatcttttcagttcttgaccactgcatcgggaccagtggtaacgatggaatgctgcttgtaccaagggagccatgacacttcccatagcagtctcatcaccacacctgttgccttgtccatcatgctccattcccaacctagaacacaaagagacctcagtggtaagaatcaggggctactgccttcacttaattttggttttgaaaataagccctgggaaataacgtatttttgagtcaacgtggctttcttgaagaagtcacagaaacggaaattgacagcaatctgacagaaatgcctttcttattctatagctctgaaaaccacaggagtgcctctgcaagccagtcactcatttagtttccgtgcatgacctcttctctgtttgcagctcttcacacttggcaaaagacaagaattgtatgctggcatgcattctgcccaaagaggaaacaatactgggagaagcaggaaagaaaagatctttttttggctttatagctgtcagcagtgacttacacatggcccgtttcatgggctactacaaaagcagatgaaaaaccatcctcatgattcagggtacaacttctcactggatgacacatgccggtgactggagcatatcctgtagagaataacaattacttttattttcattttatgagaaaacccattaagaattacaactggacttttgcctagggggaaaaaagtaaaagcctttcaggaaacaggggtagcattatttccctactagcattgtgtcacattctcttgggaaagccacaggtaatgttctctaaaaaggttcactgggtctgcattttctcctttcctaagggaaggaatggcctggggttaccattttcttctgcccaccagctaagccctgcctttctgttttagtaaatggtccttcatatcgtggtactgatgaaggaagccagaaattccatcaatgttaaaaagaaaatcatcagtctccttcttccaaagtccacatcagaatttattagataaatgtaagctgactttggaagaaagctctttggcagcagtcatttctcatggcatctcttttctcattccaaacagttagtggaaatcacactgcattttacagcaccccctccatgccccaaatgcacaatcactattttaaaagcaagtataatttacgatggtatttaagtggcatttaacattgagaactccacataagtcactgtaagcaaaagaaagaaaatgtatgcttggccggtgtgtggtggaaagcagtggtggagagcagaacatttgaacagactgcctgatttaggattactttttaaaagtcatgccctcaagtatttcttctacatattgacagcaataccttgcattccagcaggtccaaagtcttgcctggttaaaaaaattgcatggtcatggtgttcagagtggttgagatcagatctttgctgttgggacgcccagcgacacacattctccaagcttctggatgggtttcccctttctatgaggctgatggactaagtgaaaacaatatgttaaagacacacctgacaatttcccaaaggcttcgtttgataatttcctctgaagctgaatttgggattaaagtatttaaacaatgattcaataatatttggggcttattctgatatttgctttgatttgtgacttctaaatgcccatgaaggatattttaataataatcaattttacctgtgtgaaagtcaaatgataccatttatgagaatggttttgttatatttgagacagaatctcacaattttacctgtgggaaagtcaaattataccatttatgagaatggttttgttttgtttgagacagaatctcactctctcacccaggctgaagtgcagtggcaccatctggactcactgcaacctctgcctctcgggttcaagcaattctcatgcctcagcctcctgagtagctgggattacaggcgcccaccaccattcctggctttttttttgtttttttttgtatttttagtagagatggggtttcaccatgttggccaggctggtcacaaactcctgacctcaaatgatcttcctgcctcagcctcccaaagcatgggaatgtttgatactgagatttgctattgtgaggcaacttaacattaatcatttaggtaataattttagtagtctaaataatttctgatttggcttagatttcagtttcatagaattaagaacaaaaacattgagaaagattctggcatgtttttccagagatgtgaaggtataaaatcttagttaagatttttgtttattttttacgatccagaattaatcaacatgtggggagaatatgaattcttccatgagttgacaaggctgatgaaatcttagtctatggagaaccatcaaattatattaactttacactaaaaaacaaaaacaaaaactcccattttttttttaacttcatgctactgaagaggggtggactcttccagttctgatataagaaaataagttctttgaatgttgctaccatcacattagggtcaggagttaaaagttcaggggggaaaagggcccaaccttcaagaactcactagccacacttctcagagtagttctgatgaaatgaaaatttgaacttggaaccaaaaattagtccctatttgactgacaggcgaattttgttatagttcagcaaatgttattaccagtgtttacattcttaataaaatcagtttccttttttaatatacggatcacatacttttccaaacaaatgctttaacaaccaattggaggctgttatttccagctggagttaattcatattccttgttggcaatataaaatagattgatgacactctatcattataaaatgataagtggatgttaactgtataatgaaatgcaaacacatggatttttcctatttcctaaatgtacaacttcgttaatatttcataatcaggaggattaactatgggagagagatgtgtaattttaaacatcaagaaagttgtcaggctagtcgtttcctgtatgtttcctccttaaaggagctaaactcaattatattacatgaaatgcctactatgtgcatttttatccaactctttgcttttgaaaaaattaaagctcttttaaatgaaaaatattcactctgcaccttcctcttaagtggaaagatatatgtatataaaatattgtttttagcgaatcaagagaagacaaagatctttgtcttttttcttcattatatattccaagcacctagaaaatgtctggcacttagtaggcattcaatataatcccttctaatgaataaatgaaacacacactcgatgataacaataggctaaggaaattctctctcctcataatagtatccattcatttccattcataagtcacacctaaagtcagggtaattatctacctctttagacagaaataaataagcaagtggcagctgcacaaaaatcattcataatctgctcaaatttggaagtctccactcatgtggcagtttcttctcctcaatttcaagcaactaggggtttatatggaatatatctatgccttaagttagatgtagcttgaacaatttagtcttctatttgctaacccagtccctaatgtttataattcatgttttaagacattttacctttgcatatcccagcattatcatgcgcaccaggaccacatttatatgcactccgagggactcatcatggtaaatttcattcacctagcaacaaaaaaagataattgctaaaagaaaggaaacaccgaggatttcatgagatgtacatataagctgtgtaatcaccacaaataggtgagtaaattgctgtttttaaattgagtttaatagctgaactctgaaaggtagtcatttacttttagctttggtacaatgtgtggatatgtaaattgctaattttgtaaactccacagtaatatgaacgtacaggacatgctcaaaagggctttgttatactagtgcagtgttagaaggagtctatgtgtgatgtaatccaaatataacattagccaaaagcaaccacaggagggtaactttggcaaatcatctgctagcctgtgagttgcctgcaaccacagtaaaggaaaacagcaagcatttgcttactggggtgcctgtgtgacaaccaggggtgctacgtctggttgagagagccaatggctatggggtctgtgtgcaggagctgtggtagtgtatctgagggccagctagcaggtggggcaggtgaggcaatgactgcttgaaagtcctacaagatagaaatcctccaatatttaagttactaaggagactgtacgagtacctgtcagatgaatgtcagccctggatgcaactcagaagagcaaatttgagtcactgctttttatttaattttaaaaaattaggctgaaatttctaaaagtgacttggtatactttaaaatcatagatgttggaataagtgcaacctcagaggtcatagtccaattctgttttatacagatgaagaaaataaagcctgtagaaattatctgacatgcaaaacacagagtgagctactggcagatatgaatctgaagtggactgtaactgtatcttctcattaacctagtgcaaaattagtgcaaataaaaaatgctagcaggaaggagaaaggtggagttaccaggctagaatgcaaagttcttagaatgaagactcgacacttgttaaaaagactaaaagagggatgaaaaactaactgcaactcagcttcagatccaggagatttgaacagtagacacagcaacctgaaagctgcacagaaaagacaggcataatctcatagcgagtggctttaaaaataaatataactcaagaatgattgaagaatgctctaaaacaagaaattcacaaatcatagtattttgatttgccacactaaccaagaaaaagaccaagaagtctcaattgaattgtttcaagaatccaacgtgactgcacagaacacctttaaaaaaatcagggtcttgaatgtagactgaaagcatacttactgaatttgtagaagtcacaaacaagaaaagaacagcaaaggtggaagtaaaaaatctggctaagctagaatatactagagataacaaagtataacttgaaaagatgtgaagtccttttaagtggaaaaatgcatgtatacacacatacatttatacatatatacacatgcacatgcacacacacatgtactcacatacatagaatggtaagacccaatttaatacctgtacgagataagccaagctgtgaaaaaaaatctgcaatacaatcttggattgcataagtgtgcaggcagatagctcatgcacaagttgtcccactctaggctacagaaaacctgaagtattgagtgcatttttctgggctgtcttatgacagaggtgcttgacaaaacatgaatatatcctgagaagagctaacagcaaggaggccagaaaatgtgtcttataaagaagggttggggatacataatggttaaaagcctgaatgtcacacattaatagtctcagataaatcctggttcaacccctcactgcttgtgagacctttatttttctgagtctcaataaaatggacataataaaaataatatctcatagggttagggtgagaattaagagagttaactcatgcaaacaaatcgctaaaaaattttataagtgagagggaggaaagggttttttaaggatattagagtatgagaaatggaaaagaaaaacaagaattaatagccttcatatggaaaaggggtttgattcattgtatatatctatagaaaataaaacttaaaaccattcacattattaaaggggtaaatttcagctcaatataaagaaaaagtcaatgttagacaaaaagctgttgtttcttatgggctttttagtcatgggctgattctcttatcttatgccacacttcatgctgcctagttgaaaagtgaatcaaatcttccaccctcctgttctggattcattatctgataacatattcctaactttatagttgcaataaaagttaaaagtcaacaaccaggcctgtcaccaacacattcattcagagactcatgtctatcccaagaggcttcttgtaaggcagctgtttcaaattagaaacatggctttgcacaccaagttataacatgtatttagttcaatgaagttgagatgtaaaatgcactttgtgttaaaataaggttgaaagcaatgttagtaaataaaactagataacaataaaacaaaactaaagaaacggaaacagaaaaagtgaattaatttctggagaaggagaagtaaggaagagtaggaggcacttacagccaatgcatataacagtgacagctatactgtaacatatgtaatacatcaatgctataggaagctcctacaacagaaagtcttagaataataaaatgaaggaaagatgggaataatgacaaatagcttgtgatatttgagttagtataaaatgcacatataatcatcctaaattagtaaattcatttgtacttagtgaattataaaattaacacagtgtcaagaaagtacaatggacaaaattattaatctcaatagcaaataggatattataaaatgaataaaagagcatttttaaaattcagatttaccattcaccaaaataaaagtattacttaacaaaagtcactattatgccaggctaattagaaaacagggtgacccagtagaaaccaaaatcagtttaagaatgttctgagtcagcacacattttgagattcacaaagtatacataaattattataggtagaaataatctaatacaagggaataatatttttgcatagcacaaagtattatttcaatgtggcaaataaccagctgtctgtactgtacaaagcactgtatcttattattttgattttcaaggcttaaaaaagttcctccatattattcacttccaaaatatacttaataatttgactgcttttcatcttgccaggccctatcaattcctgagatgtagtgtttttatattgtgaaacacatggagtatgataagagctggagaaataatatggcaccatattattagatattcaaaaccctgggttctgttcccagtttggccacggataaactgagtgaccttcggttggtcatttaacctgagtctcgattttcttgttgacaaactctacttttacttgctttgtctgtttcacagtgttgttgctcaaaacaagcaagatcatacaactatactcggcaaaatacaaagtacttgagctcctatcccccatccatgcacaaagtttaaaaaaaaaattgtgagtgtattttcataatctacctgaaaagttcaagaaaaacaattgccttaatcacagtttttactgaaagggacctcaagattcttctatttgaaatttgttaaatctcaatctcaatgaaacatctagtttaaattatcaataaaattactgggaaaaatcatttaaaagctatttccagcagatggcagtatgcatgcttcagaggggcaaaggacaagctgcttcatacacctgaatgtgcttacataccagtcagtatgtcaatgttttcctatatttacacataaatgaaacaatctccttgaaattaaataagaattgtaaaatattataacctgagaaaaatgctacgttttaaatgcttactcatttgactcttaaaagcaaagaaaaatattgaaaaaaatcattatttagactttttaaaatgtcatctgattacaaaattacataggcataaggaaattctcatgatctggctgtttttaacactcaaataatatagagaaagaactaaaaggatatcatactaaattaacaatttgaatctgtcaagatgggctaaattcttattaggaaattcttaataattctaaataattcttatttattaagaaagtaattttacaacttttagtgaaaaggaaagtaatttttctgaagtaaaagcaaaatcaacaaaaaagaacagctaataatacagagagcttatcagcttccagacactgcattaaacactttacctatattgattcaactaatccttgaaataactttagagatattaactccattttacaagtgcaaaagctcaacatatattagagagctcagaatcctatagaggacagatgttctcattgcccagagaagttaagtaacttgcccaagtacaattagtacacgagcaagggatgaaaattagcagtctgacttcagggtcatagctatacccattttgctgtagttccacagatctgcaggccacaatgctgtcgttatacataggatgtggttttaaaatcatcaatagtgattctcaacctttgagtttaagaatatagtgtggaaacatattgagaaagaaaatgtaaaatttgcagcttcttttcataatcttctttaggtaaattttaagaaaatgaggagcgaggctctaaactgaatataaataaggatttattgatgatcagtataacagtattccagaaaatattgagaagaaataaagaggagctagagaagaaaaattaaataagaaaagaaataaagggtgaaatgtataaccagtgtttggggttgcaagaaaagcagtaagcataaacattctaagtgacgtatttgacactgcataatgcaaaccaaagtacatctacaaaaaaacactgagtatcttttcaccatgtgagccaacctattggaccatgggtagattttctgtgaggtgttcagggttgagcctagagtctttattaaattacctgaaagaaggggtaaacagaacattaattcaattttcagatgacctgatgttggaagagtttgtcaatgatgtgagggaggaaaaggtaaaatcaaatcaagtattcctttccttgaaatgaaaattccttccaggtttgttcccggacaggacaaattctcccaggacatttcgctggcaggacaatctgacctgctttgtctgactagctgatgaacagctttgtctggcttcaacaaagcaacactcattttttgttcagatgggtggatcaggtcttgagaggctggatagcttagcagtggagagcatgagctctgcgtcagactgcctggattcaatcttagttgtgtgatgctgggcatgttatttgtctctgtgcctcagtttcctcacctgtaaactgggataattacagtattatcctcataggattgttgaaaggaataaatgagttcatataggtacagtacttgatgcttggcccttgcaaatataaaaaaaaattagcagtaattactgctattattcatatagaagcaaataaacaccacatatatacaaaatttttttaaagagacttttgtataactgaaagtaaacaagtatcaacaagatagcctgagtgattctggctagatataaaagaatactgaaatggactgagaaaagtattactctgtccacaactatctcttacgtaggtaaaagttccaaactcatacctgcttgtattctcagccccatactcagtattccttttcctcagaaaacagaggtgtctcccaatctgccaactcttccctcatctccattctcatattaataataactactgtttagtgatatactcttatcaactatttattgaacagtggctatgtgcccaaatgttctgggggtggagaatggaatagtcaatacctttgagtctctgttcttatgaagcatagactctattgggcaaaacagcctataagcatgaaaaaaaatgaatgcaaaaagacatgcgggcaatgtcatttgaaatgggaataggtgtaataaagaaaacaaatatatgagtgacaagatagaggaggacaagaggagttaaggattgggtactatttgagattgggtagttaggaaagggagaaccatggacaggaaggaataattgtgtgactgtttagggaaaaagcaatctaggcaaagggaagagcaagtgcgaaagctcaacatatattagagaactcagaatcctatagagaacagacattgtcattgctactttataaagagactgagaccaagagaggacacacagtgttttcctcaaatgattagcaaagctatcaagtctatatgatatcagtgcttgttctcttttcgcaaataccttgctctatgttgtgttttgttgttgttgctgttgttgctgttttgtcatgatggaagccctgagtctctagacagtcactccaaaaatcccctccatgctgctggtttaatcgcttccttcctaggaattacttttcttctcttagtaacattctcaactttctttcatgaaaaaaaaaaaaacgatctacgatgttctgtgggatctggtactgtttaccattatattcttcaatgtcactattctgtttctttagcaagattagctctacagctctactttctctgcctaacctttacatgtcagtgttgctcaaggtttgtttgtttgtttgttttttgactgttctcctgatacatgtttcccctgcaatattctcttcactgctgttgcttcaaccagtatctataggctgatgaattccaaagtttggtttttttgtttgtttgttttgagatggagtttcactcttgttgcccaggctggagtacaatggcatcatctcggctcactgcaacctctgcctcctgggttcaagcaattcttctgcctcagcctcccgagaagctgggattacaggtgcacaccaccacacctggctaatttttgtatttttggtagtcatggggtttcaccatgttggccaggctggtctcgaactcctgacctcaggtaacccacccacctcggcctcccaaagtgctgggattgcaggcatgaatgagccaccatgcctggccccaaacttttatgtatctaacagtgattcatctctctcatgtgtgagggccatctgttcaactctactaacaggactatctatttggaagtatacctggatacctcacagcacacccatcttctctctaaaacctgtttttcttttctaaatattttatcccagttacagactaaatcatccttgattccttcttcttcaagtattagagtcattctactaccaagtaccgcagacatctgtcaaacctgtccacctccacaccaagcagcttagtaaaccaaccagctcatgcagactgttgcaataacttgtgaaaacttttgcaaatattttgtatttaggtgatttgggcacatttgagtagctctccagaaaggaagattgtaagggttgatggttgttttcaataaacatgagtctttccttttatgtgaattatgtcttacttcatttaagtatcaaaggagctttggaaagcccaagaataggcagtcagctgtgaggtcctacaaactcttgtgtcctttgtaacaatggacacatagcaaaagcccaggtagaactgtttacctttcctcaagattgagaaagatggttcgcacaggaatctataaactttttctgtgttttacaacctgggaaaatacaaaggttgtaacaaagtaaggaaggataaggtcagtctgatatctgtaacttaagaaagaagaaagtgtgaatttcacgaagggaatttggggctgcaaaagcaaagggggaaaggaagaggcaactgagacgcttcagtaaaaatcgaagggacctcttagtcagcaatactgtgtggatgttgtgttacgttaaggtaacatgtgatgtggggactcgcttctagagtgataggtcaggatattcctgggaaggtgagtatgtttttataaaaggtggctgaatcgacttgtgcttgatgcaatctgtctctgtgatctggtatgttcaatccacattggggaaattaagatagcttgttgaggtagggaagtatagtgtacacaacaaggagtttggacccagacagacactatgaacttagaaactatgtgttcatgttcatagcatagtgtgtaacagagtctctctcctccaaataattctaataatgcatctctttctaaaacacggactgatcaagtcactaatcttaaaaaccctttatgactcttgtttgacaagatgaaattcaaactacttagtatggcacttattattttctaaagttagccccagcttctctttccagtctcctcatctgccatctcccctaaatacctttcaattttaccatgcagaccaatctagagtgtctccaaagactccataaattaatacttctagtatcttgttacaagctgttccccatcttccaagacctatctcccctttttctagcaggaaaatgccagttgagttgaaaaagtccaactcaaatgacatgtcgtcttaggaagatttcactggccactggcattatttgccaaaccatatcctctctttttcaattcatgtttacatagtactttgcaactgaatcccttgaagattaatatattttatagatctctatcacattttattattatcatttgttgattggtttattttacctgctacaattagctccttgtagaaaggtgctatgttttattaatttttgtctcccaagaatctaacaggactttgcctatggtaggttatgtatgctaggtgaataaatgcctagaggattgatgtgaattcaaatgtaagaaacggattatagataatgactcaaaacagaaaactgctacatgatatgctaaggttgcatgaatatgtatactttccagataaatctgcattgcactcacattcaatgttttcaaaaaagttaaaaaatcaaaagcagtgtattgatataaccatcgttaagtaaccagtaaccacatatatttgctgctaactcttgaataagtccattaatactttttaaggaccagggtacggctgtggagtttatattttctttacaaatattggttagggaagcctgccctgttcagataacacatttatgctcgttcactgtccatcataagtagctaatttcaatatacaaagaaactgatgaattcactcaataatttataatttcgtagaagtccaagactgtttctttgtactgggaggcattcttttaaatgaactgctttcttatcatttaataaatcctgagattaaggcataaattctatttacagggccctaaaaatgttaaggcacattagacccagaagaccatttcatagatcttagcaaataaaaaaagatacctttgacctgtcacagacagcagagtgttgctgatggaaaatatttggtacattgaacgaaaacaacctaccatcttaaccataaaaatctgcctcatcagcctgttagaatcttaaactagattgctaactagtttgattcaatcaggtaactaactgaattctcatttcaatgacttgaatcgtacaaacaagacacagaaacagataaaggaaagacatcagagttttatctagcaagagatatataaaatgcctcaactttgtaatgagaggcagtgaagtttggggaggaagagcttaaggctcagaaggcagatatagatctgggctcaggtcctgactctgccatactaactgtctgaccctgggaacatcacctaacttctttcagcttcaatctcttcatttgtaaactgggactaaggctgaatgcatcttagagttggaaagtattaaataatgtacataaagtatttatcagagattcaggcgcaaagagctaaaatgttagtagtgtaagccttcactattaacattaaatcttcattttgaatctagacccaaaactagatgatttcaaataccttcaaagatttcatcaacaaccttaattctccataatctgtttttttattgaccaactcatctacataaatggtaccattaacaaacagaatgttcaagctaaaaaaacgtataaattatggtagattcatctctttccctcagcccatggattcaatagcaaatcctactgattttaccataaactatctattattactgcaatcctcattgtctaataaagcatcctctcttgcctagacatttatacccactttccagtagggtctgtcttcattgtccctaggcctcttcaatttttctttacaaggccgagagaagcaggaaccgaccctcagtggcttttattttgtacttaatactgcatttaagctcctcctatgacctgaaagatgcttgccttcttctcctagctctgcctgactccttacacactaaatttgagccacaatgaccttttagttactaaaacgcatgcccttattaaatggctggatcttttactttaagtctcaatttaataatcaattcctgaaagaaggttttcttttttgttgttttgttgttgttgtttgtttgtttgcttgctttttttttttttttttttgagacggagtcttgctctgttgcctaggctggagtgcagtggcgcgatctaggctcactgcaagctctgcctccagggtttacttacaccattgtcctgcctcagcctcctgagtagctgggactacaggcacctgccaccacgcctggctaaatttttgtatttttagtagagacggggtttcaccgtgttagccaggatggtctcaatttcatgacctcgtgatctgcccgcctaggcctcccaaagtgctgggattacaggagaaagaaggttttcttaatcatcatgtctatgtataacctctatcacccatttgctctgttattctctttcccagaaaactgtcagttccttgcatagttcttatgtaacctatgatgtaattatttgatttctccaccagtctataatctcgctgaggtcaggaaataagcttattttatgttaaccaccatatacctggcatatagcattaaaatacttattaaaagactgaatcgatcaaatttttattgcatgtctaccacacggcagacacttttggatataattatgaggcttaataatatacagtaactgcactcaaggaacaatcaacctattagaggactgctcctgttgaggtttgggttgataattatggaccaggtcaggaaattaaaaattttaaaactctactctcttgaagcttggtggaggattcaggccagctccaagagggtcaacaatttttatcatgcttattggaatattgccaatacctaaaataggccttgcacatggcagacgatgggtcagtatttatagtatgagacatgccccagagctgagaaccactttcccagtaaatcaaccatgttacaagttagtaaaactataaacatttcttgatataacaagatatgatatggaatcctaagaaaggcttaacatatatgacaaatctcttatttgaaacattaaaaccttggatatgttcatatccatgtgtttcttcttcatataggaagcttggtgaaatgtcaagatctacaaaatagaaagaggttaaaaaaagcagatgaaagacatctgattattctccccattgcttcacaaaggagtggggatgagtagagggtatccttcctttcttaggaagttatatcgaaatcatctagggtctgctcaaacttgttcacttgacccttaagccccagagaaaagtgttaacttagttaaccaaaaatagattatggagaattaaggttagtgatgaaatctttgaaggtatttgaaatcatctggttttgagtctagattcaaaataaagacttaatgttaacagtgaaggcttatactactaatattttagctctttgtgcctgaatctctgataagtactttacataaattatttaatttatgcatccaaacacccagatttgcatggcaacacctacagaattttaccgcattcatacgcacagtcattactatcgttaggaaatacggccctgaaatagattaaatatatttgtatccaaaaggtggacaacttgcatggctaatttaaaacaacagataaaccaaagggatttaatattactagtgacatataacagtaaatactgtgtgttaagtgttctcattacacttaaattatgattgagttaaaattaaaaacaacttaaacgttctaagccagtttctcctcccagtaacactgtctttttttaatgattagctttaccaccttatcattacttgagactgttttatgaactgtaaataattttttaaaatttacctaaatttcattaacattttcaaagtctctgtttcctttggaaaaattgtaataatttccatcttgcaatatagttggaaagaatatatgatacccaataataattgttaatttatttcttaaacactgctcccattatatcattgcatttggcatctatttcctcttgttttgagtccaaaatttctgacttcctcccaagattgttcgtgatctacctctacattatttatattcatttgttcttctttcattaaatatacatttaacacttaatatacgagctcttttcaataaaggaaagcatgacataagaaatataagcttctctttaaaagggaatcccatttaaattaaggcgatactctgaagcaaattacttggacctaaaggtattcccttaattcagaaactatcatctcagttctgatatggaaatgaaattgacaaccaggtaaatggaagagcacatctgctgagcagtcaaccaaggcaaagttgaccaacaattttaaaggacagcatgatcttctctctaccatagggacacctttcacactaatcaatgcaaaaagatagaattttttgctgttagctttcttctacagtttctctccaggaccctatctgacatttcatctaagtctctgtgtctatgtaggcctcaagcctggtgagccataattttagatgaccatgagaaatcataaagcatggccagcaaaggagatagttatttgaacatcgttagagaaaaactgaatgttcctggtcttgaatttccatgaggtagcttcattacagtatcgttggtttctctttctgcttctcattctcatttgatgatgaattggaggaaaaggaaagagcctgctcaggtcagtattttgggtctaacaggctacaacagggcagagggtatggaggagaaggaagacttaagtcttctgtctgtcttgcctaaagttgtctgcctgactccagggggaaaacctgaaattatccagttggagagtgatgagggttgggaataagactaatttagaacaaggtttctaaatctcagcatcgttgacattttgggccagataattaaaaattctatgctgtgtagggctgtctgttgcgctgtaggatgctgagcagcatcccaggcctctgtcgctattagcagtagcatccccctccacccccgccccacccaccagtgttaacaataaaaaaagtctacagacattgccatatgtccctgggaactgacgtggacacaaattatcctcagttgagaaccactgatttagaataatgaaaaccttgtgactatacacttaagtatatgcaattgtatgtgcaattcaggtctcatcaataataaaactatttcattcttcatctgtgtgatttccatgtctatctttcagttggtcatgaagttggggagggaaggggaggagtgttattcttacctctccaaatctcttacctgtattaattacttaaaatgcaactaatatattaagtattaaaaaattattttctctcccatagctccattctctgatactctatttactttagaataatttgtatttgagacagagtcatagtctattatctaatttttttaatggacttaagaacaaaagtcctcttgactgtttttaaaacataaaatgcatcactttgttattcctttgacactctcaaaatcatacttactacttactgtctggtgaatatactgtatccattcctacatagaagtcctttacattttcacatgtccttcaaaaaacacaaacaaggcaaacaaaaaaacaacaggaaatctctaaaagcagtttaactcctaacttcttgatgaattacataactaataaacttgttgaatctttcaattttgtaatgatgaaaactaagtcctagaaagggacatgatttgtctaaggtcacaaagccaactagtagtatgactaaaactaaagccttaccctcctaagtcccaatttaatacttttatcacttcatgattggataactatggtcacatctccattttctaaagtgttatagcatttatgatatactgcctataatatggcttaataatagcatgacttttattgtttacgttttttccttctaattttcccatgtatttattttttctcctctaatagttataagttctacgaggacaagaccatatcaaaatctctattgcattactccaaaagccttcttattaggcacatttgcaagccaaataagtctgtactgattgtcttccagatagtagaaaaaaagtagcccagggacataatgaatgacgtaagaataacatctccataggaagtttgaaattttagataacttatgaagtaaaatttggcatagagaaactaaaatatgattgtctatttgtgcatctgtatatggcactgtaaataatggatgacttgtatttacacacttcatcctctcaacatccctattatttttctcaatatgccgataaagagacagaagcaggacagagagtccaagaagcatgccaaagttacataactagcaaaaagttaatagtcaaaaggttaatatgaaaagttcatagtcaagagttgaaaacattcatatgattcacaaatgatgatcctctgaacacatctattgccaaggctagtaatttgttttctgtgtgttgtttggtcttcataacagaaattagtgccaagaacaaataaaaatgtgtttgaatttctgtactcattttccatttcacagagatatggtataagtgtaattttataaattgctatctcaatagaccaaaatataattaacagatattagcataaacaaaatcatgtttcatgaaactaagaatttttctccttcactatcattgcttgaaatctaatcttaagcatgggggaaagaggtaaactatagatatccaagaaattatattaaatatcaaaagttgtgaggggggagggtgggttgagagatagggaaataaaacagcataggcttaggtaataaatttgcaagatcaatataatatatatttcatattggcatgaggtaacatatatagagtacatcaaaatctcaattatcttttagaagtaggtggtttacgtattattatttctcctcagttgttctctgccaatttaaaaagaaagaacacaagtttcaggatattgacaaaatttcttctgaatctgattaaggttcataaaagagaaataaagataaatttaaagagaccattagtggttgctgtgcagcaccgtgccaatagttgtatgctttgtattaataaatatattaccttcagtcttataatgttgaaaaaaatcacatttgttcaaaagctgtaataacaagaatccacagagttaccaggcataaatcattctatatcatcctgtgaagcagagtgattctagaaagaactatttcatccttcataggcaacatgaaagcagatggacaaagtcctgcgagttttgattatccccagaacaaaataaaaattacaattcatgttttaattccatctcattatggctttttaaatttatgattcccccttgacaacaacggaaaactacttgatcaaccaaaagaaactttcgcttcatgcttcctttattttagcattcctgtactttaaatatgtagatcaataatttaaatttaatgccatcatgcacatattttggcacagtcatggaagttctcacacagattgccaaagggtaccaacaaataagagaagtgaattaaaagatcaaaaagctttaaaaaggagtcactactcacaatgttcattagggtcaggaggtagttttggacgtgctctttgccatggaaacggaccacagagtcatccactcccagcagtacctcgatattgtaatcgttttctcccgcgtgtctgcggcgtctcattgtttcattcagctgctggtggatgttgccataaacagtacctagatcatcaaggccttccaggtccgactctaataagagacaaaaggaaccaggaatttcagtttccctaacaggccttccaatcacttcttagaaaaaaagaatcttctcaggggcctatcagtatcattcataatcactgagatgttgcttttcagtttattccttaaataatacgcatatgcatacgatcagacagacctgctacaaattgaacatagaagagcaacactgaaggtaaaatcatattattatacagggagcggtgccatcatggcagaaggactattctgtaaggatagaagtggttcagtttttctcccagcaaagagtcaaggcagtgggggtacagaatacaggctggctatgtagttattaaataaattgagattacaaataaaaataactccagtatgtttacaatgattaagttcctgtagccatggagtatagaatttgtgtcacataaatttaaattgctcctctttccagtaaccttaatttaaaaattaaattatagcagggcaacacaacagcatctagtgatatgattatcagtcactatgtattgctttatttcttctgagtaaagttttctagtgaatgctgccagcgaagaagtggatatacagggtatatactatatacataagtgtgtgtgtgtgtgtgtgtgtatgtgtatgtgtgtgtggataagatagtatataatatacaggttatatattatatatatatgccaataaaatatacatatatgtgtatatgcagggatacacaggaaaactttagtgctccacatttgcactggccatcatttggatggcaagtcatttcagttgctatatatctaaacctgagatatcaaagtaagaagtcagtcagaaaataacttttattcaaagaaaaataaaagtaaaaataatttcttatttaatgcagttcaagaaacttacatttttttactttccaaatgaacatttcatacacacatacacacacatatacatacaacatacctatatacatggaaagaaagaagaagagagacaccatcaggttttaattacctaagttatctgttttcagatgactatattttttgagaaaaaaagttttagtgaattaaaaaataaaatctatcatttggattaaaattagagagtattcaaaactgctggtacataaaaaccaaaaatattttcatctccatttcaagtatatagaactcagaaaggattttattttataagctgccttgatgtctaaaacaaccgtatatgtaaaaacaagtttgacagaaccagctctgactcatgctttatatgatggtttatttcatgctgcactggggcttgttagccatttgagtcagcatctgacattaataaataggtattgtcctctccacctttgtggctttaataaaattaagactgggaaaaataggtgtcttttggctgggaaggttgatgaccaagccctagccaaaaaggattagaagtagtgaaagtacagatcctgctcacactttttctacctttaaaaaatatatagaaacaccaataccctcccttacaagtagggggacatggtctgaatgtgactactcaggtttaaaagctctactttaattcactttgacctaagcccaactgctagctcattagctgggaaaattctcctcaccaaggaattacattggctccacaatatataaataactctcaccatcatccacatcaaacagaaagctttcctcaaaagttttcaagagctgcaaaccctcactgaggttaagagacgactacacctgcaaatagctttaccattcaacctcaagtctttttcacacacttagaatgtgaaaggctgtgatagctagtgtacaaatataggaaattcagacatgagctctcaattctaaaaatggctcctgttggcagaatgctcagagaaaacgtccaatggaaatataccagcaatgttattatatcatgaagcttgatgtgtgaatgaagtaggctgaatacttatttcagagaggcagttcattctgctttaacacacctttggtttggcctttgcaagcctctttaaataggtagttttctggtaaggaaacagaatctctctttttattgcataagaaacctgggaaagaagaaggaagcctttgaaaatcaagaataatttgtccctactttcctccatgctgggcagtgttctttccatgtttcctaaaatgcacaatatcaaatatttcaaagaaagacagtaggatagcttctggcactttttacttatactcatcattataattacagactgctctgaggctgtgaaataccttcattcataatgaatttgtcttagtaaaactgcaaaattatggcaaagctatgacaataagagaaattgacatagttgactccatcttgcttctcacctccaagctgttcttggttatttctgggcataggccaaactaactttgagaggagtttattttatagtttaaccttaaagcaaggatgatcatagcccttcccacaactaaactgcctttgtaaaactaatgaaaggccactaggttaggattatgaatgaggtttgaattcttttaagacacaggcataataaaatgatgaaccgctattgttccagaggtcacaagattggaaatttccccaattacttttttttttttttttttttttaagacagagtctcactctgtcacccaggctggagtgcagtggtgtgatataggctcactgcaacctctgcctccccggttcaagtgattcttgtgcctcaacctcccgagtagctgggattacaggcacacaccaccatgcccagctaattttttttctttttgtatttttagtagagacggggtttcaccacattggccaggctggtctcaaactcctgacctcagcgatctgcctgcctcagcctcccaaagtgctgggattataggcgtgagccaccacacctggccccaattacttctgtagatagcatcactattgtggaatctaagattgatcttttgagatattttttagcctgtgcattctgacaaccgactgaccccaaccaaatgcatgactcatgactcagctggtactgtggccccaccaagaggtggacttagcatatgacgatcattttccaacacctattgaagtggcatcgttgtctggggtaaagacccaaggtttgtcatcttgcaccaaggaaattcagtatgcagacacacacaagaagtgggtttaggaacagaggtttaacaggcaaaagaagaaaaaggagaacagctctctctcctgtgagagagaagggcacccagatggggcttccagcccccagcagagtacactggattttatggacaggctggaggtagtaatgtctgatttacataagggcccacagattagttggaccaggtgtaacagttacatagcatgctgggaagctggccatcccaccctaatcttattattcaaatgggctttccacctggccagtgccatgttgtctcatccttactgtacatgtggctggcaaagagaagggaagatggagctgccatgttggacatgcctagcccccaggtaccccctttcctattggcacaactgccagcattcacctagcaagtttctagcttgcctttctatgtctgccgctcaattttacaggctgttctttgttagaaaagaaaatgatttggggctgcttttcatgaaaagaaacatgttaccaaaaacttccctaccctcactacccacctagataatttcttctttactcctatatcaccatgatcgtgtctcccaacaatcagcagcacccattaaggaatgtgtcccctgcctgccaaaatatctttgaaaaacaacctttgagcctttagggagacggatttgagtaataactccacttgccatgtggcttcaatggtgctagctgagttgggcagcagagagtgatttatgtgacaacagaattagcagaaaaaaaggaaaatccaggttacagagagctttctaacaggtgtgttctcaactgatcattcaaaaggaaaaaaaaggccctgcaaaaggtagagcagtgttattaatctcatgcatcattccaaaaaggtgatgctcacagtgccttttaagcttctcagaaatatcaaagtcaatcccctcttagttcttagagtgagttttcttttttaaaactttttaggaaaatgtacgtttttgaaggttaccttaggaattactgatgtgcattaattaatattttggaaacattttaattgtatccttttgtgcaccccctagtttcccaattactgtataggaatttgcagaagtgatcattttactataaggcctattttatcagaatgaatttttgagaggcatataggtgttcaatcaagtcaaaataaatacagttatttttagtgttaagtataagattatcagtatcaaatcagaattttgaacttactaaacagataaagtagaatataactttctttgctgattatggacactaaggcttgaaatatttttaggagaatgacatgttcatatgcttaatcatacttataggaaatcaaagtataggattagtgaaattgctccctaccccagaaaaaaatttctatggtctgaaaaaggacaggagacgaaggtaaaattggaaaggtacaagttctgaatctaatacaaatacatttggggttggaatgcaattataagcatactgtgatagagcctgtgataaaaccatctacccaatattcattctctcttccctaaggagcagaatgttaattttatttgaaataataataaacccagcaaaaagtcactcccaatctccctgtgactaagggttacatgtgactaagtataagccaatgagatctaagcagaagtattgcttatatcttgatggcttatgactcctcaaaggaagacaattcattccagtaggtgcacacccctttggccctccactcaatcacccaatattcctttctgctgcctagaatgtggacatgatgtcagcagttctatggggtgatcctaggataaagggacatgctgaatagaggagagtctgacactttaaaggagtgtgactccccagtgactgtagactcaccataccagccctggattacctaaaaacaaacttcattacatatgagaggtaacacttccatcatgtttaggtcacccatctaatgagttttttcttgtatgccactgaatctagtcctaaaatacatgacactcagaaattttaattttgttgactaggttctcccagtactctttactccctatgagaatgcaagccaattttcatgtgaataagtgaagaataaaatacgattcatgttaccaaaatgtatcatagtagcattctctgtagtgcatcatttcagaaaatgagaaagcatcatattgttttacagtaacaatgaatacagaatgaggctatatgtaaaaatcttgccttcttcatgaacagaatactgttatgaaatgaagtaactggaatactacaggctggattttccaagagtaggtggagatcctataatcagagctaaaaataagtgtaaattccaacaaatgtcatctattaacatcagaagcagagagcagttaacttaaataattgtgttaacctgtttgtatcatccaatagtgatttttaattgacatctttttaaaaaaatttaaagttatcacttcctaaaaggatacagtaacagcatctccacatatgtggaggcactattctaccaagatataaaatgtttccgtgaaaaggagctctatccttcacaaactgagaaattccataatgatagttcaaagaactatattcaggtcaagttatgatgtcaattcaaaagtttcactaagtacctgttgcttttattttttaaagacataaccattgagtgaatgtcagtttccgttatttcttttccccaaaagttctaattctaacatccgtgtgtttgcttttgtttttactgactactttatggaataacatgacattttttagatgggaaacttcttaccttttaaggaaaaaaatgttttaatgctttgggtttgtgattattagcaaatgaaattttaaaatcagtttaatatccaaaatatgaactctgactggcagtaaaaaacttctatgtcagcgagaatgtttctaactgcaaatcaagaaaacttagtgtcttcagcaataagtaaacatactagttcacgtaacaagagttccagaggtatggtgattcctggttaatccatcaataggtcatcaaggattcagttcttttcatctttccatatcctgccattcttggtgtacaaactttgccttcaaattagctcctttgattatttcaaaatggttacaccaattctagcatcaaagccatgtccaacagattgtgtcttcctgcattactttcttaggaacaggtaaaaacctttcctagaaactctctggtaacatttaactccatgtttcagtggccagaattgaatcacaggggcttgaaataaaagagaaggaaacgaatgttgtacaggttacccaccttgctgaaatctttttcagatcttcctcttccctcatcccttagtaacagccttccactggtatcttttatacctagttttcaataatgcatttcatgtttaatttcttctattataatttgtctagagataacttctgcattctcttggcctcaatattttttgaaagagatagtccttcatttccatagtagtggattctcataattgttgctcattcagtcccattgcaaccatttaatttgatttcatttcagtggtttattgctgaaacatttgggtgtgggcaaggttgtcagataaaataaagtattttttgttaaattaaaatataagataaacaacagtatttttactagagatatctcacagatattgcatgagacatatttaatactaaaaacctactcgttgttatagctgagattcaaaatcaaatgaaaatgctatagttttatttgctaaatccagcgactctaggtgtgggggaattatcttttgccaggcagtacatgcagttacacgaacttacaccctcttcatctcacttttctcctctacacttccatcttcagctctagcagtgcacattcacctggcatggccaagtagcatatgccatttccttgactccagtacttggttaatagatgttcaaatggcttaaattatgctaatgaaattgtgaactaggacattttaatttggagctactaggaaagaaaagttctcattattaagctggaaactggaggaatataacaatgtaggtgtttacggctagtatgagaatagttgttggtctaagtttaatgctagaagaggaaagtggagactactaatagagaatagactacactccaatgatgagtatgagcctgtgaattcacccactaatttctgaaaacttggtcttttcagtttcacaaaccaataaactaccaccacctcattttcttattttactgctttttttttttttttccatttgctaagacagtttgatgtaagttcccgacaggcaggtgaagctaagagcagcctgataaataagcccatttataccctttctctgctacagtcatcaatagtcttcattttccttctcattcttcttctgtagtcaactattcttaggctacacagtgctctgaaaaagactacatattctgttttatttcccaatttgtttattttattctctcggttctattttaaatgaataatgttgttactagtgatttgtttcttaatttcttttattctttttcagctaaatcataactaattttgggagacagcacagtttttaattttcacattttactgctctaaacatttaatagcattttcattaacatttctcttcctcttgactaaattatatattttcttatttatggcttttgtagttcagctctactaaatcaaggaggtaatagaagagtagaggaagaggtcaccacacccaattactagattacattctagtaatcttagactgctagaaattaaggttttctaaataaggtcaactacatagaagagaggtgagattccttttcacagctgccgtttcaaagctcatgttacttccctcactttccacctatatgcaactttagtaaggatagaaaagctcttcacctcaaacttctccagaaactctacatttgcattctaaatcactccaatatggaatgattaataaaaatgtaaataagtcattatagccaaatgactaatatgttaatattaatattaacacttgccatttattctgtgagataaatatttaaaggctctgaacaccactttatgtcacactgctctaagcactgggaatccagcaatggacgagacaaacatgttgcttaccctcatagaacttacatcccagtgataagaactatcaactagggtaagaagagtaaaacaggaggaagggagtaagagggacaaggcgagggaggcaaaattttagataaggttctcaaaagaaggcagcaaatgggctgagatcttgcaaagtgatggagtaagccacacaaatatcaaagttatatttgactcagatatatgtaaactttttatgagcatattcatatttatattacagatttttcagaaagaggttgtatgatataatacaaagaaaatcagaataggctcaggaatgcagcaagccgactttctaaaatggccccactaagatgccctgccctagtcccaagaacctgtgcctttgatgaggtatcattcctacgattatgttatgttatatggtacaattgaccataagatagaaacattatccaggtgggcctgatctaacttcatgagacattaaaagcagagagctttatctggctgttggcagaagggaaagtcagaaataatgaagcaggaggaagtttgatgtaccattgctggctctggagatggatggattctgctcctggacaggagagaggtatctagttgctgacagtgaaccacagccaacagccagcaaggaaatgaggatctcagcttgcaaaaacaaggacctgaattctgccaacaacctgaatgagcctggaaatggactatttcccagatccttcagataagacttcaatctggcccacaccttgattttggccttgtgataaattaagcaaagaaccagtccagccaccttagacttctgacctatagactgtgagctaataaataggcattgttttaagctattaaattaggggtgatttattacacagtaatggaacagaaaatgataaaaagagaactgagttctagttccagctctactatgatgcaactctatgattttgagaaagaagctaaacttatctgagcttcagtttcctgaaataaataggctgagctagctgatcactaacatgttctttctggctaaatttccataattaataattaggccacaatttcactaaattattaaagatggttattattgttatggctgtttgatcatacatgattgatcatacttataaatttgatgctaaatccttcgtcaaggatacaaccatcgttaaaacatttttacatgaaaaaaatgtgctacactaagagaatctatattatgatataaaatacttcataacaatataaaagtctagtaacttatcacaataagagataatctgaccattctcccatttaacgagcacagtgtccataaagtctggagacattggcagttatacacaattttccaagaataccttaaatctcttctctaaaaaataaaatgttgcctattttttttcagattttataaacaacctcggttgtctaaaaggtaacacttagacattttttaagtattatgtattcacagtacagatcagaattttatcctgattaaaaatttacttcatatctctttgttatgatgcaataaaattttgttaacatatgtatgctacttgcaataaaattttactgaagaagagttccaaacatggaattaaaatgtatgttattatcgcatcaaattattgaagaagcggtcattctacatttttaaaaatctaaagtgcttttgcttatttgaataatactgatcaaacagttttgattcacgttctgattggtcagtttttatatcatacacagttaacatatttaagccacagtaattattgcagatttaagatagatctatgacagaacaacgtttgctatctaatattattaatggaatactataattcctagtccacaaataatattattcaagttaaatttaataacaaaccttttttgcattcaaacaaaattgttgagccattcctaaagtgatttctgctaaagacacttatttgccaatataaaactattcttagtctaaggaataaaatatgccagaagagagaaacactgttactacattttactacataactgtgtgcctgtaatatattctctgaaatagtatcgaccatatggatggaaaataatgggcatttttatatcttctatgttttctaagatgtataaactatagatttaatgattgctttaatatttgtctttgctaattctaacatattttgtcagttctgtgttggtttggacagatttatttttctcatcattatgggttgcattttctggcttctctgcgtagtcagtaagtttagatgggaggtctgacattgtgaattttacccttttggctgctggatatagttgtattcctataaatattcttgaactttgttcttggatgcagttaaattacttgacaagtttgttcctttcgggtcttgcttgtaagatttattaggtggggtcagaacagtgcccatctacagctaatgactgaccaccactgaggccagacccgtctgtctaccctccactgtgatgtgaatcatgagatattgcagtctggcttgtggaaacaagcactattcccagccccatataagcaccaggcactgttacctctgattttttttaggtggctctttgtcaggcttcatgtagtttcctcacatatatatgcgatgatccggactcagctgaataccagagggggacctctgcagatctttagagttgtatctctgtatggctcttctcccattctcagtcctgtgagctctggccaccttcctctctccaggctctcagctctggcttctcaactctgggaatttgttaggctccacctgggttccccttccctgggattcatctggaaaccctcaagacaataagctggggcaatcctgaggctcacctcatatgtttctcatctctcaggatcactgtcattcactgcctgatagccaacgtcttgcagactgttgtttcagacattttgtccatttctggttgtttaaagcaagagagtaaatgcagtctctcttattctatcttgatcaggagcagcagttcactaaatttggttttgctgagaacatatggtagtttagaagcttggatttacaggcatgttacagggtaacatgccttaaaatttcaacagccatttagcttgccctaaatgattttctatatacatgtacttggacttgatgaagttaggcagtagtgaaatatacagtgagaatcctgaaaatgtccctttaattaaaaaatgtacttttatgacacattaaatctcctttagtatgtccttgcaacacacagtatcatatgtaagaaagtgcaattaaggttgagtagcatttaggaaatttccaaaaaaaaaaaaaatcacctttctcataaaagaatgtgaacttctttgttcattaaaagctatataagccaaaaggtactgtaaatgtatttacgggaagaaactgtcttccaagagtagcaaagaaaaaaaaaagtgcttgttaactaagcacaaacatggagggagttcaaaaaactaaaaccttagcaaacatggatatcaccttacagtccaaagaacatgatttttgaaatattcactgaatatgttttgctctgagtttttcacaaaattacaagctagggttttaaaaatcatatttagatgatagaaaattggggtgaacttcagaaagccacgttacagaggtaaaggcaagaaataaattttataaattagcgttcattgttggcaatttctcaaaatcaacaagggtaacaacaagcagtatgaaacagctcactcaaaaaaaaatcatcttgtgataaggaaagtggcacaatggcgattcatggtacagtaggttctgttatatctaagttcatcttcttagattttaaagattatatgtttttagtccaagaaacctaaacatttatatattcaattcaaattgaggaatgacatatttgaaaggttatccggatgtagtgagaacactttaccacgttaccaccagtggtatacagtggtattgattttgtatgtcatcaaaatcaatacatacagatattttcttcaaataccaaaagggaaatccagtctacaggaagcaagtctatttctaagaaagaatgtgattccacatctcaattcattcagtggttttaaagatctaacaaattggtaacacaaggaaaaccttcacatataaagatgttagaattactagaaaaggtttattacctccttcctggaaggacatcccctcacctttctttcctctctctcctcccatccatttatttcaaaacatttcttgaacaccttttcagcacagaacctaatctggctcctgcaaacaaacgtgaataagctgaattccggtcatcaaggcggtcacagcttaataggaaagaaggatatgtaaacagatattttcatgcaagatatttgtgtaactgaggaagaatcagtttactctaccaggaagaatctgagaatgtgtcaacagaggaggtgacatctgaaatggattttaaaagatgcacagatattagacatggagaaatagggtgggcccttccagacaatgggcataatgcacgcagaaagactgaaaagtattgaaatgttggggaaatagaacttcaaagaggatggagcaaaactaagtgaatatttacactgggaaatgcggttactaagagaggttgaagcaagatcatgaagaatcttaaatattttgtaaacaggcttcaggccagatttcctggggcaattctgtaccatgcttactatcttggcatcaatattaggaatgttttcgttcattctcacgtgtcctagtttgaacaataaattaagtggtcattctgtttatgggcctttcagttctcaaaatatgatttctagaaggcagggctgaatccacatgatttctttttgtgtacttgtattcaatgataacaaagaaattgtagcaacagggcttccatgtccttgttacagtgattatcttagcttcagaagctacttgggagtcatcattcgttctaacctccttgtggggtgcactcctgcagaagttggaactatagtacccaatgtgcttgtagttagaattccacatgagactttggttaaaccaactggatgaactcatatgagatttggaactcagaatggcaaatatggttatggagacactgtaaaaacagtggctttctgtagcagggtcctatgtctagttgctagctgtgtggatgctgaaagaaaggtgcagtttcagttgtagctgtttgttacccttggataatatcatcagtagcaagctggagtcagcaggtccagcagcagctatctccacctcccattcccagattttagcagaaatagcagctaccagggtgggccatcttctgtatcattctgggaactagtcctgaaccccaagcctagaggctgtattttcaatccttccaaagatttaatgtacacttaaatcttttcattgaattctttcatgcttaaaatggctagtgtggtttcaatttcctaaaactgaaccttgacatgtatatggtaagttatttaacaaaactgggcctcaaattcacatccatgtaataacaaagttggtctatccagtgacctgcaggatccctcctacttctagaattccatgttgtgattctttactgttgtggagtttgcctaatacccccatttttttctcctacatccctcaggaactgcttccaatctggcctgtaccttactgttccatataactgtttcacaaaatcacctattcatatatttttagtattcagaaagtgtaccaaaggcattggatgtggataagacgggataagagttcacttattcactggacaaacatttattgagcacctactatgtatcaggtgcttccaagtaacatattattaactatttgacttagtccaagtgtttgtttagataaaatattcctagaagcacatttatcttcatctgttttccaatttaataagaagtgtcatcctcccaacctgttgatattcctcccaacccctctccagtctaagcttcagtcagtatagctgctcctttacagatactgacttgagtcaaatcaagattttttcccttctttctagaccactctctccatttttaatccttttgctttcttcaacagagtgaattatcacacattttctttattgattcagtttttaaccctacttttcattcctctccactctgagtttcccagatgtctcttcaggtggtcctttgcaagatcttgttctcgcctgctggctgagcatcactttaaggccctttgctttttacaagtagtcccttgggcaaatcattcaataatagagttttaatgcatttttgatcctaaattacacatcctgagttacaggacatttcaacattgacattccaatgtcttttcattgttattctcaagtcattcgcttatctcaacataatatatccttcaacagtcttcttgtataacatttccaggcaatcaaaaccctgaagtcatttttattttgcttgtctcatcaggtcattgccaaattctgataattcttgatacacaacaatcttatatttgccattctatctgcatttctatatccagtctcatatttcaggttctagacactggattgtgtcttctctttcctcatattctgtcttctacacctatcctacattctgccacttaaattatcttctataaatcttactccaaaagcttttggtattgcaaatttccttcctttttacattaaatttcaaccttttggcattggccaaacatttaactaactaaactatatatctcttattgtatcctagctttattttttctctagagtagttaatcttgttatttttcattatagtctactcatttttttttgcaattttacctatttcatcagcctagaaagttgtttacctgaacaaaataataactaaaaaaaaaaatcttttaaggaactgttcagattcttccctgaaccaagggaccagctcacatttcttcatttaaatataattaatatattcagcagttccaaagtactttctatgagtctgttaagccaaaacctcaaaacaatgtgggggtggagggtgctcaaaggtaaattcatgtattacatttttcctcttgttcaatcgacatcagagaaaattcttgatagagcaaagaaaagctgcaatataaatcaccacagcacataagatcttatcacaatgctcatattgaaacttaatactcattgtgatggtattaagaggtgattaagtcttaatggattagggcagaaaggacttgtggaagttggtttgccctctgccatgtgacatcatagtattcatcccctcgtgggtttcccccatccatcatgtgaggatgcagcaacaaggcaccatcttggaagttgaaagtggccttcaccagatagcggtgttggttgcttggtcttacacttttcccagccagcagaactgtgagaaataaatttatcttctttataaattactccatctgtcttattttgttataatagcacaaatgactaaagagaaacaacaaggctgaaagctaggtatgctctccatgatattcatcatagtacagctatactcatactaggcttatgatttgtggaaattagtatgccttcatcctatctaccatggacactccatgatactgcagacagagggacatatataaatggttttgactgcaaaatacttttgtgattaaaaaactccggtaattaattactaagtccattaaaacaaaaagggaaaacatgtcaaaaagttgccaaatgaactggaaatacagcaagtgatcaataaatatttgttaaacaaatgagtgaacaaatcagcaggtaaatggtttagctttagagaaaataatttataaatggaaaataatgtgtcaatatgcaaaatgtagaagaatgaaaaaggaaaacataactagctgttgctaaagtttctaacagtattggaagtgataattaaaaaaaaactggaggtaattcatacatccaagagtaggagtatagttgaataaactatatcttatcataatatacacagaggcacacactattatatgatattctattctatctcatatataaatattaaaacaagtaatttttattatttatggattttgtatttgtgagttcatctagttgttataatgtttttgtaatccctaaatcaatactcactgtgctttcacagtcttccatagacacgtacaaagtggaaaaacaaaacaaaactcaacaaggctataaaataaaataaatatgaacgctgatttataatgaagaaataaatgttaccatttccagataattgtttagatagaaattctacagtaatctacatattaatttttataattaataaatgaattaagcaagtcattgaatacaaaaccaatacacaaaattacttgcattttttatattagcatcaaaacatcatttaaaagactataaaatagtttctatgtttataaatttacaaatatatgctagacctctacactgaaaactataaatattacttaaagccaaacattactgagatactgagctggaaaaaatattcataatacacattagagaaaatattaatatctaaaatatataaagtactcctgccaaatgataagaacaagacagacatcccaattttttaaaatgttcttagacatgtacttaataaaaataacattctaatagtcaataagtatatacaaagatttttaacattgttaaacatcagaaaaaaaatgaaaaccagattaaacatacccactacaatggctggaagacaatatcaagcactgaatgatatttggatcacctgaaattttcatacagtgcaggtgtgaatgtgtatggagatgctcctttttaaaaccatttggcattagcaatggaagttgaaatatgtgaataccctgtgataaaacaattctactcctatgtaaaaacgaagataaatgaatgcttatgtacgcccaccataatacatgtacaaaaatatttgtaactatttataatagcagcaactgaaaaatagattatagtaaattacttattactataagatacattacattagagtaattttagacaaccaactagcacgaagaaataaaaagaacaaattactactacatgcaacaatatgggcacagctcatagatataatgttaagtaagagcagccagataaaactgagtaaatactctctaattcaatttctattatttacatatacatatatgtgtgtgaatgtgtatgtgtgtgtatatataaaaatacatatacatttcatgaaaaggccaaacaacactaggttgatagaactcaaaatagtaattacctttggtagggtatatggtacagtgtctgctttgtggatgctggaaaaatttaactcaatatgcatgatggttacatctgtaaattttcaatgagtgaaaagtttatgatttgtgaaattttactgtaggaatactatcgatcaagaaaaagttaccaaaaatccacaaaaagatttaaatataaatctattctatcatatgccaatggctttgtttgatacatgaggatagaaatatgactttgtagaacatccaaaaaaattccagaaagacattatgtagcaatctaaattaatgagaaatgatttatgcaaggatggctaacagcctcccacaaagactgccttctcttctcccaaaaaagtgatttgataataaaagcactgtaaatcaatccacgaaatttacttcctagggggtggaatgcctggctaatgtaagcctcactggagtacacaggatatatgccagctttttgccaaagatgcctatgagatcattctttgaaaggcctcccctctatactcttgacatgatataaactacttttatatttatgtatgctggacactgctttagtgtactttatagatctttaaataaaaccagctgtcattccagctatccttaagagaaaaaaaacaaaaactttgcctgctacacttttgtgcatataagaaccacctaattctcagggtctgcaccagactttttactacactaagcctggagactgtatttcaagaagcactcctgcaggtcccgaaacagctagtttgggctgtacatatataatatactgctttttactatcgtatgaactattcatttttcgttgatctgcttgttttaaaaatatgatggctttactctgtgtgatctgaattaccttggacgatagaatcaaatattataaacaataaactatatatattcctatccttcaaaaacattataaatcttttatctgccatctagatttcacttctcttagtccttgcaatgtagcaacattatgtaaccattgcataatcaaagaaggaaagtagctaaagcaatgacttttcatatttattaagaattatgtatgtaaaatgattcttcaccaggtaaactcttaatttaacagagctacctcagacttggataggagacatctaagtctcttataatataaactcagggtcagctgaattcaacaattttaaagactaatgtgcattactaaagcataggtgaaagattataaagtgataaacttacctaggctgagtgaaaggcagagaggtatgaggccttccaaaagaaacaaacacaaagacagaaaaaagaaaacataaacaaaacaaagaaaatcctgagaaaaaagctgaagagactagagaggaataaacgatctgcaatttaaaagtcgagagtgagtagataaaactcagaacattcagattgttttaagtgagagaacaagatcttctaagaatccgtggcataaaatagaagatgcaacattcaacaaaattaattttacaatcagacaagtaacttcctaaataagcaactaaacaaactgttgaccatatcatgagccttgcaaaatgtccttgattagcttgcttctgcatttctataaaatggagataccacccatgagacctattctggacctcaaggtattattgtacaaataatgaactaaaggtagtaaattgttcttgagttcctcaagatatagtgtatagtaattcagactattgtgcttttaacttttattaattaatgaaattatatgagttaacattttaataacatttaataccatgggcatgtaaaattaaggaaattcttatagtgaaaatgtagtatggggaaaaggccatgaaatataaatggctaaatatttcagtgaaagaacacagttacattttttcccccagactctggactccatttgaatatgaaggtgctagaaaccctaacaccttgtttggtttaataacatttttgaggatattacagtaatgctaaagaaatgcatcctatctatcaagtacttaaaatgttaattaaatgaatacacactgattattagtaattacatcaacctgaatacacattaccatttaatgtattaaactcatcactgagttaacagcatggttttaaataaactaatattttatttttaagaaattggctaaattaataaattatactctaacattaagtattatcagcattagaattaatttgtatataagtacacttttcattataaaacattagggataattattcaaataagaggaaggcagaagggtgcagaatatcattatccagcggcctatatggaaaaggcaattgtggtttgctgatcttaccaggttgctgatgttggatgatgatagttctcattttaccaattattttttcactaggataaggccatatagttgtgtaatcactcagactgctttaataccattaacttgtatttacccacaaatagtccaactgtgtgcaacaatcttagaacgatgccttttacaccataggaggtttttcctcgaatttcctatccctggactgtgacctgacaggggcagtgtagtcatgacgaagcttaaatcgagcaatgtcacagtctactgaaaaggacacaaattctcgacctgaatgcctacggtctcataaaattctacaataattaaccaaaggtccaaaaaaaatttctttttagtgatttttgttctcctaattttctgactgctgcttgactgggcaaaatagtaaatacaagtaaacttatttgttttcattttcttcattttagtaaagacactttttatgagagactaagtaatgaatggttttttttgaaatttacaattttacgtaaatgaacatatattaccaaagagaagattgccagtgatttctgtgttatggaaacacatgcacatatacaacccaaatacgaaaaggtactgcaacatattttgcttattggcattgactttcatacctaagatattttcttttgtcattttaaacattaatatttaatacttataatactttccatttaagctattctttcaaaatatatcttaaatatttatactaataaatatctctatattctctcttggtacaaaacatgcatgttctatatttgctgcaataaaatatcttttaattcctccctatttttccttatttagtacatgtgatttattccagattaaaattttgatatgtgtatgttgaatatttgtatatgctacaagtaaccagtggttctggaaactgctctacagtgctcttggcattctcaggaactctttcggggttatcggaatgagcagattctggctgtcttcaaccagagcaaccctcttttaagatgttttatgtgtttatgtttccaggtaagctgtcttcaaccagagcaaccctcttttaagatgttttatgtgtttatgtttccaggtaagctattaaacaaacaatggaaattatacattttttaaccttcaattccccttattgctccatttcccaagctggtgcttcatctgtaacaatgaaaattatattatctcacaaattgttatgtgaaataaatgagataatgtattacaaattatttttatataacaggtaataacataaacacacatactcataatatgtcttacaaaacatggaagaagataagcataagtgtcttattgacagattgttataatggcaataatatcaaattcttaaataagaaagacaggtgtttattagtgagagagggtcttctggtaacaagatctttacagtagatttattttctataggccttaagaagattttatttctgtttttgtaattatggagatttgtaaagtggcattatcacactaaaaatccaacgaatagtttgggtcttgatacatccatatattcctattctttcctgcatgagcatgctcctttgggccaccattccaatcctgcaactttagtcttgtgacccatgatcactgcaaaacacaatgccctttccttctgtatttttatcccagtcagttcacccctggtcaggtgttggtcctgtatgtctctaacaatcatcttatgcttggtataatttatcataggaaactgtacagcctcctacaattaagtctacataaattacaattattagcaaaattttaaaatttacaacactaattttaaaatttctcctgagcttcagactcatatttccagtgttttgttacaaattctgtatgcatacgtaactggaactgcaattgcaactgcagaatgtccaaaattatataagttatctcctctcttccccattattctttttctaatttggaagtctcaagtgttattaccataatcttgtcagttacccaggcccatgatttcttgatcattgaagcatattttaatattatcaatgtatctggacagacttcgtctttctactaattgttaagttccatgacgggagggtaggtgccctatttaagtctgtattccacattatgacaaatataatatttaaatagaaggaacacagtacttccagaagcaatgagaagtcaactggtcataagagcctttgctttacacaactcttaaagcaaaatctgggaattctaaatgtgtggcagacagtcttcctaaggactctaccaggtgactagtcatttgttttctctgttcaaacaaagagactatattaagttttataacatggtatcatgggaaatttaaactcttcatttagatattacgaaagaatacaatgtcaaagtagcccttattatcagtagggacatttccattttctttctggaatatcatttcaaaatgactgttactgaaaattttctctgcagactatcatttatatactttaggaataattaatttctgatatcacagcttaattataaaaatttctagtgatgactgacactttggttccttctaacatttctttcctaagataataaagagatattttggaaaaccttaatcatgatcactgcctgacaaaagataatgcatagggttcaccttttacttttaacaacagttgtgaaaaaagtcacactgggcctaaagtagtaaataggtcatatatttttaactcaggaaattcaaataactgccatatcccaagcccaaatggttatagattgtactgaagaagagggagaaaaaagatactacactaaaaataagattaaaccaaacactttaatttttttcaaaagtagtctgccagcctcaaaaatatcaggtatatgaatgacagtaacagccataaacccaggaactacaggatccaaaatgcagcatgctggtgtatataattcaaggcaaggacatgaaagttattctcatgaatgataatgggaatacaaaaatagtagcataaaattgccttaaatgcaagaaaatagaggaagaaagtcaagtatggtctcagattattttacataaagaagagatggcaaaaacatatataccgctgatgatcccctacaaggagatagtatggaaacataacacttggtaaaatttgttggaaaattcaagaaataagaagtatgaatttgaaacggatgaaacgtttgaaatataaagggtataaagaaaatgaacagacttgtagaatatatcaaaactaatttacatagttagatataccatatgctggataggaacactcaatattgtaaaataagagataaaaataaaaaaggccatcctccctgaatgaatgtagaagttaatgcaatgtcaatcaacatcccagtgaaatttttttgcaatttggcaatgtgattttaaaatttatgtgtaaaaataaatctataagcgcaattatttaggtttttgtttgttttgttttcaaagatcaaagaatagtctgggaagcccaggcacagatctatgcacaagaatctgttatgtaataaacggatacctgtaaacagtagtgaaagaatatactttcaataagcaatagaaggcctcataccaaacgttataaaaaaaatacctatataaagacttaaataggaaaagaaaaaaaaatgaagccagtatacagctagaagtggaaaaatatttaaaaccttaagcgtgggaaaggtcttccaaagccagaaatgtagcaagaattaattcagtgaaagtttgccagatacgacgatgatgatggtgatggcgacgataatgatgatgatgatgaagaacaatgtaaagaataaaacaaatgtctcaaaagatctccaatatattacatgaaaatgatggctaccctttaatatttaaaaaaacacattattttgcataagtagaattagcccatcacaataaaatattagcaagggcatgaaaagtcagggaacctaggaatcatccagtccatagtgatgaatgaagaagtatagaaaccaataaacatgaaaaattccaaattcaaaacacagaaccatgcatgcatgtacatgtacacacacgcacaaacacacaaagagagaaaaaacgacaatagaaggacatacactaaaaaatatttttctttttgtttacttttccaaagattttaaagagtattattataattagaatataaatcagccagatgcagtggctcacgcctgtaattccagcattttgggaggccgaggcaggtggatcacctgaggtcaagagttcgagaccagcctggccaacatggagaaaccctgtctctactaaaaatacaaaaattagccaggtgtggtggcacacgcctgtaatcccagctactcaggaggctgaggcaggagaatcacttgaaccgggagatggaggttgcagtgagcagagattgtgccaccgcactccagcctgggtgatagagcaagactccgtttaaaaaaaaaaaaaaatcaataaatgttgttcataagaaaacaaatgaaaaaaacagagttatgtgcaatttctcaacaatgtttattaatgtataaaggaatatataccacctccagttagttcatgtttgtttcttaatttttaaaaaaatgttaaatagagacaaggactcactctgttgcccaggctggtctcaaactcatggcctgaagtgattctcctacctcagcctcccaaagtgctgggataacaggtgtgagccaccgcactaggccaaaactttgaaaaaaatatagcactatataagtacatgtatcttgcactttctatgctatattataagtttctgtttgttttgcttcccctattaattcaataaaattattgaggacttgaccatgtttcattcctgtttgcatctgcaatgcctacacagtacagggcctggcacataaggaggcactcagcaaataatggttgaagaatttcatacttgcatgagtaacgaaaataaggacaatactatcttctaccatatctgaacaaaattgtttcagcaactagtacctgccagatatgatcttataaatgcagctatgtggccatgaaggagaacaggttatcagctggagaaatgagcagacatttccagcatggatggaaaatcactcagattgaattccacttccttgtgtttctggtaaatattttactcattcttgataacctcttgctggaaatcttttgcacacttccacatcatgacacccattatgttttctaaaactcttcatgcatatctttattatcagtataatcaagctgcagtagagtattatttgtgattaagtttttttggcgatactgagagatccctgaaggcaaggaatatgcattatatatcagggccactgcatacagtcctgtaggttgtgcactgcacaagggcatcatgtctaagagatgctgtacacatcatgaatatcataaattggtatatttataacatcaattttctgatatatgatagtaaagtatccggaacatagagaatcctttattttctaatatggaaaatccctggaacatggatggtactaaaaaatattcatataaataaacacgtcaagaactgaaccaatatctgatgcacaaaaattaatgtatagaattttggttttatctttcaagttgatgtgtggggaaaaataaatttaacacggcaaataatatcaatgaaaacataataaaattacagatcttttggtaacaaatactgatgaattttatggttcgaaaacatgcaaagtaaattctctctaaaaagaaaatcgtaagttctctgattacactccagcactaatgaatgctcccagcattggacactgggtccatgaaattgctgtctcacacagtgcttataagctttaatgtcacaaagcatggtaagcacttctatttagctttaagcaaatgacgttttcattttcaggtcttcaagggcacagtattcaagagacctataaatggaatgaaaggcattggcaaaaataataataaccacaaaatagctcacatgtcttggctctctattcttccatttaaccagtatgtgctgagtacttgctttgtataaaataatatgttgagtactagcattcttgaagcagattcatcccaccaaacttctgccttcaaaagatgatggcttttcattatctcgctattcactattgtattacggtagaagacgatgtgaagttttcaaatataatcccaggttgccagaggtttaatacagtttaatctagttttcagttgggctctgcttagaataaaagagcatatccagatttattatgcaaaggtgatgaatggagatgtgattatttgttttcccaagctatgctttttagggttccttatagtaagctcccttcacatttaacatacgctgttatttagaaaaattattatatgccatatctaaggggacttcattctactgcataaagcaaggaaagcctaggtcttggtggggacattagtcctcttcaggacattaaagcattcagaaagaaactaatgtgtctagccaaaattttctagataattgcatcctcatgaagaaatttttaaagggtattttagtgtcccaagcttttttttttttcagtcagatgactcataaagttaattaacatcataactgaaagccttaggggaataaggaaagtctgaacagagtttgtatctactctaaataagtggttctttcttttctttctctttcttttctcattcctcctcctctctctcttttctcctttctctcctttatcctcttttgctctcctctcatctttttgatactgatttctgtgaaattagaatttacctactgccttcaaaaacatatttaaaaattatactctgtaatgaaaagggctggtagtttgattttaaagacacatttttcagcaaattctgatattttcagaatttcttgaaaacatctatttcagaaattccacattgtacagctcaagtagttagctttaagtttctgatacttctctaaatttgataaattctttttaggccaccaaagcatttttttctattatccagagtggcaataaactaatttcttgtcttctaccttagaaactgaatctggttatctagcccatagcttactatctatactgcttggacatctgccatctttttagagagcttcatttcaatattgaaaatataaaattatattaacagcaacaagttttgtcaaacaagtgcagatttatttattgtgtattataaaaagcaccatataaatacatatgtaacacgtacatatatatatacatacatatataaaaagtacttattatttcccagtgctcagagggaagaaagaagacatttgaaaatttagtagcatgatgaatttaaaatatacatttttaaagacaactagttccagcactttgggaggccgaggcaggcggatcccaaggtcaggagatcaagaccatcctggctaacatggtgaaaccctgtctctcctaaaaacacaaaagattagccgggcgtggcggcaggcgcctgtagtcccagctacttgggaggctgaggcaggagaatggcgtgaacccgggaggcggagcttgcagtgggcggagatggcgccactacactccagcctgggcgacaaagcaagactctgtgtcaaaaaaaaaaaaaaaaaagacaactagttgggagtctaacgttgcaattgttttaaaatgtcagggtgattgttactcacatgtttttaactctttggatgttatatgcataatgtaatttaaaaaacaataattatacgcactgtgacatatttagtaacatgaaaatatatgaaaacaaaaatatagatactcgtaaatgtttagtgttaaatgtcaaaatgtacgctaaaacatgttctcatattcatgtatagtatgtagtcatatttacacatattattaagtaatacaacttcaaaacttttattaaaataaatttatgccttcgcttaagctttaataaattacaaaattgagatggctttctaaaatattttgaattcaatattactcccgaagccattagttttcgaagtgtggtttcaactcaggcacagaggaaagctaaaaccatgggtatgccagtgttagtgcaaaatcacttatcttttggaaatatatcttagaataaagggctactggaggtaaaacaatgaagacttgaggacaaggagtacagatcgaacattttaaaaaaagaagaaattagtagttccaagaccaattatatacttaattgatagagtctagattctatctcaattacatgcctttccatagtctcaacatggcttcccaattcttctaatgttgggatgatctgaaataaatattttgaagaatacaggtatgctaataaactgagaaaacaaaatgaatatcatggttctgacatgcagctgattagagtggtcctgacaaatgaaagcaaccacaattcttaaaggaccagtgattgatgccaaaatgacttcagaacaagcctagaaacacatgttttaattctcactttctaccttgtaaattattatgaaaattagtcacaagtaatctagataggaggacctagcatttacacaattctaaagtgtactacatatgatatagagtcatcatatgaactttagaacatcactataacaaaggtattatttccccccttttgcagactaagtaactgaagctaaaacttgatagcacttgtctgactgtaaaattcatgctgttttcgctacactatactgactctaataactagcactgctttcatgcaattaaaatttattgagtatattctgtgttctcacaaatggatagaacatagttggtacaaaacacacagattgcaaagaataggatgaaaaacagttaaaagtagatccgaacacttacacatgtgatagaaacactacgcatggtgtctttacttcgtatataactaatcctcataaaaaccttatgaaaagcaatatcaatgtcctatttttataaataatggtaagagaaattaaaccccttacccaagaacaacttttcaactagtaagtagttaaactgaaactcaagccatctatgttcttttccaccactttccactgctttgtcaaaactttataggagacacttgctgccaactatggtggaagaatttgcagcacagcaatgctcctcttataacaagtactaaaaaaaatgtgaccgggcgcggtggctcacgactgtaatcccagcaccttgagaggccgaggtgggcagatcacttgaggtcaggagtttgaaaccagcatggccaacatgatgaaagctcacctctagtaaaaatacaaaaattagccaggcatggtagtgggagcctgtaatcccagctactggggaggctgaggcacgagaattgttcgatcctggtaggcggaggttgcagttagccaagattgcaccactgcactccagcctgggcgatagagtgagactcagcctaaaaaataaataaataaaaatgaaaaaaaaaaataaacagacaaagtacaaaaaaaaaaaactttgaaggtgttagagaactgctaagataactaagacatgacacaaaaacaagaaattgtatagcgtttaactgacattcttaaaagcaggctttttccttggggtatatgcatataaaccgaaattcaagccatctatgttcttttccaccactttccactgctttgtcaaaactttatatggacacaaataatggtcaccaggtcccagaatgggttgtgtgagcccttgaggccttcatccagcgttgtttctgggaaatctctatttcaatctattcccatacattagttattgaaaaataatagacaatcgcaaaaacaagttgacctttttgtgttcctagagcccggtcattttatggccctcgagactggaagtcatgccaaacaactcattaccaaaagagctaaggtcccagcctgcgccgaagatttatgagacctctcctcatctgtgaacggaccagtggccgactctggtgcccaggctgttgcttcccagcctggtggtgaatcctccatagtctggtgagtgtaaatatatatatctcttttcccttctccccttcaaattgcaatttgcttattatatcatttgcttattatatcaatttgcttattacattaatctgcttattatatcaatctgcttattgtatcatttgcttattatatctgcgctgccatttacatgggataaagcttgtttacccttaatggtgttgtgtgtgtgtcttttattttcccctcacgcatttcccgtacagaacagagaccagctgggccaacatggcgaaatcccatctctactgaaaatacaaaaaaattagccaggcatggtggcgcacacctgtagtctcagctactcaggaggttgaggcagaagaattgcttgaacccaggaggcagaggttgcagtgagcggagatcgcaccactgcactccatcctgggtgacagagtgagactctgtctctaaataaataaataaataagacaattagggaaaaagttaagatggtaggtataatcccaaatatatcacgaattattattgtgggttgacatgtgccccctgaaagataagtttaagtcttaaatcccagtacctgtaatggtaatgttatttggaagtagtgtcattactgatgtacgcaagatcaagtcataatgaattagcgtgggacctaattcagtgaatgatgtctttagaataaaagagaaatgtagacatagacacatagagagaacatgtgaagagagaggcagagaccagagtgatatgtctacaagccaagaaacaccaaggattacaggcaaccaccaggagctaggggagacatcagcagatattttctcatactgccacaaggaaccaactctgctgacatttgtatttcagacctctagccaacagactatgagagaataaattctgtgtttttagtcacatagttggtggtactttgttatggcaactttcagaaaccaacacaattacattaaatgataactgattatatatttgaattaaaaaaaagactgtcatgctgcataagaaggttaaaataaaaaaattaatgcttacaagcgacacatcttaaatactaaaatgcaaaagataaaaaatgaaagggtaaagaaaatgcaccaagctgacactaaaagtaaataaataaataaataaataaataaataaataaagtagatgcagctataacaatattagataagctaccctttaaagtgagaagcattactaaaaacaaaaaatatatatatttataagattaaaaaactcaacccactgggaagacacagcaattgtaaatttgcatgcaactacttagctttacaatatataaagcaaaaattatcagaactaaaattaaactgagaaaacagttataattatagttgaagatttcagcacaacgaacactaaagaacaaacattttaaaagtcagtacatttctagatgatatgaataacgcaattaacaaacttgacttggtaacaaacagcattgtactcaaaactcacattattttcatgtgatcatagaacattggtttattgctggataataacatttcatgctgggccataaagcaagtcatacaaatttcaaaaaaaaaaaaatgaatcattctgtgttctcccaacatgatggaattaacaagaaatcaaaagcaaaaagataattagaaaatcttcatatgtgaaagtagcccacaatagtcataaaccatattgtcaaagaaaacatcacagtggaaattaggaaatattttgaactgaagaatattagaatttatgtgatgcacgtaaggctgtagctagagagaaaaggtatagcctctaatgcctacattgtgaaaagaagaacggatcaatatcaactttctaaatattaataagttagtaaaggacagaacattaaaagccattaaactagatgaagtagaattgcagaaataaaatagaagcataaagaataaaaaaaatcagtgctggcaaaaattgaatctgtgggaagaataatactatattagatgacttctataaagattgatgagaaataagtacaaattgccaatataaggaatgaaaaaaccaatattattacatatcctgaagatagaagtacatcataaataatgccaattaattttaaaatttatgagaaataagcaaattccttgaaaacacagcttactaaaaatgataccaaaaaaggaaaatatgaactgtactaaatatattaagtaataaacttacaactaaaaatctttccagaaatctaaaataatctattgacaaactgtgagaattaataactaaattagcaagaaagatgggtataaagtcactataaaaatttgctttttatatgctagatatagaattttttaaaaaaatataattcacagtaataccaaaaacatcagataactaggaatatagctaacaaaatatatgcagtacttgtatgctgaaagttataaaatgctattgaggaaaaaaataggaaaaacctaaataaatggaaggacacatagttttatgtaaacatttcttgctattcttttaatttttatccaaaaattacggcaatcatatttcactttcagtagccaaatataattttgctgacacatctaaggaaaatactagaatcccccactttaattccatacatattttggaaaactcattattataaagatgctaattctcctcaattttaattttatttatagatttagcataatccccgttaaaattgtgataattgttcttctgtggaaactagaaaggtaattttaaaaaattacatggaaacggaaaggtcaaaaacagctatgggaatctttaaaacatagcacaggtttgaacaacttacaccgcatatatcaaaagctaccataaagctaaaatagttaaaacagagcaacattgatgcacacactgacaaaaaagccaacagaagagacggagtccagaacagacccacacacatatggtcgcctcaaatacaaggtgagactgccacgcagtgggaaaagaatggccattttagtaaatggtgccaaaatggaaacaacccagtccattaacaataaaatgaatttaaaaattgtggtacacttatacaatggattactattcagcaataaggaagaataaactatacctacacacaggaataaattttacaaaataatttgattgaaaaagaaacagacacaaaagatcacatactacatgaattcatttatttaaagttaaaaatcagccagaactaacttccaatgctttaagtcaaaatagtggtgaggggctgggcatgttggctcacacctgtaatcctagcactttgggaggccaaggtgggtggatcacttggacccagatgtttgagaccagcctgggtaacatggtgaaaccccgtctctacaaaaaatacaaaaaattagccaggtgtggtggcacacacctgtcatggcagctatttgggaggctaaggtgggaggataacttgagcctgggagatcgagtctgcagtgaaccaagatcacaccactgcactctagactctgtgtcagcaagaccccatctcaaaataataataataataataataataataataataataataataataataataggaaagtatctgaggtgttgataatgttgtaggtattaatctaggcacaggcactctagaaaaatataaggttatgtgaggcactcatgaataagactaataattctctctccagctttatgaataatatgctagaataagcatattgcctatttcttcatttccccagacagaataaacaagtttttgaagcttacggccattttagcaacataaaaaagtacacactttgtaactcattctatagcttttttttcattgtgacattaaaaacatgtatttaatttaaaaactgagttgcatcctgtttgttctcctgcatgtttgggagtaactcctttttttttttttgctggtacagaatactctgttattatcttcttgctatgctttgaatcacccaagccaagacttatttttagcattaagctgctaacccagaagcaaagaaaaccagtcacaagggattatctctttcaggactgtactcgaattattatacatgtgaattatttaagaatcagataattttatgtggcaaaaggaagaagaaagctatgaatagaagaaagtacaagttgtcactaattattaactagtcaatatgaaaataaacccttccataaatagatttttatatttttttccttacactaaattttcttccacttctgtttcttccatcctgtccacattggtggattatttattgctatttcagttatacatttcaagagaatgaggtgactgattatatttttgcatagtttcttggtttaaaatactgtgaaaggaatttatttttaaatgtggaacctgttactatgacatcaaaaatgacaacagaaatggatagcaaagaaatactcttaacacctttaattctagtgactataatcatttaaaatctcttgctcttgatataagcaactaccacctttaaatgaaagtaggtatttctaagacattccaaaagtccctacctaagctgtattgcttgtattgatccgtattctctttagaaatgccttcctatctcacaggttattacatgatgggagatcactttataatcttagctgctagccttgaaatatttcctctctatatatttcttcttaatctcaatcttcttggctacctattttattaccaattcctccattccatttctagcattatctcacccttcaggctttatgcgaggcactgtcttccttccccaaaactatgactcagtaaaccatcctttggcaacccttagtaaatatgctatttcatcctggtgaggcagcaaattggcccagcaagccagactttaccacaaggaattgcccccaggccgccaaagcatttctgggagttctgtgtatccaattccacaaatatttcctgagtgcctactacgtgcccagcactctgccaggtgctggaaagaaaatgatgagtaaaacaggctcctggcccttcaagagcttacaatttaatggaaaagacagagcttaaatgagtaactgcacagatacatgattacaagctgtgatgagtgctgggaagagaaagtactcggtattctgagagcataagatgcttggcctgattcagtgtatggagtcaggaaagatctctaaggaagtgacatcagccaagatctaaaaagtgatcatcaggcaggggtcatgctaggcaggaatttgcatagcaggataaagatctgtgtacttaaaagaggaggtcctttctattggaaaattattaaatcatcaatcaaaaggaaggagggggagaactctgaaatgtacacagcaggaataaacttaaaatgtattcctgtgcaagaattatttcactccaaagaagaaaaataagcatccttatcttgaactttgctaggagtctctcttatatatttaaaaaagaaactgaaaagtacccagagctataatcagggcattatgtggaataaaattctaaaaggaaaaatacagatgacgcagaagttgcaaggtgagataacaatttatatggagaagaagaaaagggcaaaatgccataagccagtagcagtacagatatagggaaggcaggtttaagatgaggatcaaaagaggaccaccaggtagttgcaaattctcaaatacacgtgcagattatgtggaagtgctacatacatttaaatataagtaaaatgtcaaagaataatgccttagtgtgtttggtctgctataatgaaatatcataggcttggtaatttatgaacaatggggatttattgctcatagttcttaaggctgggagagcccaagatcaaggttaatatctggtgatggcccattcctcatagacaccttctatgtgtcttcatacggcggaaaggtagggcagctctttggggtttcttttataagggcactaatcactagcattaaccatcacagactacacacaattgttccaaatcagcatggacgttcaataaatatccattattgtggaggtagaaaggtaaaatggagaaggcccaggacttgtgtcctgactgcaatgcactgaagatctgaatcactgacctgtgagtttctaatgttagaatgcatttgaagcacctggggagcttagtaaaccatagactgattggtcccagcaacccccagagtttgtaatttaataagcctttgttggggcctaagaactgcatttctaactagttctaggtgatgatgatgttgctgattgagaacctttgttccaagggaactttcctcatctgcaaagtgagacattactgtctccaaggcccaacctcacaaatttgttgaataaaatcagtatacactttgaacatataggctgttccatatttgtcttgtatttcactgccaaggatggtatttttgagtgactgaacgccttgcctatattttctgaataaaaagacactgtgtgagtgtaagcctgtaatgatcaaatatctaagaattctgcataagtggcattcactgaagtggcatgaataaacagaaatttgaatactgaaaaagagagagaataactgagaagttatgtaggcaatactgtaaacatggccttaccagatgttaaaatactgaaatacttccatgccagatggcatatagctatgtccaagacacaccctgagtactgcacacccacaaaggcaactaaaaggaaccaccaccaccctgcttgagctcctgtaccagtgtgtattctgattgttgtgtgtcttgcctcactggtaattaaatgttttattacccttagaaaggaaagagaggatggaattgttgctagctcctcacaaacatctacccaaatctttccaatacaaatcctggacttagcagtcatgtttgttcttcctctgtatctttatttagtccgtgtaaatgaatataagatgttccaagagaaataggggaaaacggagaaaggagaaataccaaagaggaaaaaggatttaggattatatgtcattacagaataactccacttgagcactgttaaaacctgctctgaaaaatcagttcagaaaggcctatctagacggctaaaggagagaagacacagtagtcccagtatgactggtctatatgtgtctctctgttcagcattttccaaagctgcgtaaactttccttctgcagatgctaaaagtattccaagttgccaagtggcatgacatagttccgttgccagcaactctgccaccttgggctgcttaggtctacagccttgatgatctaagtggcctttgatgttgccaggcattggatagaaacaaggactttatactttggagctgggtcagtgttgtctctatttgtgctcagaaaaagggcattttctccactatctgagctaaaatttcttagctccaaaactgggattcactaaccaagaactaaaaactggaaaatcagggaataacagagtgtgagcactctggatttcttcacatgcttttccctgaatactacaaactgagctcattctttctgcatactcggagtaatgattagttaaagaaagcatgcttagaattataaaaatccttccaggaaatgtttttggcaaaaaatactcttccttagataaaattgaaatgcataatgtatgaacaatcccatctcaatttataaaatttcaaccacgtgaaaagacatgtttcttgctaaaattccttcatcagtttccattaataaataaatggtggtgctccttgcatctaccttaactgcaactataaaacactaagcctatgaatgaagcatttaggaaaccataatccactttaaattggatattatcaattcagcacaaagagtcaaaatggttactttcttccttgtattcattagaaaatacggtagaatggagaatttgtgggttctgtttgaggttcaattacacctaaacattgaccaattagtttataacagaaactatttatatcaatgactattttcatagttatcatattattgttatgattgttattagcagaaacttccgtttctgagtacagccacatgaaaccatcttagataggccgttagtagtaaacttgagcttccatgcaagaggtagctttcattacatgctgatagaatataagtgcttcctttcacatcactgtatatgatgtttccaaatcaccatcaacatgacttgaattttttttttttgcagtcacagaagttataatgattatcactattcccattatcttatctttctattgctacagaacaaatcacaaagttaggagcttaaaacaacactcatttgctaatttacagtcttgtaggccagaagatggtcaggcctcaattgttgtttttaattcaggctctcacaaagctgaaatcaagacgtcagccatgctgagaggggttttctcctaaactttttctctttcagattctcgagttgttaaaattcatctccttgtggctgtatgacaggtcgcagttctcttgccagatgtcagacaagaatcactcagctgctagagactttcctcagttccttaccatgaggtcctgaacagttcccaacatggctgcttactctcttctaggccagttagagcatgtctgtctaccacttcactgtcttttagttaagtcctctaactaggtaaagcacacccatgataatctcctttttgatatcccagcatattcacaggctctgcccacactcagggggaggggctattcagggcgtgtacacctagggatggagatcttgtgaatggaattctgcttatcacagcaactgtcatgaaaattttgctcaacagaactccagtgattgggttaacctcttcccccgaggccacaggggcaaggcaaagcaagtggttgagacacatctcttcttgcatctacttcacgcgctggacttccaagcagagaattttccttttaacaaataattatgtagtaaataaacagtttgaaaaaaaaaaaaaaaacccattttggactagataaatcaattagagaccatccagtcaccaaaatctcttctggcactaacagtccatgatttcaaaagaaataagttcaagtcaatcatagagctatagttgacaatttatgatagagtgaaaagaacatttaatttttaatcataaatattggattcaagttttgcatattccaattatttattctgtaattctgggacatctgtagtatcactatgccctttagttttctggcaaatctgtagtatcatacacttcagtctccatgcttagaaatgatgataatcattacagtaataataaaaacatatgtcttacaggattactgtaaggaccaaatgaagtagtgcatataacacaaaatagtatataaatgtaattctgatttatattattactactatgaagacttccctaccccaatcaagttgtttaatagataaccattgtgtttaccagctcaatacctcttgctctagtgaatgtctcttctcattcatcatatacattctgtatcatttagggttcacataagcaacataccttgttgctatggaacagcaataatttgtgaggacagcaaatgcttccggggtctacatgtctcaaagggtattatgtaattctaatgtgaatgcattttactgtaggaccaatgggacacgcaaacacatagtatgaatatttgtaatattcttgagaatatatttaagtggatatcctaagaagctgtcagaatccccagactcccaaattaatttcctggctgtggtacaagagctattatgagagcaaagaccaagtagaagccactgaagtaaatttttaaagacatctctatcactattgagccatgcacagaaagtttaaacccaaagacctaaaaggattcaagggtgatgattcctgtcacttctccatttaacactccactttgggctagtgcagaagatcgatgtattttaaagaataagaatgattttttataaaattaataaggcagtaatgattattatggctgcagtttcagatactgtttgctcactggatcaaacaagcatagcctatttcatctaacatgcaggtttcatttgataaaggtacttttccctctattctggtaagacaagaacaccactagtaaacaatttttacctgacagggccagcagcatagctttgacattctgtcttaaggaaatatcgaatttctcacacaatctcacaattcactactctagtctacaatattaaatacatattgttgacaggttctagagggcagaaagtggcagtcatctcagagatttatataaaaaaatgtgtagcagagattgagaaacaaattccatagaaatacatcatcttgacatcttagtaaagtgcttaaggatccactggttcagagcatatcaagatttttttccataccgaaaaataagttgctatatattgtatacccaaccactaaaaaggagtaggaacatctaattaactaatacgactttggaggtgacatttatcactgactcattcatatgattttaaaaagctcccagttttaatagaagtccaggtcaaagcaaacaaacaaaaaagttcttcaggtttcccaagatacagtgcaaattgttctatttttagtatttgtgacaagataatcccatggtgtgtaaagtggctgtgtagactggggtgttatatggagattgtgacaaattctaataaaaaatcacagcaaaacctatgtgcatttaatagtatagtaaaaagggcaagtacttataaacaaataacctttttttattttttaagatagtagctcccagcttcccactggtctctggtagaactgaatgcctaatcaatgaatgccagatagccatgcaacttgatattccattcttacatcgagtgctattggattaattttgcaattatgtcaggcaaatccagcggcagtccacctccattattcaatgaaaataatctacatggatcaggtctcggaggcacaaattgtataatcattttgtttacaggacccagcatgtatgcctgctcctaacgtatttcaacttctctctcaactgacacctaatgtgatcctgggagttccttttcactaaataactgcagatgaagattctatagcctgtcttgcagatgcatctataagatatacaggaaccacccagaactggactgcaaaagtgttatagccccattcaagaatggagttataaaacaatgaagactagtccagaaggtggctgcatttaagcactatataccattttgcaggagtacagcccaaggctaggatctacacaccactttctgagttgtctggtgaagtaattacaataatataagaaataaattgaaatattgataaccaggaagtttgaaagaaaagttgggatagatctttgggaatgggatcaggatctgaggatatatgtataccataggaatgctcaccagaagattccctgcagaagaggttctcaattacacggacagaataactccttctgcacatgtcagtacagcgaagtgctatggtggcagtaattgaggctgtgcatgaaatcaacaacagaaacttaagctctacaaggctatctgaatatcagttctgatgatttcttaacttgtcacgtaaggacccatccctgctatgaagccttgaaggaagacagcttcctaatatattttatattatggcacacatagttaatgataaaatcaagatgttgaatattttaaaattatatctaatgactacatagtagtcatggatataattatgtcatataattatatctaatgactacatagtagtcatggatataattatgtcatataattatatctaatgactacatagtagctcctcccataactctatgatattgagttctgctggtttggatgctggaaaccatgcagagaaaagggtgggaatgtaaatttggtcaacccccatggaagacagtatagagatttctcaaagaattaaaaataaaattaccatttgacccagcaatctcgctactgggtatctacccaaaggaaaagaaacagttttatcaagaagatacctaaacctgtacgtttactgcagcactattcacaatagcaaagtcatggactcaaactaggtgtctatcagtgaactggataaacaaaatgtggtatatatacaccatggcatactatgcagccataaaaataatgaaatcatgtccttcatagcaacatggatgtagctggaggctgttatcctaagtaaaacaactcagaaacagaaaatcaaataccacctgttctcacttatacatgggagctaatcaatgggtatacatgaatctggaaacaatagactctggaaactacaaaagtggggagggtaggaggaaagcaagggttgcaaaactaccggttaggtaccatgttcactattggagtgatgagttcactggaaacccaaaccccagcattatgcactatacccatgtaacaaacctgcatatgcaccccctgaatttataataaataagcacataaataaaaaatttaaaaagaatatcctgtgaatagaaagattctcctgtttcaagaaggaatgcttttttttttttcttagtatttttatttactgctggtgacatcttccacattccaaaataaatgacagcagttcacttctgggatggttaagtacttcctctccaaccaatcctcttgtagataactataaacactaaataaaatagaaaaaaaagcagctttctgaagtcattggagaatgaacaaatgcagggagaagctagagaggagctgtcacttggaagaatgaaacgacacatgggtgagttttctgattgtatggcttttctttctgaggttaagtctatatgagtggctgaaatatgaatgagaaccaggattttactggcataaagaaccaaagtactgagtttgggcatcacatacttggaagtttggggttgggtaagtgcagtggtcctggaaaacagaaagtcatagaaggtgacttccatattctgcaaatgcactttccaacaacctctggctgacccctgaactatatgtgttcgaggcggactctaagcagcccagctaaggctaaaaggaatgcagaggggttacagtttacaatctgataccagccacagtgtcggtctaaaacaaacaagtaaaacaaaacaaaaagcacactatctagaggactaccacataatgcaacatctctacaatgtatcattcaaaatgtttaagaaacaattcaaaattagatacataaagaaactttttaaatgtgatccagaatcaagagaaaagagaattaactgagagtgaatctgagatgaatcagatgttagaattaggatgcaaaattataaattcttcaatgatataaagaaaaatatacttataacgaatgagcaagtagaaaagctcaacagacaattaaaaataactaaaaaatacaatactgaatactaataatacaataaatatatatatattttaaaaatcaagtggacaagtttaacatcaattgaaagtgacacataagggtcagtgaactgggaaatcaataaacagaaaatatccaaaaagaagaaagagaaaacagtttgaaaattataaacagagtttcagttatctgtgtagcaatacccaaaggtatgacatacatataactggaatctgagagtatagaacaagaaagaattaagagaaaaattatttgaaatgattatggccattttcaaaatctgctagaagacatatatttacaaattcaaaaagttcagtgaatttcaaacaggacaaaaagaaataaaaccacacatgggcagtttttagtcacattgttaaaaccacagataacagaagatcttgaaaggagttagagaaaaatagcatactatttatgggagaataatgttacgagttatccttgacttctcatcaaaaacaatgaaggccagaagacagtagaaaaatgtcaccaaagtgctaaaagaaaccaaaactttaaaaactaccaaatttgaattcaaaatctattgaaaattactttcaaaaaggtagatcacataaaaacattttcagataaataaaaattatgatgtaaagcagaactacaccacaaaaattcctacagaaagttatttgggctgaaggaaaatgataccagataaaatcagatgtccaggaaacaatattgaacatcaaaaagaccaatatgtgggtaaatataaaatattattttctattcaatttctttaaaatatttacgtttaaagcaaaaaatatatggtgggatttataacatatgtacagataacacctgttataactatagcataaagaaaactggggccgggtgtggtggctcacgcctgtaatcccagcactttgggaggccaaggcgggcggatcacaaggtcaggagatcgagaccatcctggctaacaccctgaaaccccgtctctactaaaaatatattttaaaaaaagaaaattagccgggattggtggcgggcacctgtagtcccagctacttctacaggctgaggcaggagaatggcgtgaacctgggaggtggagcttgcagtgagccgagatcctgccactgcactccagcctgggtgacagagtaagactctgtctcaaaaaaaaaaagaaaagaaaagggggtcagtcaatgaacctatgtgattacaaagttttcacattttacatgaattggtacaatattaactctaaggacacctgaaaattcaaggatatttattatagtacctcagtggccattaaaaaaataaattattagagctaaaaagctggtagagaagctaagatggaattacataaaatattcaattaattcaaaaggaggtaataaataaggtacacaggtacgaagagcaggtaggacaaacagacagtaaactgtgaaacattagacctacctccaaccatatcaataattacattaagtgaaatgctccctccaaaaggcagagattataagaatgaataataataataaaaaagctagctaggccaaactatatgctacaatacagataggttgaaagtaaatatgtggaaaaagagatagcatgtattaagcaagcataagatagctgagtgactgtattactatcagacaaagtaggcctcaaggaaaagtttcactttggaatttcctaattagttaaaaacattaattgagtactatactcactacctgggtgatgggttccattctaccctaaacctcagcatcatgcaatatacccatgtaacaaacctgcacatgtaccacctgaatctaaaataaaagttggggaaaaaattaattataaaataaataatttgggtattccaaatttattaggaaggcataaaaatcaatgatttttttttccttttaattacactcaaacttcattgagctaagtgatttccatgtattttttttaggcgtgttaagaaatctataacctaaagttagagaagataacatttctgatttccagccatcatctatatgggtatatacttgctatggagttatatcagaaagccaataagttttcatactgaatttccttgaaaagcttccatactcaggagatctcactcttggtaaactcttcaaaatgtctcggtaccaactgaatcatttcctaaaatcagtaaccaaaattttctttcacttttttctttcctgtttttctctttccatccaaatttatgtttgtatgtatgtgtatggatgcacatattcacgacatgtgtttatatatatacactcttatttttaaaagcacatttcatccatctgtgtcactctagcaatactgaagttaaattgcctagccaaaaatattggcaaacaacattttgcaaaaacacattaagcaacacaaagcaaggaatctgtgttccttctctctcttttttttaaagtaactataccatcagtgcaataagggagaatcacatctaaatcatatctaatttttttccaaatctgtttttgaattttacattaaatttaagggatgggggaagagagagagagagagactgaacaacactgatgagtctcagggaaagcaaccagacaaacacacagagcaccattgcattttcatgagctagacataaactaaatagtagataacttttccaacactctacatctattgagtgtaaagctaggatttaaatctaggtggtcctactcaagggcctgctctttaagcccactgaactattccatcaaagataatcaaggctttaacacactgtgatgtttttaagggttcataagaaagtagattctcaccatggtaaactagcatttttttaagcaatcttactcactgaccttcctattttaaaaataaggtaacataaaaacagaataattgaaacattagagttaatttacataaataaatgctcttttcaatagctaagactatccaaaatctcaaaaacctattcttcatctgttggctgttaaaggagttttagaaaaagaaagctaacaaatttctcaaggtgagtagacattatcaaagcaaatcactgattagaatttgttttttacattctgactctactccctttagagaactaaatctgttagctgatgtaattagatagctaaaattcatgcttttttgtatgaacatttcacttattcttcataacaattaagagaagcaggtataccctgttatcagtcacattttacaaatcatgaaacagatgtccacagagatttggtctctctccaaagccatatgacccataactgtcagaatacagatgttcttaagcttgtgatctaaaccccatactcaatcaactatgctagctgtctcttacctttatcttaaataatcacaaaaattcttaaatggtaaatacctttcacagataatgatatgccaaaccaggtactattcaactgccagttcttgtgttgaatttcctaattaaaaggagtcaagctacctagcaactgacacctttggggaagggagtcagcttggaggtgcatattggggctatcctgagtgagccttatctcactctagatatggggcacaaggctaattagcaaatagaggcatctaaagttttggggtgaacttcctatattgaatacagtactatcaaaattttctcttcaaaattgacttgaatgaggtgcctaaggcaacataagtggtgctggtcaaaagataaagggatccatctcttcctagttgattaaaatgctcagactcaaagaatgctatttattgttgttcccccagtatgtaattaacaaaagacaaaaaaaaaactttctgcaagttcctaaagagtgctatttagcaacattagacactagagaagtagttttctaagatcaaagtataagagcataaatccaggtaattaccaagtaattactagcagccaatatctgtcttatttgtcagtgagatggtaagaatgactgaaaaccagactactttgtaaagaggagaatattaaaaactcttccattagcataaggtaaaaatagggattcttctcaaccataaatgctgatgtgacaaatcctgttgctgtcatgccatgtgacagacacaaccgcaaggcttggaccccagcccactgattatgccaggcaaaaggctggtgctcccaaacctcaggtcctcatctggcagcatgggtctggggccagtattataccaggtcataccactattgtgttttggtctatgataggccaggagaggaactggtacttcactaatcatgcagtttaaaagtaccactgcctgtatattgaggcccctcttccaaagtctgtcatcaagacctactagaattatgtgtgcttccctacaatgcaatgtgccaacaaaggggccacgtcactacccctggtgctgctttctcaatgcattttctccagtgtgccccagtagcttgtgcatgtgctgcttagccattacccttgtgagacttatcttacagtttcaatttctggactatgaacattagaaaaaataaataaatgtcttttctgttcaagtcatagcgtttgggggagctctttgctgtagcagtttaacctcattccaatcaatccacaggctatattctgtcagcattctccaagaccacccatagatttgatgactccttaggaggattcacaggactcagcatatagtcctgttcatggttaggattcattacagtgaaagcatacaaagaaaaacctgcaaagggaaaagtcacacagggtgaagttcagaggaaggccagcacaagcttccaagagttctctcccagtggtgtcacacagaacacacctaattcctctagcaatgagttggataaaacatgtgaaatgttgtctactaggaaatctcattaaagactcagtgcctgagattttgttgggggctggtcacgtagccatcctcggcctagcacaaaccaaaattccagattcccagaaaaaattaggtgttcagtatcacccacactgtttgtacagttttggcacagcaagccacccttatcagttctgggaatgcgaacccttctaaattccagtttttaatatgccagccaatgaccaaccttgcaaggaggcctttccgaggataacagcctcaggactgttatgttaattctttaccgcacaggtatcctaactaatattttatataaatccagcaaaaataaaaaagaaaattcagaagaataatctgtttcaaaatttgtgaatgaccacccctcaggaatgacagagaggaaataaattagtggtggggctttagccatatctgtaacatttgaaacatttaaaacaaacatggaaaaatattgatagctgtttaattgtatgatatacacatgtctataattttatttttgttcatctgtataactttgaaatgtttcatttaaattaaaagatgaaaaaaacaaaaaaaaaaaatcatacaaacaagaaactatccctcatgaaagtatatcattaataacatttagaaaggactatgcagtggagaaacagctgcgaagcaactcaaatgtgccaacgttaagagaaaattttgtaaggtccaccagcgtatgtcacaaattaagtgacttttaaaaaaatctcctgaaaaatattttggaactataaagataatgggtaccataacagaggaaatctgggtttataccaatatttaatagccatcaaccagtcaatcaatcaatcacaaatgctccacacacaccactctaacaataaatgaaattacatagaactccaatttacaatagttgtttagcttacaattcacttatatttttctaatgataaggagagagagaaggaaaagaagagatgaatgtgtatacacacatataggcctgcaagaatgagagacagaaacgagtggagaagagggcaggaaaaggagaggggaagcggaactgggaagaaataccatgaatacaaatgagagaaaatctatttctagtttccagcactaattcaggtattttcaaatctcaagtgtactagaggggcaaatgtctttaaactacatttaaataagtaggaagcactagaagagttacagaataatcagaaccctatagtactaatttgagaaggatggcataagaatcacattacaaaagattaaccatattaactaactttaaaaaagtctctgggattcttcatgactacttttagttaaaataataataagtacatttatttgtgatgacggcaccaatgatgctattctaaatactttatcttattaattctcaaaagaacccagtgaggaagacacttgtctttccccattttacatgtgtgaaaactgaggcacagaaagttaaaataaattgtcttagatggagcctgaattcactcaggcagactacatccaaagcttttatttttaactttactcattttgacacttcatttcctattatctcatactttatgaaaacataatattcaactaaaaataactacatttcctatactgattactcatgactttggcaaagcaaatgttattatacaggaaggagcaaaagggtatgtttctcctgtgaattaagagaaggcttcagtagcatttctcccataccagtattccaaagcatagcaaaaacacctgtctgggaaagcgctttatttcctaagctgttctataaatacctgaaagctattttaaaaacaaaaataaaacataaaccgttcctgaaaacttccatgcctttctaacttcccaatggtgactcctttttcctaggttcctagaaaaaattaaaaaaaaaaaaaaaactggctaaactttttttttaaagcttcttttatattctgggaaatgaaaaatgattatgagcttactatgagctaacaaccctagataattgtactgatggatttataagaccccaaacaaggaaaatgatcttcccactgcagtttgcacattggtccacatctgtgacactatgtttagttacgggtaacatcactgaaatggggcatttggaataaaggaccaggttagagggaagaaagggtagttagagggaagaaagaataaagggtagttagagggaagaaaatccatctttttgtgtaatttgtgtatattgtatattacgtgtatattttcacttctaaaatactaaacatatttactttgtgtatattgtctctctcccattgctcaaattggtattagccaacccaagctacagagttgagagatggagaagaacaggaggaaaaggagagtgtttttggcaaaagaaatggcattcccaaaggcccacactgaagataaagcttagcagtccaggcactgaaatttcagagcagctggggtgtagacagtgaaagaaattggtaagtgaaagcccttgtgagtcaggacaagaagggctggatgggaggtcaggggagtcatgagaggccaatgaaacattttaagcagggaccaaatctctgtgactacagttagataataaactttacttgcgccatttgaaattgttaatattcaactgttttagacctacaaaaatggcaactacgcatcatttaactccattaaaaccttcctgaaaggaagcaggactagaaaaccagggaagtgttcaatagtgaaggttaaaaaaaaacaaaacccacaatatggtttcagtgaaaatattgaaaatattgttattggagcagagtaacatgatgacaacctgtcaaggctattacagatgcgatacttctgcaggaaaaaaaaattaagaagataacctacaatctgattttaagatcctgaaaacgcgtagaaaacacaataacaaattctaaccaccccacgctatttttacaatttaaaaaatgctgtacttttactctttctcttaaaaaatatgtatgttccaggtgcgtggccctatgctgagcacatgagtataaagatgtttcgaggatcttaaaacctaacatttccatctggatagtggctgcaagtgcaacagagaagtgaccccttagacctcactgctaatggcagaatgaggaccagaactcatattccctgactcctggagaccagggcccctcccactgtaccatcctgctgatatttcataggcttcacctgagataggcagctgtgtctcttagtctacacattccatctcgaaacaagaggaagggcaagcatacataattaatgatggcactgtaactttccacagcctttatatttctatatctattttctccatgtatagccttgtccatcaccaccctatcccatcacaaacttcctacatatttaaaaaaaatccacccccttaatccaaagtagtgggaatattatatgcatacatcatagcagtattttgcacttgaaattcattgcttcaaagcatcttgataatttttcttgtctctacctgaccctaaattgcactggggtaagatgctagctaggtttaaggcacacactagttttcttcaagaacagttctttttaaaagaggaaaagaatagaagagaagccaaggggatagaggaatataaattttttcactgacttctttgcctaaagaggaaaagaatagaagagaagccaaggggataggggaatataaattttttcactgacttctttgcctaaaacaaatttttttcactttatttttactctaagttaattcaaagataattggaaatagctgacttttagttttaggaggaactagaaaagaaattttgatgtactctttgtcttcaaaagagtatgagtaaaaaaaattcttctacccatcggattttttttttttttctttttttttttctgagatggagtctcaccctgtcgcccaggctggagtgcaatggcgcaatctcagctcactacaacctctgcctcccaggttcaaatgattctcctgcctcagcctcccgagtagctgggattacaggcacctgccaccacacccagctaagttttgtatttttagtagaggtggggtttcaccatgttggtcaggctggtctcgaactcctgacctcgtgatccacccacctcggccgcccaaagtgctgggattacaggcgtgagccaccgcgcctggcctccatcagatattttgcaacagaaatattagtttccatctccttccttcatataatctcgatatgttagattaggattggagtctgctgtgggatattatatagacttggaaccagaatagataagataacttggactaaaatgcccactacttctctcagactaacacatttcctctttgttgttttaaattttttccaaatatgtaagtaataaatgaatacataattgaattttaaaattcatgcaataaaagatgagcaaaagtcttcccttagcatcccacctcccaattactatcccattcgcaaaggaagtcagtatctgtgctatcactgtcaccaattttgtcattaaaaatcaagagctaaatcttgttaccttcaaacgtaatattttgacatatgatgataacatatataatcctttccatatacagaatatttaagtaaagtcacaaccaggaaaataaaaaagatgtagagatcacttatatcattttattaataagatagtatatacttacttttaaatacatgtaatgtctgctggattaatgaactgatgatccaggctaggaaagaaggttaagaacaacagctcttcagcatctataactagattaaattatcagcacaaaccatgtattgaatttctggaatttgttttattaagaaactaaatttgaaaacaagctgtactcatgcaaaggacagtagaagattaaaagtaaactgtctaaacagtctatatctggatgtaaataccagctcactcttttctttttccacactgattttcccacaggaaggaacagattaaagagtggattacttcaagcactataaaggtctctagactgaccccactcttagagggagctctttcagaggaataatgctataaagaacagtgaaagccccaaaaaacccacagctgagcccttcagagggccccattcacagtcaccattgactgccctggcctctctgaggggattcaatataattcactgcccaccagaatactgaattcacaacagagaggaaaaaaaaaactgatggtgctgctttgcatctgtttaaatttttacagaaatgttaagggagttaatcttctacaagtccagtcatgtgctttcacaaagggccaagaaaggagtcccaaagctcgccatgactcaacaggaagctctttgtgtcttcctttctacaccatgtctgacaaagaagctgtcttaagttcatgggcctctgtctcttgcgtgaattctgaagtcagtgaagcaacaatgatgtcattgcttctgaagaccactgttggctgagataatgaagatctcttcacccaaaacattgccatttctgcagcatacatttcctaccctttcaaatacaaaagtattctaccgattgaggggggtgatgtatgtttattttttgcattattcaaaagaagtcatactgaagcatgtttccctctcaccaaaacatcttctaaaactgaactagtaaataccactacactaaaatagttgattcatacacttgaaaggaaaccaaaagttatgcttttgaaattagatatattattcaattaatattctgatactaaatgtccagtagtttcataggcaacatatggtatgacgtgaataaaatccatttctcacccttttagtctccaacatatacgcacatttggctttttttttttttggagatggagtttcactcttgttgcccaggctgagtgcagtggcacgatctcgactcactgcaacctccgcctcctgggtgcaagctattctcctgcctcagcctctggagtagctaggattacaggcatgtgccactacacctggctaatttttgtatttttagtagagatggggtttcaccatgtcgatcaggctggtctcaaactcctgacctcaggtgatccacctgcctcggcctcccaaagtgctgagattacaggtgggagcccagctgcacatatggcaaaagcaaattagattatctaaagaatatcaaatagtttaaaggcagttatttccacaaattttaaaaatgatagactcctttgaaaacaactcaaatatggacatattcaactcatatatccatatatgcagtctagcatgtataaggacaaaaaaaggcaaggttaaaaaaataagtgtttaggcaattggaagttcagcagaaccaaaataatgagtgtatactggggagtggcgtcccttatgaataatgagataaaatagataaactatggaagtaccaggcaatggaggacaaatataaaaaatttatattttatccaatagggagttgggagccactaaacatttttagattaataaatgacaaagtatttcagtttacaacaatgactacatcttcaatcaaaagcagcaatctccaaagcagagattgcaaacacatacaacaacatttactggagtatggggaaaaagaatctctatagttctctttattacagtcttgaaaatttatagctccatgaaagttctacaatacataggatgcatgttccataatgtataaatgatagtagtatatttgtgtgtgtgtgtgtgtgtgcatatacacacgcatgtgctgtggatacatggtccacaacatttggtaaccttctatctcaaaatggaatagagggagataggtttagaagcaggaaaacagtttaggatactgctgcagtatttgaaacaaaaagtattaggctctgaacgaaagtggaaacaacagaccctgggccattttcttgagagctatctggatgtaaaatttgtgggtactgcttaccaactggataagggttgtgaaaatcaggaagttaactgggtggatgttggtttcatttactaaaactggaatataagaggaaaggataaagaaggagtagtccagaaactggtggagggttagaaacaaactcaatgttagccagtctgagtcacaggtatctgtggaggaccttaaagagaggtaaggtaaggaaaaagcaaatgtaacagcacagttttctcatcaaagattttatttattttgcaagtaaatcagataggagaagctaaaaaacagatttcaatgaattaagaattaaaaacatgaagtaacataataacatggtatatgacaaagtatgaaaatcaacataacttgatattttataagaactataaaatatcaggaaaaaaactttcagagaaaaaaaagaaatgatgacacccacactggataatgaacactaagtggaggtgacaagaagacactgcagatgcagaagggaatatgactatatttacagaaagaacaagcaggggagacgatgaggaagcctagctaactgcatcccacactacatcagagcaggcatcatatgctctcttttccttccataaagatggacacatgacattacttttaaagcacattatgttggggtatttataactatgatgtaatgacttaaattttaaatattctgctttctggatttacaaaagtactaagtaatatatataaaacaaagaacccttatttttgctccatttctgaatcttatactcagagattaggtaggagtcaggggatagcctacggaatgctgttgcgcttttattttaaaatttctaaaattaaaagtgaaatggtcataatgatcatgaacaacctcaagttaaagcagcccccataaaaatgtctgccctgattcttaaaatgggctcagccaaatccactcctttttcacattggagttgacacatttcatgccctcatcacctctcacctggattagtactccagggaaaaacactccaagctcttttccctgcctctactctctcactcctctctatactccaagagtgtattctgcattccacatgaatggaagacagattttctaaaatacatattatagtacataacttctgtgagtatatttttttaaacttgtaaaatagggttcttcataatctggcattaaccgttcttacccgagacaaatataagaaaagtatatcagccgggcgcagtggctcacaccgtaatcctagcactttgggaggccgaggtgggtggatcatgtaaggtcatgagttcgagaccagcctggccaacatggtgaaacctgtctctaccaaaagtacaataaattagccaggtgccgtggcgggtgcttgtaatcccagctactcaggaacctaaggcaggagaattgcttgaaccagggaggtggaggctgcagtgagctgagattgcgcaactgcattccagcctgggcgacagggtgagactctattacacacacacacacacacacacacacacaaagaaagaaaagtatatcaactatagttttggctgtcgtaagacaggaaaaggggagaggaaaacaggagagaaactgtgagctgactgcccatcttgtgtagggcaccatatcattagcagcatcttgagacacacagaagtttagttttatagatgaggcagtgatatctaaagaggcttcctaaagttctgcaagtgacagagctgataattgcagagctgtgatttgaacacatgtctttctgatcacaaaacctatactagagaagaccatggatattcagtgaacatacctgaagctacaaaaagagcatcccttgtaaactatgtaggatacaatttaatgtaaaaaaaaaatcactactgcattgtagaagaaggagacccaaaacaactgatcaaagatagtaagggataaggagcctacactgaggttatcaggagacaaaagaaaatttaaagaaacaatctgctatgaagtgtcatcatgaagaggaccaggaaaataagtcctgagaacaacaatctgttgaaatttttaggtctctgcggaaaactatttatataaattgctgaggatgagagccatgttgagggggagctctataacagataaagggtgcaaaacaaaaaatgttctttagagaaatgtggtaacaatgttgataaaataaaagtatctgccaggcgtggtggctcacttctgtaatcccagcactttgggaggccaaggcaggtggatcacctgaggtcaggaggtcaagaccagcctggccaacatggagaaaccccgtctctactaaaaatacaaaaaataaataaataaataaaaataggtgggcatagtaacgcacaactgtaataccagctacttgggaggctgagacaggagaattgcttgaacctgggaagcggaggttgcagtgagctgagatcgtgccactgcactccagcctgggtgacagagtgagactccatctaaaataaataaataaatacatacatacataaataaaagtatctacaaaggatgaaaggacccaaattcaaccagatatttatgaagacaaaggacacttttatcatcttgaagactcatgcacatctttatgaaagttcataagatgaaaacaaaagagaaagaaacgtgtgacaccagtgactaagtaagcaagttctacatcctaaatctggaggaccccacaaactacctcttctgtgctatgcatcccactcctgagtcccattcaacccctaccctccaacagtgaaaagaatacagcccggagacttcattacacagtctgggtttgataaccagacatctaaggtgataagtgcaatttcagattacctttcttgtaattttcatctacaaattgcagagaatctttgacagtacaggccttcttctatgtcacactagttgttctacttcatttttcaccttccctaaaaattttagttgagagcttttttgttcagttttaaaagtacttgcaaagctttcactttattatctaattaaaaatgtggagaaaatgtttaagttatttttctggccatgcgtgagccatcagaatctgagcactttgtgaggctttggtgggaggattgcttgagaccgggagtttgagaccagcctgggcaacatagtgagacctcatctctacaaaaaaagtaaaagaaattagctgagtgtggtggtgcacacctgtagtcccagttactggggaggctaaggtaagaggattgcttaaatccaggagtttgaggttgcagtgagctatgattatgccaccgcactccagcctgggcaatagaacaacactcttctctgaaaaagaaaaaattatttttctcagcaaggttcttaacatttctgagtatcagagtcactcatcattcatttgttcaatcaatatttattgaagacctaccctgggctaggtactgtgctagacccttgagtaagcaatgttgaacaaaaaggaaaaattggggtaattccacctattttatataattcttgggagactcaaatgaaataagttttcaggaggaacttagaaaactgtcaagaagttatatatatgtgtatatatacacacacggtgtgtacgcatatgtgtgtatatacacacacggtgtgtacgcatatgtgtgtatatatatacacacacggtgtgtacgcatatgtgtgtatatatatacacacacggtgtgtatatacgtgtgtatatatatacacacacggtgtgtatatacgtgtgtatatatacacacacggtgtgtatatacgtgtgtatatatgcacacacggtgtgtatatacgtgtgtatatatgcacacacggtgtgtatatacgtgtgtatatatgcacacacggtgtgtatatacgtgtgtatatatgcacacacggtgtgtatatacgtgtgtatatatgcacacacggtgtgtatatacgtgtgtatatatgcacacatggtgtgtatatacgtgtgtatatatgcacacatggtgtgtatatacgtgtgtatatatgcacacatggtgtgtatatatatgtgtgtatatatgcacacatggtatgtatatgtgtgtatatatgcacacatggtgtgtatgtatatgtgtgtatatatgcacacatggtgtgtatatacgtgtgtatatatgcacacatggtgtgtgtgtatatacgtgtgtatatatgcacacatggtgtgtgtatatatacacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatgcacacggtgtgtatatatacgtgtgcatagatatacacatggtgggtatatgtatgtgtgtatagatatacacatggtgtgtatatatatgtgtatatatctgtgtattggacatatgtatgtatatattggatatatatattggacatacatatattggacatatatatatatacacatatatatatgtattggacagtgtgggtctaggtgtacacacactatggtgcaaatcctagacccacactgtccaatacaggggccattagtcgtatgcaactatataaatttgaatgaattaaaattcaataaaaataaaagttcagttcatcagttacactagtcacatctcaatagctacatatgaccagtggctaccataccggacagcactaatttagaacacttccatcatcacgtaaaatcctattggacagcagtttcctaaaagctgggagtagaaacatgaaacagaacatctgaatgatgccagggttgagcagtaaatgatactatgtgaaaatatgctatgggctgggcacggtggctcacacctgtaatcccagcactttgggaggctgaggtgggtggatcacctgaggtctggagttcaagaccagcctggccaacacagtgaaaccccgtctctactaaaaatacaaaaattagctgggcatggtggcaggctcctgtaatcccagctacttggtaggctgaggtaggagaatcacttgaactgggggggtggaggttgcagtgggctgagatcgcgccactgcactccagcctgggcgacagagagatactctgtctcaaaaaaaaaaaaaaaaaaaaaagaaaagaaaaaaaaagagtgaaagaaaggaagaaagaaagaaaatatgctacaaatcacatgctcaaagaaagatggctgataattctttataagattataaaaccatcacaaaggaaagatgtagttgtgatttaagaaaaaaagtcagagataacttattgacagcttactaagaaactaaagctaattgctttaagtcaatattagatttaatccaaagaacaatgcttgaagtaagcattattattttctctgccttgtagatgaggaatcgtaagcactgataggttaagtaacttgaccaaggttacaaaactatttaatggtaagcctttgaaataaactctactaaaagaaaagaaatatttacgtaacaataatatctaagacactgaatcgatctcattgaattagttattatgaaaacagcatcaaggtaatatatcactatgtgcttttttactttcagtgattaagagttattgataataatattttcaccatactatcaccattagttagttctctaaactttgtcttctttccttgtcttctttcctcaggaatggcctcctttctcccagtcattgtatcttgaatcaaaacccaagcatctttgaatattcacatgaagtccctaaaacacttgagccttcactgttatctctaaagtcacacaacatatattttctagatcattcactataatgcgaattgcacaatgatttggttttaatgccaatctttactgaagtatgctatactatttgatgaaagagcatatactgagcatctgataaataaatgataacaataacataccttgcatcaagaataccataggtgttcatctaaaatttatcatttgtaatttaatattgtcttcacagtttttgaaggcataaaatataaacactcagtttatctctaataagtgctttagttttctcatgaattagctgaaacatgttagctcttttttcctttctgtaatataggaaataataaagattattaaagagatatatgttagatagtcttgtatcaaaaaagtccatgcttagattcattatttctttagtattataaagacccagaatgaaggtctaatctcaaaactagctgaagagatcagattcaaatgtcggaatctgtttttacagaatatccttggcaaagtttactctaagaaatgtaacacagttggactgtcttcctttggctataaaacatctttcataggaatgtccattaaggtctgggaggtggtgtggggggagtgtctcaatgcaaagtgttcttacgttaatcaaaatatatttacggaaatagttgcttatacctaggtcttatattttagtccctatacctggaaataccagggggtattcccaaaggactgaacactgagcacttatggtttctcatcctcatttgtttattagtttctctgctgtataacacagtcaaagtgttctttaagctttagtcactggaactgggtacctaaagtaagaaactgccatcatgtttggtcttaatttttcctttgtttttgccaagaattgaagaagactaaaacagatgatctctctatttgtactgagtgaggcctggacatggtacttctgtcacttttctatctctggataaaaagttagaaaaatctgcaaaagtaagtatatggcttcatggtgaccacattaatactatctactctctgatgtgcatagataaccctaagcagttttaacagtatcaaaaataaaatataatgtttctatattcatgaagaaaatttgattcctttttactcacacataaaattctgtggaatttgggataaaactcaatatctgcagatattagatggaaaaaaaataagagtcaagtagtattaagatcccaaatttggatatacagacaatcagaaaactgaaaattccaaggttctcctagttacttatgatgtcaaagctatatttgtgatgttataagtgaaaaatcatgtggtaaggtgtgcttgagttatgcagaaaaatttattttttctaacattaattttattcttaacactattttttgctattttgcatttgacattttatcattcctcatcccaacttagagataaaaaaattttttaaaataaaaagctcctaacaagagtcctttcagcaacccttgaacacatagggtttctgcaactgtaacaatttgaaactacaacaacgtcaaccacataaatattagaacttgcacaatgggaataattttggaaaatatttctccctgactttgtgtgtagataacctacttaataatcagccctcagaaatggctgggaggctttgagtcaatggagagaaaagggaagggatggagaatattacatactagaattcttgcatgaagaataaaaaagaaacaaataaatagaaagacatcccatgtccatgcgttggaaaagttattgttaaaacgtccatactgcttaaaatacccaatatgacctacagattctatgcaatccctattaagatgccagtggcattttttacggacatagaaaaaacaattacaaaattcctgtgaaaccacagaggacccttggtagccaaaataatctttacaacaaagaacaaagctggaagcatcatactatgggacttcaaaatctataaccaagcaaccatgaccaaatcaatataatattggcataaaaacagacagactaatggaacagaacagacagcccagaaataaacccacacatatatggtcaaatggtcctccacaaaaatacacaatggggaaaggagagtctcctcaatgaatggtattgggaaaagtgaatatacacatgcaaaagaatgtaattgaaccctcatcttacaccataaacaaaaatcaaccccagatggattgaagacttaaatgtaagaactgaaactataaaactcctaggagaaagcaaaaaaacttcgtgatattgatcttcacaacgatttgctagttatgaccccaaaagcacaggcaacaaaagccaaaatagacaaataggactacatcaaactaaaaagcttctacacagcaaaggaaaaattaacagggtgaaaaggaaacctatagaatgggagaaaatatttgcaaaccatatatctgatatgagaataatatccaaaaaatctaaagaactccttcaactcagtagcaaaacaaacaagcaaacaaaacacacacacacacacacacacacacacacacacaaaacacacaaaataactcgattaaagaatgggtgaaggacttgaatagacaattcttctgtgtaaaacagaccaacagacatatgaaaagatactcagcatcactaatcagggaaataacaatcaaaacagaagtgagatattacataacacctgttagaatgcctgtggtaagaaaaataagtattgaggagatgtagagaaaagggaacacttgcactgttggtgtgaatgtaaatagtgcagttcctagagaaaataaactatgttgaggctcctgagaatattaaaaaatagaactaccatatgatccagatatctcacttcagggcatatatccaaaagaactgaaatcaggaccttgaagaaatatttgcaacctggtgttcacttcagcattattcacaatatcgaagatgtggaaacaacctaaatgttcactgatagatgaatagataaagaaaatgtggtatatatatacatggaatattatccttttaacaaaggatagatctcatgttaagcattcttaacacaatataaaaaaatataaagagactcaatattcagctcctggattcaagtaatatttaaaaaaaacagatttgtaagctaggttgtgttaagagagaaagaattttcttaatacttagttctcacacagtacattaatggtaggcctggagactatatcacaaactttttaaatttgttttggttttgttttcctgttgggtagagaaagtcctgtttatcataagtcttagtcattagtctggattagtgaagaaaaagcatataattagaagaaggaaaatacaagcctagcccttttggtcttaggatgcctctggatgagggaaataaacagaactgggaagacaatggttgtaatttcttcccagttcccttcaaggccaagtctcagatggggagagataggattaagcatacaggattaaaatacaggatttttacatacagattcaagggtcaggcagaggttctttaatttggattaaagaggctaaaatatgcaaatcatcaaggaactgtaagagccaaagccttttctcctactctgttttggagattctggaagaacactttatgggcggctaggacatcactctgttcacaatctaagaagctgtgactccccacaattcttgtgcaacaagaacagcaatgtctgagtctcctggggagcctgtgagagagggctgctgaatcagtgtcaatgtgggtcccataccagaagctgtgagtgagtggatcatataggctggacaaatagcagtcccagccataactcagggtggtttgctgtactaatgacagcagactatatagtcaagctggcagtaaataccaacagggctagcagataccatgcaaaaaagatagccagcccagcaatgcctacttggccagccacaggaacccatactatggttaatataggataatttcatatagaaattttaatagacataagatgcattcaacattgtaagataacggaactactttttcctgtttttttctttgttttatccttgaacatttgtaaagaattaatatgtaccacaatgaaatccttttattaataaaatgactgttcattttgtagtctctactacttatagtaaattcttcgcttcccatttacttaattcctatttgaaatataaaacttgaagttaattcaaactatctgagttagttgctttagtgtagttgtcattaggtagtgaaaggaagaaatgggaacgaatgatgcttttatgtacactgcaagtgggctgagcaaatattcaggtcctgagtctcaatataatgggggccacaatcaggaaatatgacaaatccaaataaagtagggtttttattccacaataagaatccaggtgattgttataataattttgtccaatttatgtgtttcaaactgcaaatctataaaaatagtcccaatatgtttcagagatgcccattaataatatgtgtaagtctgagctggcagcattttagaacactgcttccacatatttaagaggaagggtgctggtgagtgacaaaatgataccctgcagagaacttagatgatagcaacctaaggtgaaccacacaaacgcttctactgatttttcaaatgttgggtcaccaaagagaaagggatattaaaggagacaaaaacaacatatcccagcctgattaacttaataccttctttaaacataattagaaagatccatttactgtacatagtagtgatgtccacaagggcttcccatgagacctagaagccaaggccaggcatactaaatgaggaaagacaatgtatatcttcatatattcccatactggctttccctatatgttatccaaaagttaggtatgatgaaattaaaaaaaatggttctaataccccaatttccattagtagaagactctttagggacactgtattaatacaagtatcatagaacaggacataaagaaaatctgcttttattatttgtttcaccttttggtgagacaagaacctctgggcttagacatggcttttatccctgtagcacatggaataaaacctgacgaaacttgaaaacataaaaacaaaacctgccaaagtgctgataaagaggactgaacttagggagcaaaatattttagtatccctgagacttgacaataaaagaatacatagcaatttgtaaagcacactagagagaaccaaggccttccacaggaaatgggtgataaatgcttagaactaaagacagtcctgtgagaaagaatggccacaaagacttaagatgtttgatattatcagagctctcaaataaaaaatatctcaggtcaaaagcactgaacaagttagagtgggggcatgtaagtggttacagtagttctgaaagatgaaaaaacttcttttcattcagacttgtaaaacatttttttcatatacttagtaaggtgctgaaagtacaggaatatgctgtatatagttggttgtttatgacaatctcaatacaatcttattgagggaaatagctccaatcattcctgaaacaaatgcttccagtatatagtcccaaattcaagaaattccactgagaagttttaaatttagatatttagaccagacaggttacagttgaaaattagagtaaaatttctagtatctagaaagaacaaaagcaagtattcagctcctgttacaaaattatgcattaaaggagcatttgttttagcctatgtgtagttctcacatttaaattgacagtaaactcatgtaaactcaaacaattttcaaataaaaatattatttcagagccacatttatttttcccacattttctttttctttaacagacaccatcaacctttaccccatatatcaggaagatgcccggtagaagactcatatgaaaaagatcctctgaagacagagggtagtgagaataacctaactgaatcctccacagagacataggaggtgcacacacacacatacacacactcatgcacacacacagacacacaatttgcaaaatcctaaatgaacatgttcaagagtggatagtattgattctcataaataaatattatgtttaaagttaatgcttgatgatccagcaaggaaaataaaacaatgacaggaaaataaatgacatctaatttatagaaaattatcttttaaaaatatattcagcacctgagttataaataaaaatgatgaaacaaaagattattaaacctccagaaacgtctggattcctaacacaaatgcttcccacttactaacatgaaagtttataaatcattgtacctggaaaaaaaaaaaaagaagtacaggctttaaaatgtggttaacgtggaatactatgcagccataaaaaaggatgagttcatgtcctttgcagggatatggatgaagctggaaaccatcattctcagcaaactatcacaagaccataaaaccaaacaccatgaacaataacaacacatggacacagggaggagaacatcacacaccagggccggtcggggggtgggggcctaggggagggataacattgggagaaatacctaatgtaggtgatgggttgaggggtgcaacaaactaccaggtcacgtgtatacctatgtaacaaaactgcaggttctgcacatgtaacccagaacttaaagtataataaaaaataaaataaaataaaaataaaataaaatgtggttaaggaggcacgcttggcatgagcagagtcaaaatgtactcaaaatttttcttaaaaaagggtctatccctcctaagcaaaagcagttgacatgcgagaaagcaaacactacattttgataatagagtgtgttttatattgaaaaggagcaattacattttaaatactagcaaagctttttcctggtatgaactgcttcctcatgaatcagtaattgatacagcttttttctgagtaggcaattacttaatttaagaatcaagatctggcccaaattatctgaattggctttctaccctgatgtatgtttactgccttcaatttcacttcagtcagtcaaacatatttaaaacctcccagttctctttctccattaatgcaagatcaagaactaaatagtaatcctgagctctgaagtctcaacacattttgcgtcttttcatcttcaattctttattggaaaaaaaaatatagagttacatttgtaacactttaatcctggtctatctatctcctaaataagctcttttcattgaacctattcatacagagacagaagaaactcagtaaggcaatttaatgaaaaaaataaagtattatcctttatgtttcacatatgaaagctctttaaccttcactctgattcctattttatgtaataagtcaatcttcatattgccttcattttgtcaataattgttataaataccccaactgtgaaacatacaaaactaaccagacaacagattccataaatatgattagtatttccacatgaattcaatagtaatagccttgacaaatgattggctgctaaataagatgatgcaggtgtaaaaattttgtaatttaacacttacccaaaataatgattgctacttgatcttagtaatttagtaatattatgttccatacttcatttactaaaaaatgtctgctgaaattaatttctattgttcaatatttgtgtgggttacaaagcccaccaatgattctctttgattagggcataggtcatgagaacttccaaatacagcaggttagagtatatactgacatgtctacagattcaaggaagggctctgggcctaggaagtccctaggagcaataaaataagaaataatcttctcgtttttctagttcttgtttcatagtttcattccctggcaaccagcagcaactcccaaatcatttctgacttctacatgtttcccacctgggacaaaaacacgccttcacagcaccatgacaaccacaccagcaacacaagcactcgggttcatgcaggaaaatgaaaatcctgaaaggaagctaggagataaaggctcactattccttgtttcccactggtaggatgtaattacaaaaattactttaacacaaagcttctggtgaatgaatagtgggtaatttgaggggagaagcctagggcctagggattaaattaaaaatgtaaaatgctgaatgatgtcatacaagttcagccaccttcccccaaaaaagtagactgcctaaagcaaactccttaatgatgacagagtaaacattcttatgagataggcaggggtatatttttttacatgagtttagacaaatgattgatttaatagtagaggtgaaatttatgaccctttaatttttattaagtatattgttaccaattagagtttcaaatataattttgtccaaattaaagagtttcaaaatgtcatttccatgcccctaaatctgaaaaagaagcaaattaaacatgcctaccatgatgaagtagacaaatttctttgtcataagcatgccaagtttatgttttttgtgtaatgaaaaggatgctattcgtttgctagaaactggcagtgctatgtgttatgaatacttgccacttctgcactagaagacaccattatttatattgccaaatgtaaaactgctttagatcttattctttaaagagtaattctaaagcagagcactgcatttttgacttaaaaaaacatatttttaaacaactcttcatatgtttcacattgtgaaaacaatacaacttttctattaagagtcaaggaagaagaatccgctatatatgggattgattgattgtttttgtgttgttgaatcgtaccatatgacacattatcttaacagtttcaaagctgtgacttttgttggaaactcagctgaatattcttaggtgacaggaaatagaaatagatattttcatttggtcaagcggaatagcttagggctccagagtgtgggagaagcacaatttttgttttgcttctagttttaatcttgttttctggagacataaagtcctccttatctatagcaaatatctttcataggctcccaattctgtgcagtgtataccttcagattctcagtgatacacctgagaatgacagagtagaaggcaagaaggggcattctaaccatcaacgagccaataactgctacctcactctcaagctaatctctacccatccctaccacaagaaatgtttagaaggccattcatactttgcctctgggacatgaatatgaaaatacaccattttgaaaattcactcagtgttctaaaagatcatctatcctaatctactcaaattggaccaacttatcatcctcctttatcaagcctatttctgtttctcattttatatacctgaattctggaaagagaattctctagtcttctagattagaattctgagtcctccttaaacaatctctctctctttccccatgccctccaacatctatcccatcacaaaactccatcagttttccttcaatttctacccacttggttctatctctccatcatctagttcaggtcctaatagattttaatgtataacacttgcaacaaactacagaactcaaatgaatggcagttctgaggaactaaactgccaaatcaagaaatgtagctagccaattactgtgacaactagcaaaatagggcagaatattacatgggccttactgatgaaatcttgcagggtcagaaatggcttgcttatgatcaaaactcctactgatgacttgctgtcagagaaatgtatggagaccatggttctcaaacacatttcattccatgtaaggcttagcttatggattttattcctcttcctaaataactcattaagaaagacctcatatgtttcctaaaataaaatcttgaattaatccagaaaaggcactattttatatagtgctttggttttcatttataaatcaatatatcttcctaaacctaatttttttcaattttaaattttaaaataatggaatacattacaaaaatatgttcttaatttacagttggaaggtatttgatctatgagaagacttggctctccatcttgctaccaagaagttaaaggaagaatttgaaagttctgaatctgaatcacttgttcccctaggcaagagagttgcacttctaacatatatggttacaattcaagattctcaaaagaaggtaaattcatatcacccacaacttaattcaatcagaacttcataaataagaaggtgaagatcattaagctcatattaacgtttatcatggaacattttaagagaactgaatgattcaattttgattcaagttttaaggtaattgagaggtgacaaaagaactccttttgctctgacccatgaccattgaaacttgtctcaaaatatattactctagttggtggcctacttcaactataattgcaatcttctattcatgactgaaaaactcagtcttcagtgtctgcattattaaaaagaaattttaagtaaactgagtatgttgatgctattgaaattgacattttaaataattttctaaagcaatgtcccaaatttctgtaattccatccaattcctttgtatatacatacgctgttaatttccctattctatcatctaaaaatacaataagtattaaacataatatttcttgtaactttattacttcaagaaaaaaactcttcttcttataaatatcagactaatgaaaagtactagggctaatatttatagaaatagataccttcaggaattgaaatgtagtaatagggtacagcctgatgaaactacagttatgacagatggacctgatgggaggacagacacagtaactgatctggcttccagttctcctatacaattccatagcatgtggcctatgcgttcctaaaaaatatttaaccattgctttgaaagaggtattaggtattagtaatatggaacaaccaagatttagatattagtaatatggaacaaccaagaaaaatcactctaacctactatcttttccttaacataaccagtcttctgatttagaataacattttaagaatatgaaaattgagtattcacatgaagacaatgactaatgcttcaactttaacaaaactcttaacatgcaaaccttctgcaaagatattaaatattaacaggcaattaaataacagctagcattcattaagcacctatttttgttgaatactaccttcagcaatttgcatatacatctaatattattacaactgtgcaatatatattacttcttttttcattaaaaaactgaggctcagagaggttaagtactaatctaaggtaacagaacaacttggtgtgcagagctattattactcataccaagtctaactgcaaagcctctacagtgactctctaagctaggcatacatttcataatactgtatttattaatatagtcctgttgtttcaaatgagaaatttctttaaaattttcaagatatgttaactttaaagttatcttaaattgcactattctgttcataaataattttaggggaagttagtagcatctgaaaatcaaactaatgactaggtagcaagtctcaaaaggcaatctagaagacaaattatttctaaattacttatatttacttatatccatgtcatttccctaaaagaaaactctattcttcattaagaaagttgtcttggcaaatgtaaagacttcttgagatttggttaaaaaaaaaatagattcctaaatttttttttctccccaaaggaaattttatatccaatgtataagcatatctccttaatagtaagttactttcaggtttcatttaaacaaacaaaaatagaaaactttgatgcaacataatttacttgactttagcagttctagcctaatttgaaataaaattccacagaagaatttcattcattgtctcctccatctagtaaaagttttgccaaatagattttaaagacaagtggcatattattttcaaatatatccatcacactggtcttaaaacaaaaagcaactgtttgccatcctagtatacatcctttaaaaggtttaaaataacagtgataattcataattaagatacttctgtaaaatacaaaccacaaagattttcaaattttaacataagctagagaaccaatagttttaatataaaggtattaaaagaagtcatatcagggatatataacacactggaataaatatctgtaacatatactctatgcattttttaaaaagcaagccacatttcatgatttataaatgtaaacttctttttctatctccgcgttatacaagagaacatggcaatcacattctcttacttgatgggagagttgttttcatcatatcttaaaattatatttcattattaagctttgtcaagacgcctacctctgtagtggaagtctttggacatgtctatgggagcctgttctacagctgatctcttgtagacaacatgaatccttcctttttcttcctccatctgtttacctctttccaagggttcaatgaaatactcttcattatcactttttatcattccagcctagagaaagcacaaaatgtgttaatttaaaaaagaaatatctatcatcttcagctcacaagcacatctttttaaatgtcaagaatatgacttgtgaaaactaacgctttttctttccacatttggccataacttaaaatagttttattaactatcaataattaattcatataaggtagaaattcacatatgacagaaatgaaaaattcatattaaggtattacggaatacaaaatttacataggataagaatagggaaatcatacaatgtatatattttatcaaactgcaaaataagtgcatttatatattctacttggtattttatatctagtaagaatcatatgggacacataaattcaaaaaatctctaatttcccaaaataacccattgtggagcagtggtccaaacgttacatacatttttacttatttacatcttcccaccaaacaaagtggcatgagagaaatgagttccatgctaccttcagtatgtaaagttatttctttaaaatagtctcattaagcttctgtggaaatccccatttctaaagtttattcatttgaagaactaactcatatttgtcctagcttaatctaactttatgatttaaattataactttaatattatatatatatatccccctcaaactgcatcctttcacactgaaaagcctactcttgctttcaattccttccatctctctatttattgttttctgattctgtttcatcttttaattattcagaaaacaccagggctatagccagtactatagctgaagaaaaatgatgtttttttctaaaatgcgatatttcttaaacatcaagtccacattacagtcaagtagttgtggctcgtgtttctactttaaacatcatacaataatacgaaatattaatttaaatataagcacatttatttgaaaacaaaattcaaacaaataatgtcttagtgtggaaactgtacttattttggaaatatatatcagatttagagatgccatattttttctcaaacctttaacttattctgtattttcacacaagaggtcactggctctcatgtaacacagacaagggaggagtttcttactccttcgaactatgttgatgtctttgccattatgctatcaagcaacatagaaataaaagggaggtgtcctttaccaaagagcatatgttttcagcaaatataaatataaatatatatattcatatatgtatataaataaataaatatatatatatttagcaaatatgcctatgactatagcttttctgtcacactcaaatctgtccttttcctttctgttctgacttctacacctgggtatagtatttcccttctttccctttgtaagcctcacagggaattcttaaaagctatgccatctccatatgccacttctacgcttgcctttatgatgtgcacatacaaacagccctggaacctatgcgaccgtgtctcacaagaaaacattactacaactcttctactattcttggcccataccctctggaacaaacctctagctttcacttaaaagagcattgagctagtgggtacttagtagtaatgctgatcttccagatactccaataattggagtttctttccttatctgactaattactttatacttagtcatgtactatgaaatgcacatatttttcaaaagttatataattattccctattcagagttgttcctattggttaatggattcacctcttctacaaatataatttccaacatcttcctcatgctttcaaattttaattttaatctattctatattatggtcatattattttatctcctattaccagtactttcaacactcactgctattggccttctcaggcattaattaattaatgtccataaaatacatccaaactaagcacaaacacagtaaatgtataaaaagttaataaaatgtataaggataaaatgttatctcatccctaacaccatctgctggtagcaaaaagcgtgaaccggctttatcccagaaagataggtctgtttaaatatatggaagtttataaggtgaagtgcatcagcatgggagtttcagtattcatctttattacagtcttttctttgccccaaatccgctgtcactgcattctgtaacatctacattattcgcccatcctcctaagtccactaacatttccttagttataaacatcatcattgtttattcggattacagaaactccctatcttaagattttccaaagatcataatgattctcccagatgagtgcctgactcagggaagaaacagtgccactgaagcggtcagcgactctgagcaatgcgcaatggctattgcagtcacttgaaagtgatagggagggcagtgaggattagcccatgggtcttttgaaaacacttctccatacctgctatggcaaacattcaaatttcaggccacatgatgttattttaccccactaagccacaggtaaaacaaaattcaacacaattaaacatctcacttagaaagcaaagaaaatttaagtcaaactgagtcagtattagtgacaaggcaagagttggatcaagtgacatccattaactccatggacccaaaatctgaaagtcggcccttttatttattaatttaagtaaagtttaatgaaagaaagtacttatataggctgggcgcagtggctcacacctgtaatcccagcattttgggacgccgagatgggcggatcatgaagtcaggagatcaagaccatcctggctaacacggtgaaaccctgtctctactaaaaatacaaaaaaaaatttgccaggcgtggtggcaggcgcctgtagtcccagctactcgggaggctgaggcaggagaatggcgtgaacccgggaggcggagcttgcagtgagccgagatcgcaccactgcactccagactgggcgacagagggagactccatctcaaaaaaaaaaaagtaagtactttatataaagcactgtactaaatatactaataaatgagaaatcctgcaagacagttcatttgtcctcatttgattaaatccagttgaataaataaaatacatgcctactgaaattcaatgagtatgctatggaaagtgcagaaaagtaattgacagggcagttgatagtaaaatcaagtaaaatttttttcctccataatctcaccagacacagaaaactgttagtaggaacagttgatttttcactcgaaattatctagtatctatttcaactgaaatgttcctagtccacatcacaataaaccttcgctttggccactgttactgtccacatgatctacatattcacatagtgtggcagccaaaattgccctttaaaattatcatattaaatttggacaaatctgaatttggtagcaagtggagcaagcatgtaagggctcaaaacatcaggtgcttctttctcactcacataaagctcaggatggttttggattggccaggaaaggtttctactccacacaatcatccaggagtccaggttgacagtggctctatcatcttaatataagcttccagtattcctagtcaaaacaggaagcagtatgagggagcccacatgggaaatttttatgagctagccctactcatggtattcaccatttccacttactgccacagataggatacagttgcatggctcacagccagctgcaaagagggccaggaaatgtaatctggctgtaagcccaggcagaagagacaaatggattttgatgaacagatggaagtctcaacctccaaaaagatcatgccactcctttgcttaaaacactttaattgcttcccattgcacttaaaactgcactcattactttggcctttaaggcccacgtcatctgcgctgcccaccatcctcaagtttgccattctcagtgtcctcacgaggccccaacctcaggggattttgttcaattttctttttctttttctatttccaaggtccttataacatcaggtctttgcaatgccattcattctgcttaaagagccacaccacacttccctaagctggctggtttttattctccaggcttcaacttaaatgttatctccttaaaatgattttcttactccctcacctcacaaaaatgaggtgcccccgtctaaattagatcctctcttagccaattattctaactgaaaataatgtgttcttttctctcctggtccttaacacaaatttcaagggtgtattcagctgaatgtgaaatttatggttctctgtctcccctgtggaactgttagctactaaggcacatatatctagcttagctcacctttgagccttaagctccatcaaaattgctcgcacaaaatatgtattcaataaagttctgatgaaaaattacatgaatgagtgaatgatacaaatgagggaatgaagagcttttagacttttggtgattttccaaatatgggagtattgctatagtggggatagaatagaaggaattagaggtgaggccgttcagggtggagcaaaggttctaaagcaagcttgtccaacctgtgtcctgtgggccacaggcagcccaggacagctttgaatgcagcccaacacaaattcgtaaactttcttaaaacgttatgagattttttgtgattatttttaagctcatcagctgtcgttagtatgagtgtattttatgtgtggccccagacaattcttcttccaatgtggcccacgaaagctaaaatactggacacccctgtaagtacaaaaactcctggcacacatgtggacagcaagcaagctattcattcagggaagagttcatgcaggggggctccaaaacaatgccacggaggactattagtactatcttgggtcagaattttaacatgtagaaacagagacccaaaaaataaataaataaaaaagaatgttgatcggatggactagaacaaaatactattttcatatttctctgatgattaagtgccagatggaagcaagcaagaagctaaaataacagtccagatagcaaaagtggcaatgggaagagaaaagggcaggggagtggggaaagaattaatttaaaagtgatttcaggaaaaaaaaagtggtaccttttaaaatgtaagctcctctattcaaaactttcgaaggtctccccttctcacctagattaataaccaaagttcctaccgagtccacctaggccctccctcatctcagcatcactgccttcaagactccatcaccgccttcaagactccaccacctctccggcctcatctgctcactctcttccttgctggcttcactccagccatgatgggctccttgctgattcttgaatacttaaggggtgtttcccctttaagacctttgcactggctctttcctctacttggaatcctcttcccctaggactatgcatggctaacattttcacctcctttaagtccttgcttaggtgttgcttctcaaagagcatacacggactacccatctgcttctcaacccagcaccccaagcctctttctctacactgttgtttccactgcacttactgtcctccgacacactcgatcacttaactgcctatcatgttcattgtttattgttagtaacccaccactgcccttctggtcaggaattacttcttggtctgctttgttcagcttgttcaactatttatctcaagtgcttaaagcaatacctggcataaactagacactcaataaatacctgataaatgaaaaaacaacaaagaaggaaggcataatctaaccttagttttgaagttggatgactatgaaattaatgttttcattcacagaaacagaaaagccaaaatggcaagctgactggaaggcaggagaaaaagttaatgcgttttgttttaaccattttcttgaaatagtgatggaaattcccagcattcagtggagaaatacagaattgtaattaagaaaaaaaaaagtcataaccgcaatggatttgggatacatcttctcaggggcaatagctaaagctgttaacagaaatgaagaagaaaagttcataaagagatttgagggaaggtcaatagagaatcctaggaaatgtccatataacgttaggaaactgtcatataggaaattcctaaaatctaaactctagaccatggcctataaggccctccatgtcctagccttgtctatttttctggcttctaacactttatgccttgctctttctgctctagccacatggtcctagtcccactggtactaccccacttatatcaattagcatcgctttcactctctatcctaactttttcccttccagcatggctaggtgattgcctggcccaattcagtatataagcttcacatgggcatgggctttgccatattcactgctatgtcatatcccagggtctagcacagtgcctggctcaaagtaggtgcataacacttgagggagcatgggagaagaaatcaatgtaagttatggacaggtgaaaataaaacaccttagatttagaaggaagctgaaaaggaatgatgagagacatgaggaaacccaagaagagtgtcatgggcacctaagtaggagagagttttgtcaaagaaaaagtaactgcagtgaagaagacgcagagaatgaagtctgtgagaaggaaactagacatgtaaaaacatttaattagagtagtgggggctgaagagatattacaaggagttacagaaagacttaagtgtcaaaaccacatgtttttcagatcccagaatattcacagccattagaggtagattcttctgcacctcttcccgtcacactatattaatatttctctgagtagctatcaaaattggagtgactatttttaaagtacctgagattttagacaggactgtcctatacatacttaagaaaggaaaaaaatcaccagtactaataactaaatagtgaaagttcttttatccactagaatgcccatttaggtagtcatgcattcaacagatgttttgagaaactcaaagaccatgcactgtcatacataacctcaataaaaaattcacattcctgctctcaggtctgcaacattttatttcacaggatacatttagtacatatgacaatgaaatgacttacaggaataagtgtgcataaaattctaagtactactattatttataatgacaccagaaatttatgacttagaaatttttagaagtgtcatgcctacaattatatattctcctgagggattatgtttaaaaagatgcaaccatttttaattttcatccttaatctcaattaattggcatacaatatcaagataatgttttataaatttccctatataacataaagtccttcacataaagtcctgcattgatatatgcagagattctaatctctgcaatgatacatgaaatatttagtttcccaaactattttccaaaatttaacactaattttttttaaatatttatttttagtatagcattaagcacattatgttaaacatattttattttgctttaattcttcatataggccctctgacagcatttcggaggggatatttataaaacaatgatgtatgctaaaaagccagctgcaaaattcccctcatttggtcaactcttccagctacatcactcaactcaaacactgccaagagttcagaattaagtcagatagcctcagatgatgaaaacagcgatcacaaaggccacactccttactcactaggaggggtcctcacagccatatttgaagcccaattataataaactaggttagatggttttctaattctcatcagagcataaatggcaaatgggaacaaggggtgtgggatatagagagtttcagatgagataatgtctatgaatgccctttataaactacaaagtcctacaagaaatgtaaaacactagtttttatatgtctataataataaaaatcagtcatcaagagaagactaaattgtgtttaagacaaaaattagtctaagtgacatttttaaaaaagttccatcaaaaattacaatgttttcttaaaattctgtgccaaatattctaaaaaacttatgccatggacaccttccatttctaactgtgacaactaaacgtggttttattgcagttcttctcagatccgctaaggaaagagaatagagatgggtagctttttttggtgcctcatgaaataggtaccaatcatttaatatagaattgcagctgaaactaaatatttatcattttgtgctaaatctgttacaaccttatactagttcatagcacagaaatgcatagtaagttttaaatgtctggaaaagatgctgaaaaaatatatatcaatattgtgtgtgtaagacggagaatacatgtaaatataatagtctagtaagactatcattataccttagtggtacaacaacattattttagttcgctaaggttctctaaaaacacattctgtgaatcaccgtttcactgttatttcctcaaacatctgttctatcaatgttccaagcaaacacattgtctaattccatttacaatgagaatggacagatttttttttcttttttttcttttattattattatactttaagttttagggtacatgtgcacaacgtgcaagtttgttacatatgtatacatgtgccatgttggttttactatatgcagatgatttctaaatatttcctgaatttcaggcaacatttcaatggcctctccagaatttctgcaaaggaaggattgaggaaggtaaagtggttgagaagggctggaaagtagaatgactagtattgatctgaagctgtattcgcaaaccaaaagtactatctctctacttaaataaaagaaactcaactattgagatgcatttagacagagtatataaagaataacagtagctggaatagcccccaagccatgccttcaatttctataaagcttccccttattttaaagccagagggaatttttatctcttttgaactcccagaattttatctatatttctatggcatttatcactgtcaactttgtattacaattatttatgttaactgtgctgatgcctggaaattaagagatgttaaataagatgttaactgtacccaaatataaacctgattaaatgccaaatttacatttgagtttagctggcatttcattcaataataacccttccagatgctttctgttatctcgaaagcatctcctgcaaatggctagagtcctacgttaaagaaaaaaataaacgataatgccatctgaacccacaattcaattaattgctaaagcaaatgaatctaaccttaaccaggaacattagacattaccatttcagttccctaatgagagggcataacctccaaccctctgctgcctggttcttatcaaaatacaggcggcaaaaaataaaatttgagaaatatttcctgaaggctaaaggattttctatacatccattctaattcctctaattttccctaatctccattaccaaatcctgcttccattaagccaggccacagttatttgggctcctaatagaattgattttattcaactatactaaaatgctaaaacgcctgcctagaatgaacatgattacacaaaaagagccctaggaagctcattattgtaataacagtgcatttgtcattgaggacctttctcaatatcataccctgtttgttacatgagagtcttgggggaaaaaaaatcacagacttcagtaacaggaacagtttttcttctcccaagaaactagttcatttttattacaaacactgaatactacataactaatcagtatctgaaagaaaactcagagtcaaatctgtatcctacttgtaggacagtcttgtgccataaatccttggatactaactttttattggaggttattttttcttcttttattttctcttcttgctgacttattatattgtcaatattttattgtatgaatgtataggttgctacatattctttgtcatattgaagagggtaggtacttgttgaatgacatataagtcctatatttcaagctaaagctacaacagcattatagtttaactgatgtgaaacaagaaagcatattcttccagaaatttgtgaattatgggattaaatgtattagcaatgcttggcattatccaatatttcacaaatatatgagtattctcagaaaaagttgaggaagcataaattattatttgtattattcttaggaaaatgacaattcataagcctaaatcttgcttttctttaatttcttaatgattcacactgtccaatggtcacaaaaatataaaatatataaaacatttatttttaatttgggcatttgattctttttttttatactttacattttagggtacatgtgcacaatgtgcaggttagttacacatggatacatgtgccatgttggtgtgctgcacccattaactcgtcatttaacattaggtatatctcctaatgctatccctcccccttccccttaccccacaacaggtcccggtgtgtgatgttccccttcctgtgtccatgtgttctcattgttcaattcccatctatgagtgagaacatgcagtgtttggttttttgtctttgcaatagtttgctgagaatgatgatttccagcttcatccacgtccctaaaacgacatgaactcatccttttttatggctgcatagtattctatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccatcaacagtgtaaaagtgttcctatttctccacatcctctctagcacctgttgcttcctgactttttaatgattgccattctaaccagtgtgagatggtatctcactgtggttttgatttgcatttctctgatggccagtgatgatgagcatttattcatgtctctgttggctgcataaatgtcttcttttgagaagtgtctgttcatatccttcacccacttgttgatggtgttgtttgtttttttcttataaatttgtttgagttcattgtagattctggatattagccctttgtcagatgagtagattgcaaaaattttctcctatgctgtaagttgcctgttcactctgatggtagtttcttttgctgtgcagaagctctttagtttaattagatcccatttgtcaattttggcttttgttgccattgtttttggtgtttcagacatgaagtccttgaatctgggcatttgattctatgttgctgtggattctgtttatattaataaatgcacatacccaaactataatctcactcatcttggcagaagacatatctgaaccaaaacagcatgctttctgttatttatttcctttcattgatttgtaaaatataaaagcaaatcaaacaacaatataacaataaaaaactaaattagcttggcgaagtgcttcatgcctataatcccaacacagtgagagaccaaggatggtggatcacttaagccaggagtttgagaccagcctaggcaatatagtgaggccctgtctctacaaaaataaacaaataaattatccaggcatataggcatgtacctgtggtcccagctactgtgttgagaggctgagatgagaggacttgcttgaaccctggaggtcaagactgcagtgagccatgattgcaccactgcacaccagtctgggcaacagggcaagaccccatctcaaaagaaaagaaaaaataaaaaactgaatcaaagcagtcatccactctacttctttctagggtgatttttcctaaaaattaaattaggtgggtggaaaaaaggatcagccctatattgtttttctattgctgccataacaaattgccacaaatttaatggcttaaaacaacacaaacttatctttcagttctgtagatcagaaggctgactggtgtcaaggtgttagcagggacaatttccaaaagctctgaatgcactggtactattctctttcaacctaacttctcacacatgccagttccactctttctcaacaccccttagatcccattgaattcattaatcattcccaggctacactcctcccaattctaatgtaactgcagagagcctaagctgaaagtttcaagaacttcctacttgaggtgggagagtggggtccaagaaattccattacattccccttttgagtgtcaaacacttctttccaagtctctgctggtatcaaccacagccagttatgtcaatgacctttttattcagctgattatgttggaggttctcaggtaagctctctgttccatgcaaaatgacatcatgaggaatagaggtaaggcacaagaatgcatttatcagggctctctgctgtaacaccttggccaagaggaatagagaaagagatgagtaaagaaaaccaatctgcaactcagagctggaaaacagcagaaggaaaaaaacagagacaaaaaaagaagaaaaaaagaagagaagaaaggttagttcaatcaatctctatgttccaaattcagagggttggcaaaatggaagagagaaagagcacaagtgagaggcaaagagacaggacatgaacttctgaggagttcttctgccttttaccgcacagtaaatatccactctaacccttctcctctcctagtatgttacatgcctattgtagatgtgctgcaacacacacaatatatctgttgctaaaattccataaagaaaggtaaaatattgaaaaatgttaacgtacagaaaagagtggattttttcttttgtgaaagaaaatgaagtttaaaaaaatgaaattaagcaacagtttaaggacctttgtcatttaagagtcagtttattaactgaacacctaaaaaaacattatgggtactgtggcttacccatcgctattgtacttgtgcaattacagggggaaaggatggggacacaagaagtgaggaagaggaagaatgttatgaaggaaattgagtttgaagatgagttgaagtagaggttccacctaccccaattttctgaaagtcttaataatctctagtaaaatgcttttcgtaagtgtttgacatttatgaaatccatggcatataaaattttattcattaaaaaaactcttagctacttttcataaagagtataaattgttgcttactgtatctgttttagtttttcatgttgggcttttcatgttaagatattttacctagcaattttccttagtcatgatgaggtttattaggatgtgcaagaaaacctctatgaaaagacttatattggatggctaaagccatagtaggatcaaagactgtaaacaattttattaacctagtcaattcagcaaaccaagaactgctgattaaatgctcatttttttatgctttccatattaacatacctaatttccaggctaaaagataagattaatcctccttgtttttggcataaaggagaaaccctagcttggttgatacaggatttgggttctggtcacagctttgctattaactagcattacttgtgaaaagtcatttaaactctctggagctcagtttcataatctaaaaacttaaaagagttttactagataatctctaagatgtctcccaattcaattactctattatttaaattatattctaatattagagctcccaagacatgaatttgaaaagctgctccctgccaatatcccgaaacccacttattcccataataaataatttaaaagatgattgtaagactcatatacttaactccttaagaaagtaggtcgcaaactttagtgtgccaaagaatttaggtcccaacctcagagacttttccatgttccaactccagagagtctgattcaaaaggactgggatggtgatcagaaatctgcagttttaacaagtacttcagatgctacaaatagtagttgcctggaaatcatagtttgagaaaaactgccttaaaattaatgtgccaatcaaaatgaacttttggatgtttattcttttgctccaaaatgaattttaagatgactatttaaagaaaacatgaataaatggaacctatgaattcaactatatgtaataatcgaaatacataatagtcatctgctaaagatatagtaagtcctatatacatttcacagatttttacaattttatagaataactcaaggtgtcttaacagatattttataaaaaacgtattctttcattcagtagaaaagcgatatctaccaacagtcagttgttataggagggaaaaagctttaaaagatccaacaattaaaaaatagtttaaaggaaacgtaaaatccaaaataacctaactttttgatcttagacattattcaaaaaagcattattaaacataccaaagtgcatgatcatcctgaaccttcctgagttaaggagattagtgactgataactattaaagctaggattatgcattatattacattttgaggatatgtattaaagatatagtcattgctcctaaaaagataagctagattctaatcaacattaataggcttaaaattagtagtgacaggtataatttaaagcataggaattctgtgtgggtaaacaggaattcaaaccagatcagttcaactattccttcggcgcttgctattttccttctgcagttgggtgaatatagaaaagaccatatcatggtcaacatctcctggacagtgtttttcaaactttaaagtgtaaataaatcacctggagaccttgtcagaacacagattctgattcagcaggctaagattcagtattcctaataaatgcccaggtaacactgatgcttctgctccctgaacaacggtttaagtagcaaggcctcagggcatttgaaccctattgtgttgaaaaaagaaaatcccatgaatcaaattaggtcactgtggcaaattgtattttccaaagatggccatattacaattgttcttatcccacatgattttccaagtgtgaccttggcactccctcatcaagagatagagtttaatttccttgcccttgaatctaggccagctttcatgactcacttgcaactgaaagaatgtggtagaagtgtcactgcaggacttctgagcccagatgacaagacttgcagcttctgctgtggtctcatggaatactctcctcagatgcttcctctcagagcccagcagccacactgggagaaacccaaaccatatggagaggctgtgtaggtgctctcatgacagtccaagccttagaatcaactcagcccaggcaccagacatgtgaatgaagaagcctccagagagcccccacactcagccattcaattcactcccagtcagttgagcattcccaggcgaggaacccagactttctgaagcaaagataaatcatccacacttgccctcttggaatgcctaacatacaaaatccatgaacatagtaaattaactgttgttttatgctctaagtttgaggtgatctgttctacaacgatggaaaactgcaagaatggaattagagttaatgtagagaaaggatatctactaaataaaggaaaaaaaccatacgttatttttaatagtttaaacaaagctgtgtggttaagaaagggaaagtctggtgatagagacaaagtatccaaaatcattaaaaaaaaaaaaactcaaggaaaaagtctggctggaatagaagatgagttctaagatgaggcaagagattataatataaattaaatggggaggattataaagaaactttaaaggaatcagtaacagatagtaaccaagtagatgaaaatttgagaatggaacatgaactattaagattttaagattttttttgttccatcaatgatactttttttgttagacttattagaacaaccatggagcaaaacagaaatcaaacaacggaaagcaaagaaaaagttctaaggaaagaagcagaagcaatgcaaaaagacacccacagagcataaacagaagcggaaagaaagaaaagaattatggcacaatggcgaaaatggctcataaaacctgttgatacttctgctgaacaaatatttttgaaaccctgctatggggtcattcagtgttccaggaactgcggataatacgtgaggagcatgacagagtcactgccccattaaagctaaaatactagtgaggacaataaaccagtaaacaggtaaataaaaggacaggctaagcattcttaatcttaaaatccaaaatttgaactgctctaaaatcaaaactttttgagcactgacatgatgccacaagtaaaaagttctacacctgccctcatgtgacagggtgcagtcagaatgcactgaaaactttgtttcatgcacaaaattattttataatattgtacaaaattaccttcaggctatgtgtataaggtgtatatgaaacataagtaaactttgtgtttagtcttgggtctcacccccaaggtactcattgtgcacatgcaaatattccaaaattcaaagcacttctgttccgaagtgtttcaggtaaggaatactcaacctgtacttttacatagtgataagtatcatgaagaaaataaagcagagtgaagggatataactatttggtaaaggggaaatgggaagaggcgatacataagatttatatatacttaaaataaccaagaaagagcccacgaaaaaatagtaatagtagcagtagtgaaatagcagtagttgtagcgtagtaattttagtagtagttatagtactaaaagcttaagaaaaggtagtaatgagagaaaaagctaagagttattagggataaaaaaaggttaccagcaaatgaagagaaagcccaagacagcttcctaactataatccaccagatgttccagtcagaaagcttggagtcattcttgatcctctgtagcagaggctgctggcactcaccaatgcctgcgtgttcttctcttcctaggtacataggagaactgtaattccagtttcctccacaattaggtgtgtccagattccagccaaggtgtgtggctggaagtgataaatgctacttctcagcttggcccataaattcctccaacagcatcctccatgccacataatgggagaagagagaaggcaggtgtttgattctactttccctcccgaccacactatggtgttcacagtaccggtatctgctcccctccgactgctcttccacatacctagctctaataccatttccctgttttgccccttgaggtctagggacaataacagcacccagcttttcatgagttctgggtgactcgccattccatgttagttccttatcaccgcccacacttctgtaaacggtcccttcatgaaactcctctcagttaaacattttaaagaatgtcactgctccctgtcagaaccttgacagctatgtctggctttctcattaaaatttaaataaagattatgatacttaagtattaaagagaactaatgaaaatgacagaactttggaaccgaaaatgatcttgggaatcaccttgagactgtcctcttcattgtatgctgatggtatcaaggaccaataataaaacagatgagtaagttttttcctttttacatttttttacataatcagtacatatacatcacagcaaaagaaaatgtgtattacatgccaagcttttaacattattcagaatacttatttatgatatttatattttcaagaaaaaaagtaatgagatccaattcttaaaattaacactcagaaactagttctacattggaacagcatccacctaagctggaaggcagagagcatatatttctcagttctcattctttcaatgaaatcctactctgtttatagggctgccaaatggctgaaccagcccaaaacagtttacagtattgaaatatgctgactttttttcccgataatcttcttatgatggaaaaaacaagcttcaaccaaaactaaccctgatcatgaatgtcagctcctgatcaagagccacaccctgcctgcaagtaacattaagatgctaaataaagcatctctccagctagaagctcagtagtcatggcaaatgtccattatcaagagccaaggataaagactgtctagtttcctttgttttcatttaaatttgctctatagcactcatctcgtatcttgagcttcttctcatattcttgttctgagatgcattatcaaatatgtaacattctaaagaaaggagaaggcatatctatcaaaagaagctataccttgcttcaaactaagactcgaccctggtatattaaatatgacattaaagcgttcgttactttaaatagctacatttgttgatctaatgtgtgtcaggcagaatccaatgtgtttcacagattttctttaattctcctaaattttttccccacacctttgctgtatgaacatgaaatttcgcacaaacatggtactgttctataagaaatggtatggttctataacaaatacattaaaattatgtgctactaccaaaatatgtctcttaatgtcataatcttggtaatagtaagcttacatataagtgattttccaagcacttatatttgttatttctaacaaaattatcaaaagaagagcagagtgtgctttctgttacatatgctagctgatcaatgattttgttatttttaaactgtggatgtttatcacagggatgtgagttggaattagaaaaaaaaactttcaacaacaaagtatatattttatagaatagctgccctctcttacaatcaagtacatcaatgaactagactaccgaggttggtgaaatctcattacaacagtagctgaccaatagctggtcagatatactaacaatcaaatataaatggcaagtcccagccttcaagcttgagtacattctgttctttagatggccacatgagaacagagtaaacagatcagtgctgatctgcaccctgagattcacaggctgcaaacaaaatggagctcccccccaccaagagaatttaggcacctaagttttttaggtccaaatatatggtaccataactgcaatagcaatgccaatttacaaatacgtagcccatttaaaattcatttgctcattcagtcattaaaactaaattgcattatttaaaaactagactcaagaaattaaaatggcatgcccaaggtcacattgtgagtggcacaactaagacatgaactcgtgtcttttaactcttaactgatgttctttttactcttatagagtagaataaggtcccggacctttaagaaacaccaattctggagctccactgtagacttactaaatctaaacctctgaggttgggtcttgtagtaggcagaattctaaggtggcccccccaaattcctataccccagccaacagtgtgcacatcctgcataatccctccctttgagtgtgggcaggacctgtgaatatgatgaaatgtcatgcccatgattaggttacatatgtggcaaaggaagggggttttgcagatgcaattaaggtcttaatttagttgagttgagttgattacttgaaagggagagtatcctgtgtgggactgacttcagcaggtgagagctcttcaaattagggttgggtttcttctgaagctagagaatcttccgctggccttgaagaagcaaatggccaggcagtgagccgtctatgcagatgattacatgttaaagatctgagtgtggcctctaggagaaaagattggtttctagctgacatctaacaagaaaatgtggatctcaattagccacaaggaaattcaattttgccaccaacctgaacgaacttgaaagtgattcttcccaaattaagcctctaaacagcataaactttgacctcatggccaatagcactgtaattcatgcttgagcaaagacatagtttctaaccattttaaccggtcagatcaccaacaaaaagcacaaaactgtgaaatgtgtggcactaaacagacctcaaaaaagacatttgattgcagtatgaaagctgatataaaaaggcagatcactgccttgtttgattttagctgggaatatgtgcctttttaggcaactcaaattttttgctgctctgtttgaccacaaaagctcccaaaatattgatttttagggctacaaataaatcttagcaagtaagcaaatgtgaaaaaaaaatccatgaataatgaaggaccaactgtatattgaaatgttaaccgatgttgcatttatttactatatttcctgaatttttacactgaacatgtatttttttaaaaaaccctgcattttgaaaaaataataaatttctcaattcaaccacagcaaattctgcaccttctgcctaccttatgaatagttttattagctctgtattaaaactgtatgcttacttctgaatcctttaattgactgtcgactgatgtaagacagtacatggcacataagcagtggtaaaacagagatatagacaaatggaacagaacagagccctcaaaattaataccacacatctacaaccatctgatctttgacaaacctgataaaaataggaaatggggaaaggatttcctatttaataaatggtgctgagaaaactggctagccatatgtagaaagctgaaactggatcctttccttacacctatacaaaaattaattcgaaatagattagagacttaaatgttagacctaaaaccataaaaacccttgaagaaaacctaggcaataccattcaggacataggcatgggcaaggaattcatgactaaaacaccaaaagcaatggcaacaaaagacaaaattgacaaatgggatctaattaaactaaagagcttctgcgcaacaaaagaaactaccatcagagtgaacaggcaacctacagaatgggagaaaatttttgcaatctacccatctgacaaagggctaataccaagaatctacaaagaacttaaacaaatttacaagaaaaaaatcaaacaaccgcatcaaaaagtgggcaaaggatatgaacagacacttctcaaaagaagatatttatgcagccaaaagacacatgaaaaaaatgttcatcatcactggccatcagagaaatgcaaatcaaaaccataatgagataccatctcacgccagttagaatggcaatcatcaaaaagtcaggaaacaacaggtgctggagaggatgtggagaaataggaacacttttacactgttggtgggactgtaaacttgttcaatcattgtggaagacagtgtggcgattcctcaaggatctagaactagaaataccatttgacccagccatcccattactgggtatatacccaaaggaatataaatcatgctgctataaagacacatgcacacgtatgtttattgcggcactattcacaatagcaaagacttggaaccaacccaaatgtccatcaatgatagactggattaagaaaatgtggcacacatacactatggaatactatgcagccataaaaaaggatgagttcatgtcctttatagggacatggataaagctaggaaccatcattctcagcaaactatcgcaaggacagaaaaccaaacaccgcatgttctcactcataggtgggaattgaacaatgagaacacttggacacagggtggggaacatcacacaccgaggactgttgtggggtggggggagtggggagggataacattaggaaaaatatctaacataaatgacgagttaatgggtgcagcacaccaacatggcacttgtatacatatgtaacaaacctgcacgttgtgcacatgtaccctagaacttaaaatataataataataataaaaagaggtggtagagaaatgttgaatgaatgggtgaactttatcaaatgttgagtttgctcaaactattcactccacaggacattcttcaacatgacaatagttaaaagtagaactacaaattgtgatgtgagtattctgtaaaacttcacacaaaaaattaccagttatcaccaaatcttctcagggaaggcaggtctcttgcaacggaaatgaacatttttaaaaaatacatatttaggaagtacaaatgcagtgttgttccacagacataaaataaatcttttcaatagggatcagcatgaaaagcatctgcactgctagaaccacgtacatcgaaaatttatcaaccaacatcctaaaatattttcaaagtaactgaatgcctataaaagaaggctctgtaccaatttattgcaacacaaagattatcagatagctagtattttgcccatggatctgtatcctccttagttgatactaggaattgtatagcatgatcatagtcctatttctatcacagttcatcactctcaagtaagtgtttactgaaaaaccgatgcagaagatgctttgcgagggttgtgttgtcaacaattttccccagttccaaagctttcagccaagcctctgtgttggtgcactatgaaccaatcttctagagggtgatgataacagaaacaataatagaatgggctcagctcttcaaagccatgtggctttgattattttcactaccaacaattcagacccataaagtaaacaagaattctttctgatctcaaaactgctaggtgaagtcatgtagtgtgtctattttcattaatattaacaataggtaatatgctaataatagtaatggaaaaaatacacgcagttttgggaaaacaaaaacaccctcgataagatttttttcccattaaatgggaaagatgagtttagcttgatgaaactgtttctgtcgttttgagttcccataaatgttttttgttgttgtttcttttgtgttctcatggttttagctattgtgatttaaagtgattttaagccagagtaaactgacttaacccatctttactctgtgtgtgcagaaattagggcacagggaaagcaacccgactatatccagaggtaatagtaggaagataaggaaggatttctggtcacataaacaaagtctgctgaaagatccattgagttatattgtttataaatgtctttcctgctttcaggtagaaacattctaaagcagggtttctcaacctttttggtcctatttgagataattaagggccctaaagagcttttgttcatgtaggctacatttccagttacgttatgttagaaattaaaacaaaattttatgaaatatttaattccttttaaaacaaaaataattagtccattacatggtaaaataactgaatgtgtttatgtaaaataactatgtttttctaaaccaaaaaaattagtgataagaatgtcattgttttacatttttataaatctctttctgtctgacttaatagaagacagttgggttctcctagctgcttttgaattcaatctgttgtgtatattatcatacctctcatagcctctggaaaactcctctgtgcacttgagtgagtatgagagtgaaacaaacacaagtagtattattatgaaaatagttttgattttacagacctcttgaaagagtattgaggacacaggatgaacaaccttctggtttgcctaggactactctagttttagtctcaagttctaggaaaccctgagtttcagggcaaaccaggacaactggtcgccctctctgcactacattttgagaacggcagtgctaagacatcaaaaaagatcaacttgcttaagaccataacatccactaactattactgtgccttcacaatcacaaggtgacctaactcacatatatccactattactggctacataggtatctattttactttttacagtgtttaatagtaacgtaataatttgaaatcaacgaaatcttctcagtagcatatacccaagcatactcaaagtagaggtttgatgttattttaggtaaagtcaaaattaagttatatttaatttttggtagtttgggaactgaggattgaactaatgtaacttaataagtggccattaaaatacatttattttttatttttaaaaacagtacatgccatttcattaagtttttagtcacaaaatacagtttgaaatcttacttttacagtaattaccttgagcaacaacaaaaaagtatttagcttcctgagaattagcttattttctcaaaaagctttacagaataaagtttattaattctgttttatgacattcaagtgccaagccacatgttttccctccaacacctttatttccttttaaataaaattgcatgagtaaggccttagtcaaataatagtcatcagtttccttatttttttcctttttttaagatgaagcatttcttaaatgtaacatatagaacaactaacagtgactggtataatgttttaataattcctaagtttcatttttgttaaaacatgaatgaaaaaaatcatattatttagattaaaatgttatttaaaaaaatcaccaccctaaccagtggttttccctcatgtgagatatttaacattattgaattggcaacagacattcatttcaagctcaagacatttttcttgccatctttctcacaaaatgaaatgtgtacctacagttgctatggtactggtataagccttaccgtggcatagtaatattgtttaaataaatcattttattaaaaagtgtttgctgaaactttaaaatatatttccaaaggcaataattttctaaaaaaaagttgcttccttctccaattatttttgtatttttttcactcaattgtttacaaattcactgagatggttacttatgactttttaaagaactatatctaataatgccaatgcaaaatttcaaaatatatgcagaaaatcagttaagagcttttctacttcaaataggaataaaccaaaatactttaaaataccactaatatttgaaacttcacaattttgataaaggttacttgttactgcctaaaaaaatggtgacaattatataatactaattacacaaaaaagtgtcaaagtggacaaatgaaagatgagtttcatagtatttttcaaacaaaattcagtagacatgaaggtctaaattccattttatatccacacatcaaagtatactaagatattagtatctaaaagatatgtttattgtggataaattgctcaatagcaaaaacatcacatccacacatgaatatccctgccactagtttctctaaattttggcttactgtccacaaagccagtaaagttgttgcataggggaaaaaaatcatttccttgtttaaaaacttccatgaatatgtttttccttaaaaaaatgcagtctgaactttttagcaatgcatatgatgttcactcagcccaaaaccacttcatctcttgccagttcattcttcaacaagtaggcctagagtggcttcagcacctggcccaaagcagatatgcaatcacacttttcgtaacaggcacagcaacctccttgagagcttatattctcacatgactttgaacacacttttccttcttccagtgaagatacagcacagtgcagctgagaactttatacaaaaagaacaattcaagaaaactgaaatttctccctgcatgaattttgtccatccataatcaaaataatttcaataagtcccgtgggagtgaaatacacctattcaatttggattttcactttttttattacaagaattataatgagaaaaattactattacttttgtgtatgtcattttttatctaattaaaattaacataagatacaatgatgcacagatcttagttactcaatacaatgagtattcacaattgcaaatacctgtgtagccagcagtgagatcaaaatataggacatatctgtgagtctcaaaaagttttcatgcctttctccagtcagtttctttctcccttccccaggcaaccacttcctgatttctaacatcatagattgttttttctgttcttggactgcatatcaatcaaatcatcatatatgcagactttttaaatctggcttttttattcagcataatgcttttgagattcacccatattgttgcatgaatcagtagtttcttctttttattgctgagtaatatttcattatatgaacacactatatattttatgtatttttcaacatttgtacatcttcttttgtgagatgtcagttcaattcttgtgcacattttaaaaaattggattgtcttttcactgatgatttataggctttctttacatatctgggatacaagttgtttgtcatgtatgtgttgtgaatattttttataatatttcaatttgttatttgttatttgtctgttcattattgcaatgctgtcttgagatgagcagttttaattttgaagtctagtttatctatggttttcatggttactgctctttgtgtcctactgaagaaatcttggtctactccaaagactcattccatgtgccaacattcccctgcagattaggagtgccctgttcctgttctcatggctttctcttccaaggctgcacatttgtcatggggaaaaggctaaacagagctggtgttggtttattcatcagtcacatcaatgttgttgctaccagcttaaatattcacagcctttccccacacagaaccatctgctggtgctctccaacaatattaacattaaaagggaagccttgacaagaagtccagtaagtggctactgatatcggttccacaacttaatgacgttgaggctggcacgagggcaattctcaaggcctttccttcatgatcactagatgactgctgcaactccagccatcatgttttctctgggttctatgggtcaggatttcagagaggcacaatgcagatggcttctctttgctccacaatgtctgaagactagctggacagatctaaagagctggaagtgacttgaatggctgaggtctaggaacatttagtggattctcatgcacatgtttggcacctgggctaggatatctcaaggacttgcttctccatgtggctagagtgtctcacaggtgtgatgacagagttctgaaagacagcacagaaaaggagcacacaagagagatgccttagtccattttgtattgcaataaaggaatacctgggactaaataatttataaagaaaagaggtttatttgtcctgcagttctgcaggccatacaagaagcacagctttgtcatctgcttctggcaataacctcaggaaacttttaatcatgatggaagataaagtggatgaggcatcacatggcaagacggaggaagcaagagaggaaaaaagcaagaaaaagcaaggcaggaggaaggtgccaggctcttttaaacgaccagatctcactcattactgctacaatggcaccaagccattcaagaagggtccacctccatggcccaaacaccttccaccagaccgcaactccatcactggcaatcacatttcaacatgagatgtgaaggggacaaatatccaaactatatcaagagattatccagataaggaacacctgagagagattgcccagagggattgctccgaatgggagcacccagagtgccaaagggcgcattacatgaaaaagcttaccaatgcattttaattagcagcaagacagaggcagctttctgtttttccatcctgaaattaatctctgggaagttacttgtctttcatgtagaaaggggtgacagatatccttgagttcaaaactttgactcacccccgaaaattctttaaccttggattagtcactcaatgactccaaacctcagctttcccttttgtataataatagtaatactacaacgataaaaggtttataatatattctattattacactacaacaatgatgcaatggagtaatgatactaccttgctcagttaatgtgtcaaataacttatccttcttggcgactgaaacatgggaagtaattttcataatttagttccctgcccatatctgcccagtgaaatcctactcagtcaccacaatctcatcaaaagacatgtatatgtaaaactaccccatcaccaggacaaagtcagtttcatctgtgtccctcaaacttccattacatggtacaacatgtaataattatatcatgttataattatgcgttcattcatttaaaaaatacatattgagagcctaccacctgttaagcactgtgctaggagttgtatatactgtttagtaaaaacagtttgaatccctaccaccataaagcttaccctctagtgttaaaaatgtctttatctgcacctagacaattacctgattgagagtcacctctgtatcttattcagcacattccctaacaatggctagattctcaaaaatgtttgacaaattaatttcctacaaaagataaagtagtttaatacttgttcacagttagttcatctaggtaatccagcacaatctgtattaaaataaattaatgtaattttaaaaggtaatatttcctttagggaaatctgaaatcccaaaaacgttcgaatggaaaaaaaaaaaatggtacaagaaacctcatttgcattcccatttgaaccactcctttttcatgtttttactattattaggttaattattcctcaaaatcctggcagtagaaaagagtaatactggtcattttggtgatcatctgtggtcattgaagtgtgttctatgggtcactagttccaacccattcaagactaatgggttgggttgcagaatggttatccaaggtcctcacagtctttctccctgcagacaaagtcatatatttatggggccaaaataaacagacaagtaatcaccatagtgaatagccattgtttttatcatcatatgctgcagggaacttaaaaatcagctcaaatatggactataatggcaccaggaaagaggcagcaggctgcacagctattatgtgtgtgtctgtgcacaaatgcagccagtgcttctaagcacttcccttctgaggaacaaaatacaaacataaaaatgcacagacagttccttctcctattcctagaaaaacaaatcataaaagaattcactgctaccctcaccaaaatctaaatggggaggtaaaagagtcacaaaaatcccagcaaatgacgcatgataaaaatttattcctctcatgtctttccaagatcataaaaaacaggttggtagctgtcatcatggtcttatcctggacatttaaggataaacattaaacacctcaggatactcttttccaatttaagtctaaacccaggtttacaattactgcctgtgttaaaaataatgtattcacatgtgaatttctctaactttttaaatccagggatttatgtgtatgtacatttttgtttgaatgtgtgctgagttttctttctctctttcattccttttctgtgtgaagctataaacacattttaggcaattaagtggtcagtaaacaaagtcttacacatagaaatgtcatacttaaatgctagataaaatcagaggaaaatagcataggctacgtatttgacattgcaagttataaggaaaactgaaagatgacaagagatgaattcagattacaatatgagataattcataattgccagaaagtggaaacaagccattgtctgtcaactgaagaatgggtaaataaaatatggtatagccatacaatggcacacaattctgcaatgaaaggaaacgaagaactgatgcatgctacgacatggatgaaccttgaaaacatgctaaatggaagaaaccagtagcaaaacccacatattgtacgcatctatttatacaaattgtctagtgtaggcaaatccacagagacagaaaatagatcagtggtttctgaaaggagagggaaagaaatgagaggaaatggagactgactgctaatgggcacgtggtttatttttgagataatgaaaatgctttaaaattgattttgttgacaactgcacaccccaaatgcactagaaaccactgcattttaaataggtgaattgtatggtatgtgaatcacaactcaataaagctattaaaatattttgtagctgaaatgacacagggatctactttgtatataaaaagaacacatgaaataaatacttgctcatgtttataagcataaatctgagaggatacagagaaaggcaaaactgggagagaaaactcttctcctgagtctaaagccaggaactgaacatactttacctcagccaccaatatgttcaaataatctatggcaaagtttctccacatgcttcaaaacatcacttaagtacactgtccttaataatgagtactataggaaaaacagttctgtaagagtaaaatagaaggaacttttaatgcccttattttgaaagtttgaaaggggaaacatagtgaacaaaaacaaaatgataaaatcttacttttattagcaacatgaagctgtagcaaagtattagctaaacaaatgtatatgtacatagggtggaggagcttcacttaaagaatcataggcccaaatcagcccaattcagtgttaaacccaccacagaaaaacaccaagtgctgtcaccttaattccagcataaaattttagaagacaatttgattttcatgtcaatcatggcaaatgcttttgcttgtgtttatgaatcattaaagaatgatatcagttaaatataataattcgaagagaagattctaaaaacaatactaaaggcatcattgattaacagaagtcacaggtgaactgaaataaactacaagggattgagtacatagtagccaggatgctttgagctgcaagtaacagaagagcaaactaaaagaaatggaaactggaaaggattaatcatctcccatacaagaagatatgtgaaaggagggctccctcattgactcagttgctcaacttgacctcaagggccccaggactttcaattgtcctaccttgcatccctgtactccagcaatctctcccctaatgttttcaagctaactgtagcagttctataggtgtcaacttctgacagttccacatccccaaaaatggaaaaaggcatttcctcaatgtatctttttatttgggaaaaagtcttgcaaacatcttctggtcaagttcccctcagatctcactgccaggattgggtcacataatcatgcttaaaccaatccttaacaaggagaatgagacctcaataggactggatcattctaatcatgatttgcccctgaactcggcaggagagatcatttcctcaaatcagaacaatgaggtgagaacaatgaacaaattcaggcttcttccaggaaggaaggtgagcaactctcaccaagaaaacagcgatcacactggtgtatgatccagacactatttcacatggaaaaccaataaaaaacggaggatgtttaacctacacaggggaaggctatgatgaagtcttcaaatatgtgaaagtcttcaaataccatgtgaaagagaagatccctgattaatttaatatgaggccttacaaactatagctctctaacaatatgctcagtgcaaactcatgagagagcagtcattagacaattcacatacaagcagaatcatcatttccagagaatatactctttggatagaaggttgaactagtgaatctaagatttttttctatcccttctctagtttggctgaatcatgcatgtaggaaacttgcccataacctcctccctcatcctccttaacaagtctgccaactcaaatttaaaacctaaaattgatatttttacatggaaagaaaagaaacaacaaaatgatcttaataggttaaacagtcttttcttgaatcagacaatacagtaaatacaataaagataattcagagctatctaaagcaattataaacattagtgtcattttcctcatattcaatcccagttccactcctatcaataggcaactgttcttacggttgctctaagtagaagaacagattgcagattatacaagggctctagcctcagccagcatttactaaataaataccaatatctgaaaatcccttatgtctttctttgctgttattctaactgccagcatgaacaagcaaaaggagcaattaaagaagctgccatcaatatcatgggaggaacccattatttccaatccttacctcctctcttccaaatcttaccttctaatttccattctgacctcttttcatgcagctaatattgataattatttaaacaaatactatgatctcagcctgaatttatttcactctctgaacagaatgtcagtaaactgcaagtaaagttattaattttatgttcaattacaacaaaatttgagtcaggattttctccataatgccacattggaaaatacatttaacaaaatgtagatgtaaaaattacttaagattttcttgtattcaaaaacaagtgaggctttgagatgtgagaaaatgacctaagattaatagagaagatctttcattgccccacactccatcttcaacatctgcatcttcttcatctacacattttgcagtagattactaaacataaagaagcacagttggctctaaaaggcaaaaccggtgacccaaatgcagaaaccatcagataaaattcatatttttcctttgtttctgaggggaaaatagaaagccaccccatgtggctcatatctaaaaatgtaaccacttatttttgctaacctggagactgcaccaacattctccctgccaggcacatcataatgctacttacacaaaacttttcactaatgacttcagacactttttttatactgagtagatatttttaaagtataaacccaaaggggacctctctgtttttatctcacttgatcactcacctgtcctgtatgcactttattactctctccttccaaacgaagctaactcagtttaaggttcagggccccttatttacaaaggccaaactaaggctcagagaggggccccaacaatgtttccataagacattttatttttaagtttgccaaaatcacgtatattttcatcaattggtggatactgctcgacctcccctctatcacatttgcctttatgctgggaagcgagcaagcatctttaagatctatataagtaggcagtgagtttggaattatattcacttcggattcagtacgatgtaatttctgtgattcagagtaattttcttacataattcagttattgctaattatttccagtgtagaaatgccttccaggctcttaacaccaaagcatcggtaacaaactggtttataagttattctttaagattacttaagattagtcactctgcatgaaaacttggcatgtcctgaaatcacaaagctcatatatgagagaaacttgatgtaagtttccacattttggcaacaatcctaaaaatttatatggcattatcaataataggctgtaataccaaaagaaactgttctaaacttttcaataataaaaatataatttcaaccagctatgctaaatactgaattatttttctgatatccctgcagaagatgacattataaaattcttgtaatatgaagaagcaatccaaaagtaagcctcctccccttttctactccctaaaaaagaaaaaaaagtattatagaagtgcattggtgtttaattaataagatttttctgaattttgttcatttatggcattttaactctttaaaattttataatttttaccattattttctcattccagtcaaattagtacctaagtttgtattaataatcctgtattatttttctttaaaaggacctccacattgactaagcttccaaccccacaatatctacctttgtctcactcttgaaatgctattttccactggcttctagaaaatcatactctccttattttcccccagcttactgactctttctctgcacttgtcataaaagcaggagtgtgtgaagactgtgctctgggcctccttcacttttcagacaatttactttacttaagtgttcccaccgagtcccatggttgtaaagagcatcttctgactgtttttaacacctaaatctgtacctccagccctaaccccatcttcccacttgacatctccctgggacatctaacagacatctcaaactctccacggccaaaactcttgagtttgctatggatgcccactgctcccctagtggtccccatctcaggaaatgacccatcagtactattcctcacatctcaaatccaggcattatcattgtcttctctcttcctttcaccatacatatggcattccccaaccagtcctgtcaatctacctccacaacatccattacctccttccagctttcttattactattgtagtccaagccaccatcacacctcacctgaacaacagtaagagcctcctagacagactcctgcccatcctctattccattctttacacagcaagatgaacattttcaaaaaggcaaatcataccatattatccttctgcttaaaatccttcctggcccctattatacctgcagttaaatgttttactctggcttacacagccatacaagactggcttcttcccatctgttttgtcttttaatgcccactccattgctcactcactttcttactcgtcctctctgccagaaatgttttgccccttagtttctccacatctggcactttcttttttttcagtttcaatctaaatagcatgtcttcctcaccacccattctaagaatgccttagtcacttcttgtcatgtaacactaaacttatttatctgcataacattaagacttctcctaatcccacagttttcctgtgtgtatattggttttccacctatctctccctggaagcctcatctaacatctttgccatgctgtcctaccacctagaacagtgccaaacataacttcttaggccctcagtacattctttgaaatatgacactaataatcttggtgcccataattccctccaggcctgtctcaaaggttatggtacactgtttagtttgaaaaagaggtggacaaaactgatagaacacctttcctcatacaacccctgcttgaaaccacattttttttcatttcacagatgcactgaacggtacaattgccttcgtggtcataagtatgctccaggagccacatggccaggctctggcaccatggaagagcatgcaaggcacccctctgctagaaaacagacattccagtgtttctcaggtaagacttgcttattgtggctgtgtaagaggcatccaagtgacaaaaacctatgtttaatccattatatgaccattcccaaattatcattctttgctctttcacaatctggtattttaccatgcctgtgtagaggtagtttttactttgtcttacagaatcttttctgaggctttcactgatgccaacaccactaataaacataagaattgtcatgattacaccatctaagaaactccatggcaaactaaaatctgtggcaaatgtcctactactgcaaaagtgtagactccatgaagcttctctcaatcaaaattgcaagtccatttccagccgggtgccttgtgccaccccgagcatctctcacacctgtcttgctagaaaggccttcaagagagtaccaagaggagaaaccaaatatacaaaaacagcataccaatgattccacacatcactacccccaaaacaggaataaatgggagcaatagaaagaggaggaggaggaggagagcagggaaggaaggaaggaaggaaggaaggcaggcaggcaggcaggcaaaaagaagagaagagaagagaagagaagagaagagaagagaagagaagagaaatttgcaacagataagaatatccttaacactaacctacagtttctattattttcactgttgaaacagactgcagacaagtaaaaggatagcataccctttcatgaaatcatctacaggcctttgggaatgtcaaagcctaatgctggccagagaagttggccaggtatctaaaacaggagaagatcaagtctggcccaatcctggctgaatcttagattcctgaaggtcaaataacattcagcacaaactgactgcctggataaagtgcacctgagctactcagaacaaatgtcaggggaaaaaaagttgataatgagaaaagaatgacacaaatttctcaataatgtctgaggtcatttcttactagaagattccaaaatggaagcaaaccatgagtataatagactgatcaccaatcaaaagaaaatacataaaatctacattttaaaagataggcatggaagcactagtggaaaagctagccctggcccagcgccaacatatttagaaagaaggccagctccatttcatgacgtaaattgaacatttttcagatccaaaatttgtaactacagacacagaaatagactgacactaaggggaaaaaagtttgttacacttactgattccaaactttcaaagtaatgaaaccaaaaccaaaacccaatatatctctgacaagatttttcataaattatatacgttaaaggaaatatgattgacccattatattcatatataaatgaagcattattggagattttaaattgttaaacaatagctttaaagtttggaggccaggcacagtggctcacgcctgtaattccaacactttgaaaggccaaaatttgaggattgcttgagcccacgagtttaagagcaaccaaagcaacataatgagacccccttctctataaaaaattagccaaacatggtggtggacacctgtaatccaagctactcaggagacttaggtgggaggatgcttgagcacaggaggtcaaggctacaatgagctgtgatcctgccactgcactccatgcactccagcctgagtgagacccagtttcaaacaataacaacaacaacaacaataataaaagtttgcatgttcctttccctttacaggaagtcacatttataaaaacagaatctgaatacaaaaataaaagcttatgctttactagaaagtattgaccagctctacacttcacaaaatgtgttatctatagcaatagacatgttataatacgtataagtttataatttatttttattattaacataatataatataaaatataataagtatagttgggatatgtatactagtcaaagaacatatttagggtattgctttcataaaacagatctttttctttcttataaacaaaactggcccaattacctcaaaaaagtacaagccagaactcaggtgacttatgtttcaaattgcttctagatataattgtatgcttgaaatgccattgtctggttgggagcagttgagttagaacatgaatctatcagcaaggtcgacccttcttttgaaactgcttcaacaaccagtctccatctttcaacttaagtttcttagtaaatcaaattcagtactggactgggtcactacagctctcataatacacaggcagtcttgagctgatttcgtgcatcagggattctgcagtatggctggtctgaaccacacagtcctacaaattgggcaggttccctgggctttggtacctgcccaccacttccttcaaagcatctctcctacaacctaaaaccactatcttggttctaactatttacttgtgtcaaatagccaaataccattctactaggtttttagttgatgatctctgaagggatgtatcggagtctatctcaaagaacactaaacaagaagaatgttttctaaaaaatgcagcagtaggggtaggggtatgaaaactgcccctggatccacgctacatacttcatctctgctcagagatttgctattacatttgcatctcaaaagagctggagaatcctactatactagaaacctgattgcttaaacaaatgtactcccaaacatatgtggccacaggccattgctttattatattatatattttttccatttattaacattctaaaaaacatagagaaattctgatttatcagtcctctgagtagcatctgcatttcttagaggttcctgactaatctttgataatatttcagacactatggctggtagtagtagaaacagctgtagtcagagaaccaatcctgaggcatctcaaatcattcattcccaacagtgacatagtcggcttgctgttaaaaataacagctaatatttattaagagtttactgtgtaacattcattattccaagtattttacatatattaagacatgcaaactacccaacaatccagcaagtcagtactatgtgttatccctgttagacagatgaggaaactgagcacaaaaaggttacatcacttgccataggtaacatggttagtatgtggtggaacagggattcaagtccaagcaatcacatctagtaaagatttaaaattagataaatttatttgattagataataatcctttggagaacaagcaagtaacacaaatacaaagtgctatggtcccagtatatagaggccatcctcaggatgggtacttgttaatttttttctgtatttgtgataaaagtagcttataacaaggataaaaaagtaggcctaaacagagacaactcatggaaattaagtcataataagtttaagtaaggtgccaactgaacatcaggagttaaaagcaggagaggctcccctctgcaacatatttatattatactatattatattatatgtaaaatatatatatatatatgtatacatagggagaaagtgcatatgcacaaactttttatccaacagtgaagaaaggaagtaactggatagattttgactgtagatttgcttgaaagcaaattcacacacttctgaacctgtataataaagatgagtaaaaataatattttatgctcattcacaaagattagaaagcaacttcaataaaaatactgatgaaataagttaaattctatatttcaaactcaaaaggactgttcattttattttttattgttttgattttttattataatacattattgcatacagttactgaaatattaagctttattctaataatgacctttgacttaagtatttttggttttacagataagttagttgtaaaataatctcctgttgaaaggactagaataaattaataaaatccaaagatataaaaagttataattagaaaatataataatttgtgtaagtaaaatagaagggcatgtttgggtttgaaccaccccacaccaagtgtaaactgctgaaaagtggtttgtagtagtttggctttgagtctgaatagaaagcccgacaagttcagttttctcatttacaaaattagaattggttcatggcaataattagatggtacatgcttggcacatgcttgaaatgtagcacttgacactagctaatattattattgttgttcttgcccattattaggccttctccttggcaatatctcatcttaattcaaaaattacctttgtaaaatacaataggttgaagaagaccaggagaaggatattaacaacactaggaggatcaaagagagaaacagtacacagtgcccagcctggaagtgtatgagcagtggaggagaaacagggtttgaagcctatgaagccagaatctgggctgtggacaagtcttccaatccttactttaaaactgtaggtgagggaactggttctcatcaatacttagtcaaaatggaaatttacccttgtcagaaatatatttgataattcaacatcataatgaacaaataacaaaatttaaacacactgtattgatttttatgagaaatgtatgagactgaattcatcagaattcctgtttgtaaggaacaaaccaacagcagcactacaaacaaatgatgatgactatatgcacatgttttatgcatctcaattatcaataataaaaatcaaaatctgaacaatgatagaagaaaaactgagttaactttttattctctctacaaaaatgatatttcaaaatcattgataagcaaagaagcgattaaagtataagagccaacaaatatagaaaaaacttagaaatatgttggataaagaaaatgtggcacatataacaccatgaaatacaatgcagccataaaaaagataggttcatgtcctttgcagggacatggatgaagctggaaaccatcattctcagcaaactaacacaggaacagaaaaccaaacaccacatgttctcactggtatgtgggagttgaacaatgagaacatatggacacagggaggggaacatcacgcaccagggcctattgggggtggggaactatgggagcgatagcattaggagaaatacctaatgtagatgatgggttgatgggtgcagcaaaccatcatggtacgtgtatagctatgcaacaaacctgcacattctgcacatgtatcccagaacttaaagtattaaaaaaaaaaaaaaagaaagaaagaaatatgttggacagtttctttaaaaagattacctttcttccggattttttgatgttagtgatatctgtcggctttatcaaatttgtaatttttacaatttttttctcagactaaagaaatattcaccattgtaactacttatatatatatatattttgtgtctatatattttacatatagtatatacagtgtatatactatatattttatatatagtatatacactgtatatactatatatattttatatatagtatatacactgtatatatactatatatattttatatatagtatatatacagtatatatactatatatattttacatatagtatatatactatatatattttacatatagtatatatactatatatatattttacatatagtatatatactatatatatattttacatatagtatatatactatatatattttatatatatagtatatatactatatatattttatatatagtatatatactatatatattttatatatattttatatatagtatatactatatatattttatatatagtatgtactatatatattttatatatagtatgtactatatatattttatatatagtatatatactgtatatactatatatattttatatatagtatatatactgtatatactatatatattttatatatagtatatatactgtatatactatatatagtatatagtatacaatatatagtatatatagtatatatattatagattttatatatagtatatatataacatatatatagttctattcacttctctaaaatgtaatctgcaaaattatacaagtttctggctccacaaaacctaaatccacccatgatgatagtataaccttcaccagcagcatctgtgaatgagctgtttaaatatctgctatatcatacaaaggataaatatattttaaattatttctaaaagtacttacatctgccaaaaatgccgcataactcacataggcacccactaattcctaccagagttcatttccgcatgatccctacctttcccctaagctaacatttggggagaaactgggaagcaagcttgcatactatgctgcacagaatggtaggctcctctttaattgggggtgcattctttacatttgtgtgtttgcatcttcatttgttctgcttttaaacagagcactccctatatagtgccccaagccaacacagggagggactacaaaggattaaaagacaaaagaaagtctttgagaaacttgttaaagtgaacatattcaaagtggcatttattggaagatcgtagtcttaagtttgtagaaatcatcatggaaggaagtcacccaaaatataagtagagatctttgaggtgtagggatgtgagcatttttttcttcttctatgattaaaatatcttttagtatttctaaataccacatgaaataaagatgtgctacatttataatagaaattaaaattagtaaacaaagtgagctttgtttggtaacctgaaatgttctacattataagcaaattttatcaggttccgtttgcttattgcccataggcataacctacaagaaactggcaggacataacaaaaattaaagataaaccattttacatttatgggttgaaaaccattaaacacataaatgacagtaatagcactttaattgacttgtagtataagggaataaaatcttaagaggtttggaatattcagtggtctagtattagtcaggcagaaaggaatgagaactacctcaaattagatattacatgattctttgaactagttacatttttagatgttttactgtaaatagaagtggtcgttttactttaaataaaatgcggttgttcctagatatgtcattaaaactgggagacaacaaaagatggttctgttaccaataaacaaacatttattgaggacttgcagtttgttaaaaactttgcctgctctaaccctagcctgtaggtccacgattattccattttatcctgaattgtaaaaatgaaacagctaaccagtggcaggtctaaggtagaaagattccacagcatgggttgtttactacatgatactgtcttcttagaattatgaaagactgattcaaaacaaactactaagttttatccttaaaatgtatagaatattttatacccttctttcatactctcttgttttgttgttgttgttgttgtttatgaagtaaactcattatctctgttagacaattataagaaaggcaggttgctgtgactcatctttggaggggatgaggcaaagtgaaaacagtttgggagattaaaggacagacagcccctggcactgattttctgcttccgtttcttcagcagtaactagtctattccagagtgacatggtagcagggttttaactgagcgcatctagagctggtaatatttggagatggaggtgatggcccaggtgataatgaagagaaataaaacttaggaattcctgttttactgttaggaaggaagacagaactctaggaccatattttagattattacagtatagtacatgcatcactgaactaacaggtttcaaatagtaagttcatagcagccaatcatcccagagccttaaagtctccaaattttagtctctctctgtctttaaaatatggccatttatgcaactaaagaataagcaatcacgatgttaattaaaaaaaaagtccatgtcatcattgcttaaaaatagcaagcaaaaaaatgcttagagttagacataggaaattgacagaagaataggaacagaaattatggtaaaaataggcatctaagaggtctggtatttaagttaagtggttaaataaatgcagatgacaaggttttaagaatagggatgttttaaaactttcttagggtccagttttctttttagatacttgaatgaatggtgaaatggataattcaatgaataactgaatgaatgatgaaaatgatgaattcaaaaaaaaacacagtgacataatttttcacacaccactcccaacctatgattccctgaagccctctccatggtcctcaggctaaaaacttctaaggtaaataataatcatgattataaataggcatttgttgaatatctccacatatcagaaagagtttctactcgtaagtgccacaccattttcagtaagaacaaggctgaatgtaaccaggacctagaaagaacacttaaatattcttcactggtgaccacaaaaatgacccgattttatcaagctcagtttaaacaacattccccatagcacagcaattgacaaaaactggcaaagcacaggaaatattaatgaaaatgctaacaaaaaaacaattttgtatacaaaaagttctttttacttctgaaaaacattttacatactgtaaaccattaattatacacaacaaatattagataaagatatcagaaatgtttggggccataatcaagtttattttgattaagttctgtgttaagtgaaagatgaggactctgtttacaaaagaagcccaaagttagggaacagacaaatcagggagtgaagcttagagcaaatcagttaactgcttgctctgtgtagagatattggaagatggctttcccagcatagatcaatacctggttatcaagaacactttggataagaatttaaaatttatttgctaaatatttcaattccgagatggccatacaaatacacaattagaaagagagagtcttctaaaaagaaatccttagcaataaacgcaaattatcaaaaccaatgtacttagcatagaatcatgattaagagcgtgaggtttagacagactcaagtctgaacagtttttctacctctgggctagttttatttaatttcccaaagcttcagttccaccatctatgaaaaaggaataataacaagattgagaaaatgtacaggaaatccagtactttgtacatataaaaatctcaaaatgtagctattattaccaatagttagcattctaatatcaacaaaaagactattatctaagggttacataaccagggaaaggtttgagtaaaggtcaagtatcccttatctgaaatgcttggaaccagaagtttcccagattttggattttttcggattttggaatacttgcatatatgtaatgagatatcttgggaatgggacccaaatctgaacatagaattcatttacatttcatatatatcttatacacatagcctgaaagtaaccttatacaatttttaaataattttgtacatgaaacaaagttttgactgtgactcatcacataagttcaggtgcgaaattttccacccatactgtcatatcagagatcaaaatgtttcagattttggaacatatcagattttggatttttaaattaggaattcccaacctgcactacatatttagaaagagaaccaggaaacgaaaagttaaatattaagagtatctcctccccgcccccactttttttaccggtcattagctggttttcaaccaaagatttgttcattctaaataagcacaaaattattgttctgttcattgaagctgcttaaggtagattttctagtttctcttacttttttggagagtaatgaagctaagaaagaaacaataattatgtaccacatagtatatgaacgtgtgtgtattttaaccatttgaaagcaacttcaaaagccactagcatttcaaaaattgaaatagggagggaagaataaaaataaaagggcttcgggaatgtgaaagttgtagacaccccacctgaaatatgcacatttaaaaaactagcttgtaacaataattaagcagtatccaagtacaaaggccttttaaaaattccttgaaaaaattaataaaatgcataatttatttttaaaaatatattaataaaagtcataaatatgctaacaattactatcaaaaaaaccatgcctaaaattaaaagaaaaactaaaataggtgtcacttagatccaaatttgggaatacttgtagctacaatgtgtcagaaagaagaaatggccacaagaaatgctagataagaccaaaaatatccttacttattttgtaagagcaaaggaatattcaaaaactgaagataccactataaaattgtgtcacccattttcaaattaaaagatatacaaaaatgttcacaacatttgactaataaatttctttttgggaattcatcataagactgaatcaaaagaatcatgaagccacaggcattcctatagatggttacctcattacttataatatcaataaaccagaaagaagctaaatgtccaataataaagtaaaggttaaatacatttgggatagtcaattaagtttaacaaacataaactgagtatgttctacatgccaggcatatagctagctataggcatacaaaaactactaacataacagctttgctcccaatacgggagtctcattctaccatatcaactcgatgaactatgaaaaacccattaagaagaatgtaaaacaaaatagatacatctttagggtaaatactagtatataaaaatatgaaataaaaaatatgaaatattatgatctgagttatataaaaagtcaacatagagtagaaagaaatagagtggaatcatgagaagaatatttggtagttaattacagggtgttcactaatccattattactgatcttaatttgacaggctatttctcatgccatctgtaatgtgtcaaacaccctccttaaacatttttttctttagtggactgtagatattctctttagtcaattccatctgttagtggcagcatatgctatatagctccagaaatgctaatatactcaggcaatggatataagcaactaatagagattttgaaattgacaaacctaacctttctaaagcagagggcatggcagtaaacagagttttaaatgtattcttgtggaccgatggtaaaatttctgaactgatactcttaacacctttattaaaacaaatctaatctctctgctcactccttccattcaacaatacaatgaaatgttttcatattctctgatctttggctaacttaattatttcatttacttggtataagtgatgtttgctacatgcaattcagttttcactcacagttttactagtagtactaatacacatttaacaaaattgatggactttcctgtggtgctttaactagcagcatattgaatgatattatctgagaaacaatcatttcctttctctacttcatcctttatcgctcctttcattactagttcagtcattcaacataaatttatcaagcatttactataacctggttactcttctgagcactatggattaagcagtgaataagaaaacatccctggcctcacataactcacacacattgcagttgaagagttatgactttaaaaacagaaatatagttcaggtcataataattgctataaaaaataaagcaagtgcacacttaaagagtgactgggtgagggcttggtgtattgcctcttttgaggaggtgacatttgagcagaagcctcaatagagtaaaggattaataaagccagcaacctcacgagattatcaacatctataacaacataaggaatattataaatctcttggaaaatgtaaaccagaaagatgatttatacttgcttcgtttttgtgctgttagttctaaaaagtctcatcatagcccttggctgttgaaacaatgcgcagtcatgaagactcacagactaaaagtagttcaatcccaagcacatcaaagaaacatgagtgcattttacacaagtgtacggtcacacaccacaaaatgacatttcagtcaacaatggactgcatatatgatgatggtcccgtaggattccaatggagctgaaaatttcctatcaccctgtgacgtcttaatgatcctgatcccatgtaggccgaggctagtgacgtcttaatgatcctgatcccatgtagtctgagtctaatgtgtatgttcgtgttttagtttttaatgaaatagtttaaacatgttttaaatttaaaaaatagaaaatatagaatagaatataaaaagaaaatatttttgtagagttatacaatgcgtttgggttattataagagtttaaaagtaaaaaaaaaatcgtaaacatttataaagtaaaaaagtgacagtaagctcaagttattattgaagaaagaaaatttttaaaataaatttagtgtagcctaagtgtacggtgtttatgaagtctagaggagtgtacagtaatgttttaggccttcacagtaacacatcgctcactcactcagagtcatacagagcaacttccagtcctgaaagctccattcatgacaggtgatctatataggtgtaccatttttatctttgatacagtatttttatgctatcttttctatgtttagatacacaaaaacttaccactgtgttataactgcctacagtatgcagtacagtaacatactgtacaggtttgtagcctaggatcaatagactataaggcatagcctaggtgtgtattaggctatgccatctgggtttgtgtaagtacactgcatgatgttcacacaatgtgaaatcacctaacaacacatttctcagaatatatcctccacattaagcaaggcatgactgtaatgggtacgtagctcagaaatgaccaacctctcaaaaagccaaaccacttcatatttttgtcaggttatttatgccttggcatttgtgcaaagcagaagcatacattgtaatcacttgaaagaaaagattatatctagaccaaagaaagtaagacaaaagccacaatgaacagcaaggttaattattctaatgaagcatctttccacagctcctccaatttctaaccatattataagaatactcattctccatccctctcccaaaccactgccactgcccaaaaataatggtgggatttagttgacatttttttactatttttcagtgttttgaaatcttttttggatactaaaacaggcaaaaaaaaaaaaaaaaaagcatttggtaacatactttcaaataaagatttcctcttccacaacttcacatctacttctttctttattttttaacttgtccagttacaggtggctagcagcaaagagttccaccctgccattaaccaaagagaagcctcactgaaaaggatcaagagctctgtgtttcatcaatttaacatcctagcattagcaccagccaagcagacacagccagcctgccaagacaaacaaatgggtcttggctaaaggggcgcccatctctggagacagccctccagtctaaacttcttaaggagtccatataaacgtgcttttattgaaaggtgctactccatctaaaaagcacagattcagttcaaacactaccacctttcacggttatgttggcttaaggtgtgtgcagctcaatgaccgtgcaaaacctgcgtcacagctacctgctgctcactttttaaatccccaaaccaaaacttctggagccacattgaacactggctgttttatcagaaagaaaataagagtgaagaaggatgctgggccacagaatcttttcctgcctccaccccaaccccatccaaatagagagctgcactaggtgaataaatggttataggtctcctctgtttctctagcctagtggatagaatttaaacttagtgtgggaatgtcactccttcattccttttctggagtttgtcagtaagcgaacattgcttaaaggttgagcttcttggagatgtggggtgggcagggctaaattgtgaaatctattaaaaactgaaaagattttacagaaaactataaatttttaactaaatttaaaagaaaatccactagcaaacatttattgaacatttactctgtgttgaattctgggaaaagtgtggggctatgaaagagaacatggcacttaccatcctagagaaactataaatctaattcagtcaaatactaatggcaacaactaagaataaaaactacatcctgaaagtttgcaagatttggattcctaagaatgtgcaagaagtgtctctacaaagtaatggaccaaaattctatgagatagtttggaaaagtagtctcacaacttagtgttcaaactgcataaccttcatcttagaagtttcaggcgtttgtgtgtcaccaaatgagtattcaagcattcacaatcacaaggagccaccctcacaggagcggcagtagtcttgtattcattcatcctctgagcattgggcttctaaaatgtgccaagcactccatccaggtgttggaaatgtaatggtaacaagacagaaatctaagcccttgccctcatgaagttgataatccagttcaggagagagaatattaataagtaaataaataaacaccattgcttagttagtgacaactatgatgctaaaaattagcctgggtcctgggaagatctgagatggaggggcaggtatcagaggaaccattttaagaaagggtagtccagattggctcaagaaggaatacttgagcaaaaatctgaaggatcaaaaggagccaactatgtaggaggagtgactggcaaaggaagtagcaagaggaagaaatgagcttagcaagttccaagaacaaaaacgccaatgtggcttgaacatagtcaaccagggtggaatagtaaggctagaggccagtctttaccaaggcttggatcatgtaaggccttgcagatgatggtacaaagtttggcttttattctgacagtgataggaggcagctagggtgggagggttaaaagtgggggcgatatgatctgatttacttgttttaatgtccactctgactgtactcattcattcaaacatttgttcagcattaactatgtcctacacactggggatccaggattgaactaaaaagggcaaaatctctaccttcatgaagtttgggtgcaggacaggggttttaggggcaataaatacaaagcacacacttaagcttaatgtttcaagttgatatggtttccctgtgtccccacccaaatctcaccttgaattgcaataatccccatgtgtcaagggtggggccatgtggagataactgaattatgggggcaggtttcccccatactgttctcatggtagtgaataagtctcatgagatctaatggttttataaatgggagtttttctgcacaagttctcttgtctgccaccatgtaagatgtgactttgctcctcattcagcttctgccatgattgtaaggcctgcccagacatgtgaaactgtgagtcaattaaacttctttcctttataaattacccagtcttgggcatatctttattagcagcatgagaactgactaatacacaagtgataatgtcctatcaataaaaagagaataaaaaggtagaatgtgataatgcaagatgccatttcagaaaggttggttgggtccttctgacactgtgatgaacatctggggagaaagcatctcaggaaggtgagcagtcagtgcaaattccatagagaaagcactgttcagctcgtggctggcactatggttcacaggaggatgtagaagaagaggctagagggatagcctgtgtgagagccatgtgcatccttgtagtccatggtaatgagtttggattgtattcttgaatggcaagaaagaccactggatagttctgagcagaaaatgacaatctaactgctgtttggagaaaagacactacggcaacaagactagatgtgaaaaacaccgttacagcacaagagatgtgagtagcttggaccagagtgaatggtcagaatctatacatattctgaaggcggagcaaacagaatttgctaatcgacagaatgtgggggtgggaaagaatgagagccttcaagcttgattctaatggttttgtcttggatgtaatgctatttctaatttccctgcctccctgtggctgcatcttctctatatccctggtaggctccatgtaatctaatgttatttgcccaagttctacccttgaccatcttctcttctcttgttctcttctctttttatcatttccatttatactcatcgcttcaactgtactatatatgagatgatacccagagtaatagaatggaaaaggctgtaatttagggtcagatagaattaagctcaattccaagttctatcagttccagctatgcggtcttagttaagataatgacctctctaaatctgcctcctcaatggtccattagagatgataatacctcaaggggatactgagataattaaatatgtcacatttaaaacctcactatatctctggcacattggaagtaatcaaacattatttcaaagttgtattttattttgttttaatctccatctctagctaaaaatcactgcaaaaaagctttcccctctcctccattttccatagtcagccaaacctgaagcccaaaagtcacctttgagtcacctttgtctcctctagctttttctggctttatttctaactgccaagtctgcagattcaaaattatacctattgatttcattccttctgttaatcctatacttaggtagccccaaaatctgctgatcactgtctcgaggcttactctacagccttgtctcagctacacctcttcccacagtatctattgcagtatcttccaacttctctaagtcttatttcagtgatcctcctaaaatgcaagagcactcctaagtgaaaacctgcaaatggctccttataatctaaataagattccagcttgttaatatacattcaagagacatgattttgatcccatcttgtatctccaacttctcctacattatttcgtctttattccatactcttacaatttaaaagtctactgtcctattccaccctgatttgtcccatgttatttcttctgcctaaaatatgctccttcctcccagcaccccaaactctctactgtttattctttaagtccaagtcttacctcctctgaaggatcttccctgaatacatcacagactaagttaccacccttttaagtgaggacagagtagcaagtttgcatcactttactaggccctcatcataccacactgtaatcttttgctaacttgtatagcactccccatagatggccatccttgaagacagaactactcatgactcatctttgtatccttagtgcctaccatcctacagcaatgctgtaatccaattatatagagcagtcaactaatgttcaaagaggttaagctatattatatcatatatgcctgtatgtatcagagcaaagaaggttataaactctggaccattttgttccagcagccacactttctcaaaattagaatcatataaaaatgtattatttcactaatccttcagaggttttcagtctgaaaaaaaaatttctttaagtagagctcaagaacattcttcattgtatatctaaaaatagtgaaatgaaaaactattttagattccttcatttacaaactctaacttaacaaaaacaaaaagcattacatgtaatatatagtgtaagaatctaattggcaaaacttcacaattgccatggatatgatgccaatggaatttcaaacttcttcacagtcatcatgatccaaagtttacaggagtcttaagaaaaataaatcaggacaatatcccaaatttcttttcaaatacaaatactctaatggcaaatatcatgcaaacattatgcaattatttcacagttcacagttttgttcttcttaaaaaatgtatttcacaattttactaaaaattacccacatggtaattacataaataaggaacttgatgtatcagttatattaaaagactccccatacctagtcatatttaaatgacaagtctggaataataaataatgattaacacaagcattaaccaaatacaaaaagctatcttaacattttcctttaaaacttaagtaatgtcttaggtaaatccatccgttatttcgaacaacattgcatcaaacacatcacaacaaagttaaattaataatgtcaaaactggcatgtattatgaaaaaaaaaacgagaagaaaacttagaatagaatgtaagttttgacttggttcacagcttatcttgccagtgcatatcacatggtccctctcttcaaccaccagtcacacatctaagtttaactaaatgttatttatttttcatattttgtggaaaaagcagtctctggtttccaataaaaagatggcacagcatctttcttaccaagaataattactagatggttgttcataacttttcatatgcaagttcctatagtacatacatatgattataaatcatactacaatcatattaatttaaactctactcatcaatcattatcaacttaacaaattagcactcttgtgccctctagtggatgaatgaatacaaaattctgtttattttcctcagaaaggtaaaaactgaacctgactatacacgtgtatattcagaaatatgtttagaagacagatatagtaacagttaaccagttaacaatgtagcccaagaggctggtgaatacagatatgaagacactatattacaataaaatggtagtattccatgggttggagttctacctatagaattcaaatggtttgaattcatactccaacccatagaagtgatgttgtttcaggctcattgtttaatatcagaggctccatttcttcctctctaaaatgaggtggataatagtgacttcataagttgttgtgagaattaaaggggttaacatgtgagtacaatgaacagtacctggcattcattagacgactaataaaatcagtgtcctttccccttattgctatctaatccctcacctctccgtgatcagcatgcacaggtctttcaggcctgctccttccaagcacaggtgactcttgaacaacacagatgtgaactgtgtgcatccatttatacatggatcttctgcctttgccaaccctgtgacagcaagaccaacccctcctcctccgcctcctctcccttagcctattcactgtgaggacaacagggaatgaaaagcttgatgatgatccactcccacttaatgaataataaatacattttcccttccttatgactttcttaataacactttttttctctggcttacgttattgtaagaatacagtatataatatatacaacatacgaaataagtgttaattgactgtttatgttatcagtgaggcttccaggcaacagtaagctattagtggttaagctttaagggagtcaaaagttacatacagacatttcactgcatgggggttggttgcccaacctccgcattgatcaaggatcaattgtattgtcccagtgtgccatatttttttaaatacaagacttcagagaagacttcaagtttgtatacaagatgagaaaaactagaatgctcaatactgttttagtctaggttgatactggctgtcctgtgggtttcattctgaatcgggattctagccctttcagcaactcctcttacttggtcatgggcaaaatggcatagctacactgacatgattcctctatatctcaggcagatattctaatcaccacctacctctctggaataccatgaggattactcaagtcattttctgaaattattttaagtttatatatatatatatacacacacacacacacacacacacacacacatttcatatacataatatatacatctcatgtataatatatatacactcataatatatacatattatgagtatgtatatacacacatataatacacacacattcttaaaattatatccatcttcctgtatatgcatgacttatagtaatagttctcgaaatttaacctgtgaatccctgaagacacctaagacccattctcttaaaggggctctgcaaggtcaaaactattctcaccctaatatgaagatgttttcacctttttcactgtgttgatattcgcactggtggcaaaaaggcaatggtgagttaaactgctgggcttccacatgaatcaaggcagtggcactcaactgtactaggagtcatcatattcttcactgtcctacacacttatggtaatgacaataatttttaaaagccagttgcaataaaaaagtcctgttaaagcgtaacaattattaattttattaagtcttaaggcttaagtacaaaatttttaatatcctatgtgatataaataggaagtgcacaaccatataccacttctatcgcataccaaactacaaaggatatctcaagaaagatcacttgcacaaatgtttgaggtgtgagtcgaatgagccgttttttcatggaacaccatttttacttaaaataatgactaagagataaagcacagttattcaaacttggatatttggcaaacatcttcttgaaaaataacgtgagcctgccttttcaaggaaaacaactaacaggatatgttgctaatgataaaattcaagatttcaagcaaaaattagaaacttggagtacttgttatctgccactgttagcttaacagactctcaacatttaaagactttttctgatttaatctgtagttatagtaacaaatgtcaataatgcaataacttctaactccatgacacaatattttccaaatgaccaatgcataaaattacaaaaagtgcaacatagattttaatataacagagtacaaaaatacttgatatgcttttggattccacattgcatctagtatttagagtgctagtatttgttgagttctagtatagaatcaaagaatgttctcattatataaaaagcattttaaaatatttgtttcatttccaactgcatatgtttataagaccagattttcttcatatacttcaaccaaaacaacattaaaaatgcaaaagcagatatgaaaacgtaaccatcttctatcaagccaggcaagaaaaaggttggtgaaaattaaaaacaatgccatcttcctcttgaatttttttgtttttgaaaatatagctacttttagacaaacttgtttatgttaatatatgccaagtttattataactactgtaaaaattaataaatcaatatttaattttgttcatctctgattttcattatggtaaatgtagatagatataatctatataaacaaaatctctttgaggtcttaaataatttttaagactataagggccctaaagtcaaaaattgtcagaactactacctgaaagaaaccaagatcctccactgaagaaagctatcagtagagatcacttctccctcagttggaagcaggaatgtcaggaactatgggacataaagcagatacttagaattcctgagataaatacaaggaagatctagaaataagaactgagtttaacatctggaaatcctggtccaggaaaaatgagacagggcttgacaatataaatgacaaataggagaaataacgtttttataaatattctgaaattcatacattctcaattccactacatcgcttatatttgctaaggccaaaattccatgccccttagaagaaaagaaacttataaaaaccaaactacatactgatcatttttcttctgaaaataagatattaacctctgttactacagagtatacgccaaatacagaaatatccctggtaaaatatcttttaacaacatgcaaagcaattcactgtaggtttatacagtatattaaagacacataaacagtgcttctgaacataaaaataactcaacattctcaagcttccatgaaaatcagtttgttttcttacttttttttagcaaaatgggctaattaacctactagtccatgttatgaattgcttttaagaacctgacaatgtcatcttgtccgttccccaatatatatttaataaggagacattaaaattagattctgttcaagagaaatattccttctttcaccttgcagttctgaagaacccccaatatataacagaaaaatcagagttgtgctaataagtactcttaggggaataattactgaaaatgccacatataagatagtcaaaatgaagggtaaaataaattctttattcatggatagcttatgttgacaattgtagaatggcttaagcactgcacgaactttggctagcatttgtttcatgttaagacacaagtcaatctgaggtgcctcaaacgtaactgtaatatttgatgaccatgagtatgagtgaaagagaaattcatctaaaagttggcataaaatacagcaaaacaaaatctttagttttgcaaccaaagtaacttggaaccccattacaaaatttctaaaaagaattaaaaataaaaaattaatattaacaaaacaaacgataatttaataatgtatagctttgctattcaacatgtgtacctgaagtagcagatcccacagatcttgttaaaaatattgattatcataatcagtatatcagaagtcgacatacttctactacacctagggactctactcactaagtacaactgtctactctggaccttatatatataacaaacataagacgactctaaaggtggagagaagaaggcagactagctaaagacctcaagatccatgatgacatgctgggttttctttttgcttcttttatcccagatttgcagtggaaaaaaaagttagcaactcagaaatgtagacaaaaacaggcaaggaaacaaaaacaaacaaaataacaacagcaacaataacaaagccctaaaaaaaacatgctctctctagccaatggtctaggaaatggccagcctatgagaataaaaacatttagacactaacagttttacacaagccaaacaccacagaaaaaaaaaaaaaaaacacggtcctactacattcacaccagcacaggccaagtggggagcttaggcctccatcttgtcaagattgtgatgagtcatcccaacaccctaggtggtgtgagagaaagccaagtggggagctgggactttcattcccaccagttggtaaccagcacttccctagtacactgtgtactatcagtgggaccatatgaaaaaccaagactcccaactcctacccatcagtaatgagtcactctttcccctccccactggggtggtttcaaaggaggcagagtggagagttagaactttcaccattgcctggtaataaggttatcttttattggaggccatcctcaacatgatgtcagtgaagaccatgtggagagccaaaattcccactcccacccagcagtaatgagacactcctgtcttcaggagtaaatagaagccaaatgaggaacacaaacttttatctacacctggcagtaacaagggagctccttccccacatatctgctaaaatggtgtcagaaaaggccagttaaaacagaaggtttaaataaaatccagagtctcagaacatatgaaaaagtccagatataagtcaaaaatcactcgtcatatcaagaacctggaagatctcaaactaaatgaaaaaagacaattaatagatgccaacactaagatgacagatgttaaaatcatctgcacagattttaaagcaacaatgataaacaatgtttcaatcatcaattacaaacatacttgaaataaatgaaaacggagaaaaaacaaagaaatagaaaatataaggaaaattcaaataaagtattacaacagaaaaatatggtaacccagacacaaagctcatttggaaaggctcaacagcagaataaatggacagagaaaagaatcagtaaactggaaagcagaatagatgttatctaatctgaacaaaagaaagaaaatagactacataaaataaacagagcctcagaaacctggaaacaatatacttaaaaaaaaaatctgacactaatattcaggtaaagtttccatacttcattcaaactggtaaaatgacaacatcagtagttatgtacatataatacaatatgtagagtaaccaccagaaactacacaaggatatacctcacaaacgctattaataaatcaaaatagaattctaggccgggcgctgtggctcacgcctgtaatcccagcactttgggaggccgaggcgggtggatcacgaggtcaggagatcgagaccatcccggctaaaacggtgaaaccccgtctctactaaaaatacaaaaaaattagccgggcgtagtggcgggtgcctgtagtcccagctacttgggaggctgaggcaggagaatggcgtgaacccgggaggcggagcttgcagtgagccgagatcccgccactgcactccagcctgggcgacagagcgagactccgtctaaaaaaaaaaaagaaaaaagaattctaaaaatgtttgcataatctttaaaggcaggaaaaataaaacaaagaattaaaaaatagaggaggagaaaaaaacagaaaacaaaaataaagtaccaaacttaagccctaacatattaataattacattaaatataaataatgtaaatataacattaaaagacagagattgacagatgaaatttaaaagcataacaaaattacatgctgtctacaagaaactctcttcaacgaaatagggaagttgaaagtaaaagaatgcaatatatacataatgcacatatcattcaaagaaaatcataagtggctatactaatgttagataatgtagacttcagagcaaaaacatatatatattaacagaaagagatattatataattataaaatagtcaatacaggaagaagacacagcaatcttaaatacatatgcaccagacaacagagacgcaaaacatatgatacaaaaactgataaaattgaaagaagaaacaaacaaatccacaattacagttggagtctttaacatgacctttggaagaactaaacagctagacaaaaaattagcaagaatatagacgaactcaacaccatcaatctacaagatccagtcaatatttataaaatattctactgaagaataggaaactatatacagtttcaagagcccacagaacatataccaagagagaatatatcctcatctatgaaaaaaaaacaaaattaaaataactgaaatcagactaagtatgttctctgactataacagaatcaatctaaaaataacaggaatgtccccacttagaaagtaaacaatacattttaaataatccatgagtcaaagaggaagtctcataggaagtcaaaatacattcaaatgaataaaaatacaacatatcaaaatttgtgggacacagttaaagcagtacaaaaagagtaatttacagcatgcaatacatacattagaaaaaagaaaaatctcgaatcaataagctaagcccctacctgaagaaactatgaaaactagagcaaagtaaacccaaactaagtagaaagaagtaaataagtaaataataaagagctaaaatcaataaatcaaaaaagaaaaaatcaatagagaaaaccaataaaacaaagagctaggtctttgaaaagatcaataaaactgaaaaaatatctagcaagactgacaaagaagaaaggaggcatgagttgtcaatatcagaaatgaaatagattcattcaagatcctaaagataacaaaagaataatgatagaatgcaatgaaaaattccatcaatataaatttaacaacttagacaaaataaactacttccccaaaaaacataaactaccacaactcatctaacatgaaatagataatttaaacatccttgtaaccaataaggtaattaaatgtacaacttaaaaaatcccaaaaaaggaatgtccaggcccagatgggttcaatggagaattctaccaaatggttgaagaagaattaacatcaactctatacaatttcttccagaaaacagaagaagaaaaacttaccaattaatttacgaagctaaaattacactaatccccaaactagacaaagacaaagggagggaaggaagaagggagggtgatgaaagaaagagaaggaaaattacacatcaacattcctcataaatattcatgcaaaaaatcattaacaaaatattgcaaacaaaattcaaaaacatagcaataatataatgatataaaaagaatcatacaacatggcctaatggggtttatttcagggaagcaaggctagttcaactttcaagaatcaatcaatgtaagctaaaacattaacaggatttatttaaaatcacatatcaaatgatgcagaaaatacgtatcaaatgatgcagaaaaaatcatttgacagaattcaatattcatttgtaataaaaaatgctcagaaaaataggagtagaagggaacttcctcaacttgacaaaaagcatcttcaaaaaacctatagataacattatatttaagtggtaaaagactcaagactttcaccctgaaattgggagcaaagcagagatgtctactctcagcacttttactcaatatagattgaactcagctctgtaccaagcggacctaatagacatttacagaacactccaccccaaatcaacagaatatgcattcttctcagcaccacaccacacctactccaaaactgaccacacagttggaagtaaagctctcatcagcaaatgtaaaagaacagaaattataacaaactgtctctcagaccacagtgcaatcaaactagaactcaggattaagaaactcactcaaaagcgctcaactacatggaaactgaacaacctgctcctgaatgactactgggtacgtaacgaaatgaaggcagaaataaagatgttctttgaaaccaacgagaaaaaagacacaacataccagaatctctgggacacactcaaagcagtgtgtagagggaaatttatagcactaaatgcccacaagagaaagcaggaaagatccaaaattgacaccctaacatcacaattaaaagatctagaaaagcaagagcaaacacattcaaaatctagcagaaggcaagaaataactaaaatcagagcagaactgaaggaaatagagacacaaaaaacccttcaaaaaatcaatgaatccaggagctggttttttgaaaggatcaacaaaattgatagaccactagcaagactaataaagaaaaaaagtgagaagaatcaaatagacgcaataaaaaatgataaaggggatatcaccaccgatcccaccgaaatacaaactaccatcagagaatactacaaacacctctatgcaaataaactagaaaacctagaagaaatggataaattcttcgacacatacaccctcccaagactaaaccaggaagaagttgaatctctgaatagacaaataacaagatctgaaattgtggcaataatcaatagcttaccaaccaaaaagagtccaggaccagatggtttcacagccaaattctaccagaggtacaaggaggaactggtaccattctttctgaaactattccaatcaacagaaaaagagggaatcttctctaactcattttatgaggccagcttcattctgataccaaagctgggcagagacacaactaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacagagtgttggaagttctggccagggcaattaggcaggagaaggaaataaagggtattcaattaggaaaagaggaagtcaaattgtccctgtttgcagttgacatgattctatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatcctacttacaagggacgtgaaggacctcctcaaggagaactacaaaccactgctcaacgaaataaaagaggatacaaacaaatggaagaacattccatgctcatggctaggaagaatcaatatcctgagaatggccatactgcccagggtaatttatagattcaatgccatacccatcaagctaccaatgactttcttcacagaattggaaaaaactactttaaagttcatagggaaccaaaaaagagcccgcattgccaagtcaatcctaagccaaaagaacaaagctggaggcatcacactacctgacttcaaactatactacaaggctacagtcaccaaaacagcatggtactggtaccaaaacagagatatagaacaatggaacagaaaagagccctcagaaataatgccacatatctacaactatctgatctttgacaaacctgacaaaaacaagcaatggggaaaggattccctatttaataaatggtgctgggaaaactggctagccatatgtagaaagctgaaactggatcctttccttacaccttatataaaagttaactcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattaacaaatgggatctcattaaactaaagagcttctgcacagcaaaagaaactaccatcagagtgaacaggcagcctgcaaaatgggagaaaattttcgcaacctactcatctgacaaagggctaatatccagaatctacaatgaactcaaacaaatttacaagaaacaaacaaacaaccccatcaaagagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggactgtaaacgagttcaaccattgtggaagtcagtgtggcgattcctcagggatctagaactagaaatatcatttgacccagccatcccattactgggtatatacccaaaggactataaatcatgctgctataaagacacatgcacacgtatgtttattgtggcactattcacaatagcaaagacttggaaccaacccaaacgtccaacaatgatagactagattaagaaaacgtggcacatatacaccatggaatactatgcagccataaaaaaggatgagttcatgtcctttgtagggacatggatgaaattggaaatcatccttctcagtaaactatcgcaaggacaaaaaaccaaacaccacatgttctcaatcatagatgggaattgaacaatgagaacacatggacacaggaaggggaacataacactctggggactgttgtggggtcgggggacgggggagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaataaaaaataaaaaaagagaaacaagaggaaataaaaggcatgtatactggaaaaaaaaaaaactacccctatttccagatgatatgatagtctacatagaaaatctcaaggaactcattaaaaagctcatagaaacaataagtgaatttagcaaggtagcatggtacaaaataaacctgcaaaaataaattgtattttaatatcaataatgaatatatgggaagaatttaaaatgcagtactatttacaaccatgaaaacatacttaaatataggtgaaactctaacaaaaacatgtataaaacctgtatgctgaaacttacacaatattggtgaaagaaatcaaagacctaaataaagggaaagacatactgtcatgataaattgaaacactcaagatagtaaagatttcagtttttcccaaacttgtgaacaagcttgatgaaattcctatcaaaactcaagcaatatttttcatagatatagacaagattattttcaaattgatacagaaaggtggaagaactagaagagttaagacaattttgaaaaataataaagcaggaataatcagtatacctaatttcaagacttttacagctacaggaatccagattgtgtcatattggtgaagggataaatacatagcccaatggaacaaagtaaagaatccagaaacatatccacaccaatatgcccaacttacttctgacaaagttgcaaaggcaattcaataaaagaaagagagcttttcagcaaatggtgctagagcaattgactctccatagacaaaagaatagccttggacctaaattttatatctgaagcaaaaatcaaatcaaaattgaccacagatttaaatgtaagtcataaaatcataagacttttagaaaaaaacataggagaaaaatcttcaggatctagagctaggcaaagagttcttatgacatgaaccataaaaactgattaattggactccatcaaaattaaaaattttctctgcaaaaggccacattaagaagatgaaaagacaagtcaaaaagtggtagaaaatatttgcaaatgacatatctgacaaaggaaaattttctagaatagattagctcaaaatgtaaatttaaaaaattcaattagaaaatgaaaaagccatgaacagacatttcacatatttagagaatacataaatggaaaataagcacatgaaaagataattaaccattatgaaaatccaaattaaaagaacagtgagctatgactacacactatcataaaggcaaaaacatagtgacatcaccaaatgctggtaagaatgtgaagaaactggaacattcatacgttgctggtgggaatgtaaaatgttacaaccactctgcattaacagttcgtcaactttttaaaaaactaatcactcaattatcatacaatccagaaatttcactctagggcatttttaccagaaaaactaagggttatgttcatttaaaaaaaaacctgtacacaaagtttatagcacctttggtcacaacagccaaaaattggaaacaacctgatgtctttcaatggacgaattattaaataaagtatgatacatccattccttggaatagtacacatcaataaaaaaaatgaacaaactattgatgcatacaacaacctgagtgaatctccagaaaattatgcagagcaaaaaaaaaagtcaagtcctaaaaggttacatactatatagtaccatttacatactgttctggaaatgacaaaaatggaaatgaagaacagattcacagttttcagagcttaaggaagaagtggggtgggagaaaagtggtcatggctataaaagggcaatatgagaaagccttttagtcatgtaacacatctgtatattaactgtatcaatgtcaatattctattggtaatatcatactgtagttgaggatgttattgagggaaacagaaaagagtacactgaatctatcatttcttataactgcaacagaatctataactatctcaaaaaggtttaatttaaaaaaaatgtagatcatgatttagtaagtaaagcctgagattctgtatttctaacaagtcttcagataatacagattccactgctgtggggaccacaatgtaagtaataagtcattggaaaattggtcactgtaactcatcatactaacaggctaaaaataaaaaaacccatgaccatctcaatagatgctagaaaggcatttaacaagatttaacatctataaaagagaataactatcagcaaactaaaattagaaggccagttccccaacctgaaagtgtgctaatgaaaaacttacagctaacgtcctatcaaccattattgactgaatgcaattttcctaagattaggattaagacagagatttctactctcatcttttttttcaacatttcatttctagagatcctaaccaatgtaatgaggcaagaaaaaaaaggcgtacatattggaagggaagaaataaaactctctttcccagaaaatatgacagtttatgtagaaaattatgagagctaccaaaaacctactaaaactacaaagccacaggatgcaagggaatatacaaattgtacttccaaaattggtgaatttcattttgtctaagttataccccaataaatctgattttaaaagctctatagctaaactaaatagtctagccttggttaaagcagtatcaataatcagtcttataataaatgtcttagctaatggcaagtatccctcactccttttatttctctttttccaaaagagtgacaccccatcaacaatgagtttcaggaagttcattcttcatttgtccccaagataaccagacaatacatttggtttgccccagtctcaagtgtaggacaaatcttctgttaacagtggctctcagagaggttttcactactcctagtatccaacctagctgcaaaacaatataattgtttggataaaagtaaagaagtaaaatccaaagaatacccaaaccttcattaagatagcatttgtgccaggcacggtggctcacgcctgtaatcccagcactttgggaggctgaggcaggcgatcatgaggtcaggagattgagaccatcctgactaacatggtgaaaccccgtctctactaaaaatacaaaaaattagccaggcgtggtggcaggcgcctgtagtcccagctactcaggaggctgaggcaggagaatggcgtgaacccaggaggcggaacttgcggtgagccaagatggcaccattgcactccagcccgggtgacagagcaggactccgtctcaaaaaagaaagaaagaaaaaaaaaagatagcatttgtttgttctatttatttgctccatttattctcaaacagccctggctccctccctcaatcccatctaatttaccccaatcttactgtccttccttaaatgcaatagaatccagaaatgtgtaaaaaggaaaagcaaaaagataataacaaagtttaaaacctaacactaaattacagtgcacagtacatattaaggcactattctagtttcttatgtgtaaaattcttccagtaatgtcctgaaagttaaatgccttccttttttcttttaaaaaacatatttttccattatcatttataaaccaacaactacatttaccctttcaaaacttgggatcctgaccatctatgtcttactcaaatattcccttagtacagcatacttaaagcagggtaaaaaaagaccaaaaggcagataagtgtgtctgaacctcattaaggcacaaatggagttgtatttgattcactgtacttgagctacattcctacaccagaccaaagatgaagccaggaaaattcagttcccttgatttatatactcaccttagcaaaagtgggagtggatctcacaggctactcacagcaaatctgcagtgctctcatttgtcatataggacaaactagaaactcccatggatggtgaggataggcagcatggcggaagtgtgcagagtggtggtgagggtggctgctattgcagcatatagcctaccttaaaggtagatacctgaaagatactcaggtaacaaggaaaaagtccaattctggttgtagatcactcttgggaatagattttttaaagtataagacccccaaaatgccagagtataaacgaccctccctttcaatcatgtatccttgtttttcctatttcccacattataaatatcaaagacctgagcatttacatcagattggtgtgctcaaaacttcttgaaaatggtgtgtaaaatgtcagtaagatgaaatgggttgtaaaatgtcagtaagatgaaatgggttaaaaagagaaatgcagcatattatacttctgattatttctgcagccacaaggttttcattaagcttcaagcatgtgggtttgtgattatgttcatgacaacaaacactaaaacatggaacaagatccgtagttcaaagaaatgaaatattccagaatttatccacatattccaatatactgtttttgtgtattttgtttccaactcaagaggtttcttgaaacctctacaaaaatgttaatcttagtgattcattcacaaagggtttaagctaaaatttttgtagtttagactggagttcaattgtcaagtaatgattttagaagtgatataaatttttaaaattttgatcagatcatagagaatagataaacatgtctattctaatgcaaaattttagctacgtttcctgcattatcttccaggcttaattatgtatgttctggtttaacaggttattttttttttaaagatcattggaaaaatatgttcacaataaaatcattcaagaaatatatttctaccagtactcttgtttcctaacttcctattttttaagttcccttaattttcaaaacacaaacttttcttttctctcctgagttatatttgctgctcctaaccatacttacattgttcaatgccttctaaatataacaactgctatggtctgaatgttagcatccccctcaaaattcatacgttgaaacctaacccttacggtaatgaaattaagagggggggcctttgggaggtaataaggtcatgagggctttgccctcataaatgagattagtgcccttataaaagaggcttgacagagcctgtttgccccttccaccatgtgaggatgtagcaaacaagtgctatctttgaagcagagactgggccctcactggacactgaaactgctggtaccttgatcttggatttcctagcatccagaattgtgagcaataaatttctgttgtttagaaattacccattcttacatgtttccatatagcagcccaaatagactaagatgatacctagtacgtgccttcatgcaagaactgtatatagtagtagacttacatgttatcttagttaaaccagactgaaaaacttctgtagtaaatatcatttctgttttataaatgaggaaactaagatctacataaatcaattaaacttgcccaacttaacaaagtttctagatggcacagccaagctttatccagttctaatgtactccaacacccaaaatgtattttcatcattgtagtaagtactgaggccaccttggttgaacaaccacatttggatattcatatactttactcatatttctgctcagtcttgtacagagaggcctatctggctcctacttaaaaaataaaattatttgaatcataggttctatgtctatttcacaaagaaaactgagaacctagccctccatcaggcctctgaagcaagagccctccgtcattaataaatccagggctttggatggattctatttttagagtgcttgaaaagatccaaatgctagaaaaatcaaattttcaaataggcaggtttctgataataaaagattgaatcaaatatgaaagaaaaaaataattctttcccaaaacagactgcatgaccagatggaagaaagagtttaagaacaaaaagtgccaagtacttaattcaagtgaagaatacaggcattcgagggtcaatgcactacttagaacagccagagtgccagcatggacagaatactgcaccttcattctctgatgcttttcactcatctgctctatcacttccttattccccctctaatgtcattagtttaaaaaggtagaagggcaaaatatagcaaataataaatgctcagttaactgtagattgttcattggatttcatgaaaactatgcacatccttatctgaatttaataacttattttaaggatgatcacctctccagtcatcacttttactttacagaagagaagaaaaaatattctgagaggttaaaatattcccaaagtcacaagaagtgaggcatagtgaccactgtatgccaaaggttgttgtagaagatttacattctctataaaaggtatgtcaactcttagatcattaaatctttttcacagaaaacatgactcattgtgattattcacattaataaaattatattggctcaatgttcaggaaaacaaataagtagaagacaaaggtaggagaaaaagctaacatggatattaagaaggaaaaaaggatgcatgtgctaaaataggtcttcaaaaaatttgcagcaagtattctgactccatcacaagaatctatgatcttcttaagaggtggcttggagccaagaaaaattcactagatgagagtgaaggagtcaaagaaccaatcagcaaaacaaaatttcaatagctaatgctaagtaaaacagatgcccatctctgtctgccctgtccctcaccatacatgggcaatcagttataccactctgtaaccattacctttggttccagatttaccatgagcatgcagtcttatatcggttagtgacaaaaacgctttccatctcttattaacaatactttctgctacatattcagtcttgtattcattccctttacatatatgtaaaaattagcatgtgagtaaaaatcaggttctatatgctgacaagcacaatactgaatgaacctggtatatacaattaataaagagatggcaacaaaaagggagtagctatgatcaaatacaatcattctctctacactgctagaagagtttaataatccatataaacattataatcaaaaagaattctgatgcatttataaggcttgacttaagagaaaaaatagctcttcctaagagaaaaaatagcccttttcttattcattttcttggccatgtttgaaatggagaaagaaaaaaataaataaatgcccaaatattgtgcactttggttatgagtccataaatttctatgcatattattcaagccagaaaagttacacaatcaagtctttttttatttttaacttagtgattaggagtgattaaccatgatcctgttgagttgcaaacgtggcaatgtaaaggcctttatcccctatgctttgtggtcttgatttaatagtgttgtgtattcaatatatttaatatacaggagctgccttttcctggttggtaattaatgtcccttggaccctgaaattgctcagaacagggacttctctgtggagactatattccagattacactgctatttttactttataggttcttgaattttaaggatttatttctagattgtacaggttcacattttgcatcaaggttactagtcagatagcttactcttctgataacaaattccatctctgtgaaatactggcatttgtcatgctatcagtttttgaaatgttttggtagtgcctgagatgatccattgctcatcacttccaccacttctaacctaatccaacctacagccatatctcaaatgtgatcatctcctgctctctagttgattcacattttaggcagggtaatctttttcaagatagattactttattcaagatttactatttataattgacaaatattacatatatatttaaggcataaaatttaatgatttgatagacatatatatttatgaaataatcaccacaaattaattaacctatcacctcatgtagtcatcaatattttttctttattttcgtggtgagaacacctaggatctaccctcttagcaaatttcaagcatataataaaatacaacaactatagtcaccagaacttagatctccagaatgtactcatctaataactataaagtttgtatgctttgaccactatctccccattttctcctcatcatgacctctagcaatcttccttctactctccatttctataagttgacttttttatattccacatataagtgagatcatgcaatatttgtctttctgtgtctggcctatttcacttagcataaagtcctccagattcatccatgttgtcacaaatggcaggatttccttcatttctaaagctgaataaaggtttagaaaggtttccctatccattcatacattgacagacatttaggttgtttccctatcttgttgattgtgaataatactgcaatgaatatgaaagtgcagacatctctctgagatagtgatttttcttgtacagtagcccccctttatctgcagtgttgctttctatggtttcgatcacccatggtcaattgcagtccaaaaatattaaatgaaaaattccagaagtaacaattcataagttttaaattgcttgttgttttctgtagcatgatgaaatctaatgtcatctagctctgtcttgcccaggacatgaatcattcctttgtccagcaagtccttgctgtctatactacccacttgttaatcatcaacatcgtctgctcctgacagccaaccatatcatagcccaataatccaggatcacctgaagcagatgttcttccttctgaggtatagtcagaaacggaataataacctaacactacatctcaatggctacggcattcacctcacttcatttcatcacataggcattttatcatctcacatcctcacatgcatattttattattagttatttgtattaatttcttattgtgcctattttataaacttaatcataggcatgtatgtgcaggaaaaaatatagtatatatagggttcattactttctaaggtttcagacatccactgagggtctcggaacatatttctcacagataaggaagttgctgtatatatacccaaaagtagatcgctggaatatatgtagttttatttttaattttttgaggagcctccatactgtttttcataagtgctgcaccatttacattcccatcagtagtgtacagacattcccttttctccatatctcaccaacacttatctttcacttttctcctagtagccatttcaacaggtgtgatgcgatatctcactgtgagtttgatctgcatttccctgatgattagtgatgtggagcactttttcatatacctattggccatttgttgtcttctattgagaaatgtctattcggatctttgcccatttttcaaatagattgttttgatgctattgagttgttgagttcttcatgtattttgcatgttaaccctttataggatatattgtctgcaaatattttctcccattctgttggttatctcttcactttgtcatttatttctatgcaaatgcttttcactttgatgtaaattcatttgtctatttttgcttttgttgcctgtgcctttgtgatcatatcaaaaaaattattgcccagactaatgtcatgaagcttttttcttttgttttcttctactactttggcaatttcaggtcttaagagttaagcttttaatacatttgaacggaattttgcatgcattgtaagataaggatcatatttcattattctgcatgtgcatatctggtttttccagcaccatttattggacattgtcttttccacattatgtattcttggcacattgttaaagaccagttgactgagtatgcgtgagtttatccttatgctcttttttctgttccattggttttcatgccagtaccatacgttttaattagtgtagctttgtaataaaattttaacttaagcagcctgatacctctagctttattcttcctgctaagtttctttggctactcagggtcttttgtggtttcacaggaattataggattgtttttctatatctgtaactacttccatgaagcttttgatagaaatgcactgagtctgtatataactttggttagtaacattttaacaatattaattcttccaatgaatgaacatgagattttttccatttgtctttaatttcccttatcaatgctttatagtttttagtgtacaagtctttcacttatttggttaagtttatttctaagtattttattctttttgttgacattacgaatgagattgttttcttaattttctttttggacaatttgttgtttgtaaatagaagcacaattgattttgttctgttgattttttattatgcaaccttactgaattcatttgttagttctaacagaattttgttgttgttcattctttagagtttcctgggtatatgatcatgttatctgcaaacaaagacaatttttcttctttttgtttttttctttcctaaatgctctagctaaaacttctgatactatgttgagaagtgaccagagtaggcatctttgtattgttcagtatctcagaagaaaagttttcagtttttcctcatttattatcataagaggtatgggtttttcatatatagacttcactatgttgaagtaagatccttctatcactattttgttaagagtttttatcatgaatgggtattgaactttgtcaattgcttgtcctgcatctatgaaaatgatgttatttttgtctttcactctgttaattgtgtatgtagacccatccttgcataatagaaaacttccactttgtcatggtgttggatccttttatcatgctgttgattagggttactggtatttccttgaggatttttgcatccatgttcatcagggaaattagcttatagttttcttttctttactatttttgcctggttttagtagcagggagatgctggcctcataaaatgagttggaaagtgttcccttttcttcgattttctggaacagtctgagacagattcatattaatttctcttttaataaaattcacctatgaagccatcaggttctgaacttttcattgttggcagatttttcattactaattcaatcatctctttatttgttattgtccttttcaggttgtttcttcccgacacaattttggtagtttgaaagtttctcaaaattgaaaattgatccatttcttttatgtaatctagtttttcgggatataattgtttataatagtgcctatgatttttatttcagaaaaaaattgttttaatgtctcctcttatatttctgatattaaatatttgaatcttctttctctttttcttagactaagggttttttaaaacttttatttatctttcgaaaaacaactttcagctttgctgatttttttctgtttttttattctctatttgatttatttcttttctaatttttattgtgtccttatttatgctaacactaggcttagcttattcttgtttttctagttctttgaggtgcaaagttttttttttcaatataggcatttatacctacaaagattcctcttattaaagcttttgctgaatcccatgggctttgatatgttgttttaattttcctttgtttcgagatacactttacattcccttttaattttcagtgtagagcttagtttccatatatttgtgaatttttcactttcttgctgttactaatttcaacttttattgcactgtgctcagaaaaagtgatttttattttggaatgatttttattttcttaaatttgttgagatttgttttgtgacctaatatgtgatctaacctagagaatgttctgtgtgtactgaaaagttctgttgcgtgaaaagttctgtatacatcagataggaccctttagctctccagtgttgtttgagtcatctgtttatggttgatattcatatttgaatgttccacctattcttgtaaatatggtactaaagtccccaagtgttactgtattgctgtcaatttctgccttcagatctatcaatatttactttatttagataaaacattatctaaatatttagatgctgtgatatttggtgtgtttatacttataactgttataacttactgttgaattaactcttttatcaatgtataatgaccttcttttcctctagataaggttttagacttaatgactattttgccaaatataaatatagccaccagttttcttttatttgcatgaaatatctttttacatcccttcacttttagcctatgtgtctttaattctaaagtgaacctcttatagacaacatatcaccaaatttgttttttgtccattcagccattctatcctatgacttttgtttggtggtgagtttaatccatttatatttaaagaaattatttttaggtgaggacatactgttaccactttgttagttgttttctgtttatcttacagtggttttgtctgtctcatcctcttttgttatcttcctttgttattctatttttgtagtgatttgctttgatttattttctttatcttttgtgtgcctattacacgctttttctttgtggttagctcatggcttgcataaaatatctgatagttttaaccttctattttaagttgataacaacttaactctaatctcatacaaaaacactatacttttactcctcatacatacattttgtgttcttgtagaaagagtgtgcttcatatcatactgtgtaaccactaacacatttttatctattaatgtatgtgttaatattaaaagtaatttatgcaccactttgatgatgttacattaatttgtacatgtccatttggctgtatctgttatatttatgctttcaaatgctttttgttgttgtttagcatattttcatttcaatacaaaaagtcccttaagcatttcttgtaaagtaagtctagtggtgacaaactctctcagtttttgtttatctaggaaagtcactatttctccctcatttttaaaaataattttacaaagtatagtattattgtggagtttttttctttcagaacttttaatatatcatacaaatcactcctggacagctaaaaaaaaataaatacactgtcagtcttatagaggtcaccttgtatgtgatgagttgcttttctcttgctgctttcaaaattctatctttgtctttgacatttgacaatttgattacaatgtgcctcagtatagtcttcttcgggtttatcatgtttggagactttacagctttcatgaactagaatgtcaatttcccgctcaagatttgggaagttttcagatattaattctttaaataagctttcatctcctttatctgtctcttctccttcttgaactctcaaaatgcatattttagttttcttgatgatgcatcatgagtctcataagctttcttcattcctttttattctttgtccttctttgactgggaacctccaaaccatgggtcctcacatttttagatatttttctgattgattgagtctgttgctgacactctctattgctttcttcattccattcattgtattcttcagctccagaatttctgtttggttctatttttatgatttctatgtctttgttgaacttcttgttttgttcttgtattgttttctgattttgttaagttttctatctgtgttctcttttagctaccttaatttccttaaaagaattattttgaactcttacccagttcatagacttccatttctttacagtcagatactggaaaattatcatgttgctttggtgatatcatgtttagctgatgttttgtgtttcctgtagccttgcattgacatctgcacatttgagggagcagtagcctcttccagactttatgaactggcttcagaaagatatttacctaaggtagggtgtgacagtgccaactgggtagggtgtgacagctttggctcagtttgggggtgcttagtagtaattctggcttcaggcagatgcaacaatgaaatctccacagagttacatcagctaggtcagcatcagcagagactatgaggatcttcagcagccaaggttacaaatatacctggcagcaaaaaggactcttggtgtccttaatggaaaaggttgctggggtcctctagttctccttttccctcatgggggaagtcatgaccaagggaatcccttttagcaccaggtctgacatgtgggcgcacacaaccagtggcagcaatgtccgggtctgggacacaggtgcccttaccataatgatggtgtaagtgtctaaggcctgagtgtgctaagcagccgcgaagacagggtccaaggctttggggtgtgtagaacaaccacagcacttggaaccatggaatgggcacactcactgcagtagtgacaccgttatctaaggtgtgaaaatgtgtggaatagtcccagggtctgtggggtctatagagtcattgtagggaactggtagctctggctggaaaagagagaaatggcaggcacagcagcaaatcagcaggatggggaagaaggtgcagctgtggtatctctgctctcagatggggtggggttcaatcaattatttattacttaaactgaaaagccaggtttacattattaataagcttacattttatatactattagctatgtatctggaaggaatgcaggagacactgactacctttttacaaagaaaaaaagagacattatttgtcaaactcctttaaaacattgttttgtagaaatacacaggtaaggctacaaagtttaactcaataataacagttgcaaaaaaatacctagaaaaatcatcaaatcatgacctacctctttcagttattttttaataacctgcagcaaaaaaagcaactttctcacagtaacctatatatattaaatgtgctgccaacccagatctttagaacattacaaacaattttggaaaaggacactttttggaatatatatttaagcctggttaaaagatagaaccataatacaaacctactatacagcaaggactttgcacagaagcaaattaacacactatttgctaactcaatacagcactatttctggtctacatctttccatgtaagcaatcttgtcaactacaaatgtactatgtacctactatgtgccagtcactataaagtgttagatatcaaaaatgactataatgggagagcttttttattttttccatttaatcttttgaaatgagttgtaaatctgtaaagaaaattattagacttttctcagttgtagctcctgcaaacatggcataagaatggtgcttacttaatcttacagaggaaatcttcaatctacagagttggcaaaataagcagataaaatctggaatgattaacacgtcatcacagcagtagttcttgtgtggttttctagtcataccttcaaatgtaataaattaagtgttcctactttgggctttctcttgctgaaagcagtattgttcactcaagtcaagtgttcattttagagatgttttaccagtgtaaaataactccatcttgtggattatcctgaccatggcattcagatctcacctttcttctttaattttttaaaggtaagactagcatcagcctgatcctttccaacctctgtaatctgtcttgtttcctactggatattaatcttcacaagcatcccgctatatggcataggtatataaaagtgtctgccactcctagtatcatcaatcctatgaccactatggagcttagattttccagcccaccaggaccaatacagcttagtgtcagaagccatcgattatactgtccctattcattttaattccattgaaatatctaggagggaagatagtaaacatagtaaggaaggctctttgaacggctgggatataagagagtggtaatccaatggcctcctcactttacatggacttttgtccttttgtacacctgtctcctgtttgctttctgaagatgataattataattctgtatatttcaactcaaatacacttaaaactgacttataaaaataaacattcagccgcacatcaagaaaaatcctccattttgataccatatttttgaagttcaaaatttaaaggaacttcttctctctcacccactttgcacaataacaattctaacatccaatatttcttccaggtgtcattccaggtcccccctttggaagctgccagaggctttaatctaaagcacactctgcttgtgtaaagggaagttatcagatgtttaatatatccactaattaatagaatatttttttcctatataatccacaaatttatgatggaaggaaggataaagctgttggaagtattttatcttaagaacaaatgcaaatgtactttattctatcacttaaggttacagaaatctctattctggaaatgcatatacagacactaccacaaaatccagaatatattttatatcgtgatcaaaaatgcaggataagcaaggcctcagtatgcagtagaattagcacattattttctattttaatatgtcactacttctgttctacagaatgtaactataaacatactcttttggagaacttgtaaaacattttcctatctattgcttacatttttatggaaatggtataactgaagagacatcaaggagagtcttttagtacatattatgttaaatattaaaaatattttatcaaaacatagcccataaaattattaacccagaagaatatcataaaatattagctcagttttttaaggaaagtatatttttatactctaaatatatcataagatttacagatattcaaagatctgaaactaaagccctaatatttaaaatataacaaagctgcctccaaaaaaatctcaacttttcttgttatagattaatgattatcatcagaaaaaaagtctatttacattaacataaaaactgaccagcctaattttaacttcatccaaaagtttgtctcaataatttgaacaaataaaaaattaaaaacttatttctgaattcacatcgctaaagataagtcagttatctgtgcctcaaggactttttctcagctcagttaaaagataaaaagatttgtttttcatgcttgaggctttcaaaggctatggcaatttgtaaaatgtcaatatccactgaaatttggcccttagctctctaaattctctctttgtacatgcagatgcttctgcagataattgtgactactttcaggcataactaaaaagaccagtatataactaagtgttttccgtataacatattaagtaaaatgtgtcctttgtcttagagagcgaacactatatattgaggctggcaatatttatcattttgctcaaaagtaagcactctacgatttctgcaccgcattctggtctaacaactccttataactttttaagccatctatagtgcttttaggaattgaaatcagatttcccagcatccctgccattgtatcaatgacatcacgagctctactcacagtaatgtaaaaaaaaagacatcagaactcaaaccatcttatattgagagtaatagaagtcataaaaagagttttactagaaaagcctgtaaaaaaaagaatttgttttcagaagaaaaagtacatgaatgagaatacaactttcaaggtaataaagaatgaaactacagtttgggcatacctactaaatcacattcatcagaggatattaatgtattccaaacaaaagcaagaaaaacagaacattctacctcaccctgaaatattcaatattccctctctctctctcactctctctctctttctcacacgcacacacacacgcacacacacgtttattaatatgtgagatgtgtgtagaactaaaatattcttggagcatctaggattcacttccaaagtttcttttctctttaacttccccataaagctgtctcatagtttcagtaataacagaattcttggccacattggtaaaagagtggttcagaagtaaataatctgaatgttcattgttccaatacttcaagtccatgcctttgaactgattacacataattcttccatctctgacactatttataagctaatataaaatcacctataacagggttgtcaagattatggtccacagaccacttgcatcataatcatacggaatatttgataaaactagaatcttcagcccctacaagacctaccaaattcaaatctctaaaagtcagcccagaaatgtgtattttagcaagcaccccatgtgagactcataccaaaggaagtttgagaatcacagatctggaatctgaaaggtctgtaaacaaattcagaagacatcttccattgttttgtctacagtctgtgaaatgcaataagaaatttcttcccattattaaagtataataagaatctatgtttaaaaatctattcacaaaagtaagcgcaagctttagatacttgttaacagcactgtacatgtttttaattatagtaaatcaagtcctggatcagaagctaaacagtacatcagaaggaaaagcttatttcagcaggataatctcctcctacaggtggacaagattatttatacaagtcaatataaattccactaaaaaatgatgcgagaacatacctcttagtctaaaaagtggtaaactacatttattaacaaccaaaaatcaacttcctatattacaccgacctatgtacttgccatatgttgcactctacaacaatgtatcttcgggggctcaggcatttctttaaatttttccatttttgataatttcaacttttattttagattcgggagtacatttgcaggtttgttactttggtatattgcatgatgctgaggtttgaggtacaattgatcccgtcacccagatactgagcacaatgcccaatagtttttcaacttttgccatccttcctagctccccactgtagtggtccctcggtgtccatcattcccatctttatgtccatgagtacctattgttgaggtcacccttataagtaagaacatgaggtatttcgttttctgttcctgtgttaatttgtttagaacaatggcctccagctgcatctatattcctgcaaaggatatgatttcattcctttttattgctgcaaagtattcaatggtgtatatgtaccacattttctttatccaatccacgactgatgaacacttagattgattccatgtctttgttattgtgaacagtgctgtaatgaacatacaagtgcatgtgtcttcttggtagaatgatttattttcttttggatatatacccagtaatgagactgctgggttgaatggtagtttaaagttctttgagatatttccaaactgatttccatagtggctggacaaatttgcattcccactaacagtgtataagcattccgttttctctgcagccttgacagcatctgttattttttgactttttaataataaccattctgactggtgtgagatggtatttccttgtggttttgatttgcatctctctgatgattagtgatattgagcattttttcacgtttgttggcatgtacatctcttttggagaagtgtctgttcatgttctttgcccatttttaagtggagttacttgctttttgcttgttcagttaagttccctatagattctggatatgaaatctttgtcagatgcatagtttgcaaatacttttcccattctgtaggttgtctgtttaatctgttgatagtttattttgctgtacagaaaagctctttagtttaattatgttctccttgtcagtttttgtttttgttgcaattgcttttgaagacacagtcacaaattattttccaaagctggtatcgattatggtatttcccaggttttcttcaagaattcttgtattttgaggtcttacatttaaatctttaatccatcttgagttaatttttatataaagtgaaaggtaggagtagttccgttcttctgcaaatggctagccagctattccagcaccatttattaaatagggggtcctttccctattgcttacttttgttaagttttttaaagatcagatggctgtaggcatgtggctttatttctgagttctctattttgttccattggtctatttgtctgtttttgtgcatgtaccatgctgttttagttactgtagccttattgtatagtttgaggtcaggtaatgtgaggcctctggctttgttctttttgcttagcattgctttgactatttgagcctttttttgtttctatatgaattttaaaatagttttttcaaattctgtgaaaaatgacattggtagcttgagaggactcgcaatgtgtctgtaaattgctttggacagtatggccattttaacaatattaattcttccaatccatgagcatgaaatttttttcagtttatttgtgtcatctataatttctttcagcagtatttgattgttgtccttgtagagctctttcacctctttggttacatgtattcctaggtattttatgtatatttatttaagctattttaaatgggattgtgttcttgatttggctcgcagcttaaacattattgatatatagaaatgctactaatttttatacattgattttgtatcctgaaacttcattgaaatcatttgtcagtaccagcagctttttgacagagtctttagggtttttttagctctagaatcatatcatgagcaaagagagataatttgactccttctcctatttggatatcttatttctttctcttgcctgatttatctgataaggactcccagtactatgttgaataggagtggtgagagttagcttcctgttcctgttctcaaggggaatgcttccagttcttgactgcttagtatcgttgtctcctatgggttggtcatagacagttattaaaattttgaagtatatttctttaatgcttaatttcctgagggtttttttatcatactgggatgttatcaattttatcaacagctctttccacatctattgagatgatcgtatgattttctttctaattctgtttatatggtgaatcaccttttttgatttgtgtttgttgaacaaacctcgcatcccagcaatgaagcctacttgatcatggtgcattcactttttgatgtgctgctggatttagtttgctagtatttccttttcaagatttttgcatctatgtttaacagagatattggcctatagttttgtttctttgttatgtctttgccaggttttggtatcagggtaatgctggctttatagaatgagttagggaggagttcctcctcctcaattttttggagtagttacagtatgattagtgccaggtcttttttgtacatcttgtagaatttggctgtgaatccatctggtctggggcttctttttggtggtaagttttttattgctgattgaatattggaacttgataccattctgttcaaggtttcaatttcttcctgattcaatcttggaaggttgcgtgtttccaggaatttattcatttcctctagattttctagtttgtgtgtacataggtgttcataatagtctctgagaatcatttgtattcctgtggaatcagttgtagtcacctttgccattttttattgtgcttatttggactttcttgttttcacagttaatctaaagagcaatctatcaatcttgtttattctttcaaacgcctacttctggttgctttgattctttgtgtggatatttgggtctcaatttcattcagttcttttctgacttaagtgattcctgctagctttgggatttgtttgttcttatttttctagttcccctaagttcaatgttagatcattaatttgagatcttgctaacttctttttattattattacactctaagttctggggtacatgtgcagaacatgcagttttgttacataggtatacacttgccattgaggtttgctgcacccatcaacccatcacctacattaggtactcctcctaacgttatccctcccctagcccgccacccactgacaggctctggtgtgtgatgttcccctcggtaagtgtttggcactataaactttcctcttaacactacttatgctgtatcctagatatttttggtatgttgtgtctctattttcatttatttgaaaggttttttttgtttcttttgtttttgttttcttgatggagtctcactctgttgcccaggctagagtacagtgttgcaatctcagctcactgcaacctttccctcccaggttcaagcgattctctgcctcagcctcccaagtagctgggattacaggtgcccaccaccacgcttggctaattttttgtattttactagagatggggtttcaccatcttggccaggctggtcttgaactcctgaccttgtgatccacccacctcagcctcccaaagtgctgggattatagccgtgagacaccactcccagccttgacagtatttgtttatttctgccttaattttattgtttacacaaaattcattcaaaagcaagttgtttaatttccatgtaactttgtggttttgagagattttcttggtaatgatttctatttttattccactgtggtctgagattatagttggtatgacttcagtgtttttattttattgagactgctttatggccaagcatgtggtctatcttggagtattttccatgtgcaattgagaatatacattctatggttgatgggtaaagtattcagtagatgtctatcagctccaattggtcaagtgttgaatttaagtccagaatttctttgttagctttctgcctcaatgagctttctaaggctgtcagtcagttgttgaaatccctcagtattattgtgtgactgtctacatttcctaacaggtctagaagtactttatgaatacaggtcctccaatgttggatgtgtatatatttaagactgttaagtcttcttgttgaatttaaccctttatcattatgtaatatccttctttgtccttttttactgttgttggtttaatgtctgtttcatctaatataagaatacttatccctgctctttgttgtgttctttgtgcataatagatttttctccaaccctttattttgatattatggatgtcattatgtgtgagataggtctcttgaagacagcagatggatgggtcttgcttttttatccaagttgccactctgccatttaagtgggatgtttagaacatttacattttaatattgatatgtgaggttttgatgctatcatgaagttgttgactggttgctttgtagtttctactgtttggttgctttattgggtctgtgggctatgtacataagtgtctttttgtggtagcaggtattgttttatcattttcaagatttattgtaaagttggtctagtggtaaattcccttggtacttgcttgtctgaaaaaatattttatttctctttcatttataaagcttagtttggtgaaatatgaaattcttgattggacttccttgtctttaagaaggccgaaaataggccctgatctcttctggctcgtaaggtttctgctgagaccactgttagcccaatagagttccttttgtacatgatctgaccttttactctggttacatttaattttttttctttagcactggatttggacagtctggtgaccatatgccttagggatgttagttttgtatagtatttcataggtgttctctggatttcttatacttggatatctacctctctaggaaggttagaaaaattttcttaaatttttcattcaaatatcttttacaggttgttttctttctctacctcctctcagaaacaccaataatttgtatgtttgtatgctttacaagatcccatatttctcaaatgttttgttcatttattttaattctttttctttattgttaactcactggattagttcaaaaacccagttttcaatctctgaaagtccttcttcttggtaaagctacttataaagttttcaatcatattttgaaatttcttaggtgaggttttcaattccagaagctctaattgatttctttttaagatgtttatctctcccttcatttcccatattgctttagaagatttctttgtgttgattttcaaccttgacttggatcttgttgagcttccttgcaatccacgttttacattctttatctgtcatttgtgagtttccattttgattatggaccattgctggagagttagtgagaccctttggtggtgtcactacattcggatttttcatggtgtcagaattcttgtgctagttccttatcatttggagatgctggcaattctaatttttatagttattttcatgtgggtaggattttttctttttctctataatactgttgttttgtttcttctttccctgtctctttaccctcttccctagagtgtgtgactgaagaaaatgatgggtaaggtcttttgtctttgaccctatagcactatgcacttctgttggtagatttttttactggggtatgcaatttgacctataagtcagtagatggcgcttatgggtaagagccggctatggccaataaggcagggtatatgcttgatccttgtttactggtaaaagctgtctgttgccccagggaatgggctgactcctggaaagcacagcagtccaagctccctcctcagccctggaaggagacggtagaggggaagggcaagatggacaaatacacctacaggtcccctgatggcaggcacatgcacaagtgctaagagacagtccagtgggcagccaccaagtacccagaggtataggtaggcatgaaactgggaaacctccttagccctgagttccctgcctggagatggcagggggcagcctagacttctaatcctggaaagtggacactccagatggctgtaggtctgcctgggcatggagcagagaggaccatcctgcaccaggatctctctgcataggaagtgtgaagcagctcaggctgctgttccaggtgagcaggtgctccaaatgcttggaaatctgcctgggtgtggagtggagatggtgtccctgcaccaacatctctgaacaaaaagagtggggcaattatgcctgcagaaccaggcaaatgagggcttccaatgcatggagatctgcctgagcatgaggcagagagggcacccccatacccagatctctgcacagaaagatgcggtgactcaggctgttagtctatgctagcagttgctcctaattcttggagatctgcttatgtatagagcaaagagggctccactgcactacgatctatgcacaggaaaagtggggtggcttaggctgctgatcaaggtgaagggatgctcaaaaagcctggagatctgcctggctctggaacagagaagaccctgctgcacaaaaatctcaggggaacaggctggggcacccagcaatggcacatgcagaccagatccaggttgtcaagctggccctggctgcaggtctcatcattcagaagaactgtgattgggggagggcacaattccagtgccaactgttgaggcactttccaaagttctggctgtggtgacccctaccctgctccaaagcaagcagttcaattgctggcccaagactaaaatgcctacatgtccatcatgccagctcaccacagaatggctgattttatatgaactcaggttaaaaattgtgtgctgttctcagtcccacatctagggaaatgcttgcagctctttctggtatctttccctcacagcatctctaagcctctccctaagttacctccaggacctgggagaaacagagcgttcttccttgacctgggttgctcacatacccagtggaaaagtgtgtcacagagggaggttctctgcttctctcacatactggggcttcactcacttttatcagccagtctctgtcatgtggctgtttgcccacattttcccccaccaggatctgggatgtccttcatgattccagtggattcccatttttcttcctgaattaaagttcacagagttggtctttatgcactatcttgctatttccaagtgcctgaagcacactaaaagcctctaatccaccttcttctaaattttttctttgaggggagaaaagaagactgtagtgtaccactccatatatcaacaagaatagtgaatgaaggaaaaagtggcagagattatctaaatgcagtatataaaatatgtatgtgtgaatgtgtatatctgcatatataagtgtgtataaatatagtttgagaccactcaggcctattttttatttttactttttaaaaaagaactacaaagcaccatcactgtctgtggcaggtccattatatatgcctgcccagcttcccttcctcttcttgtgacaaccacaccttatgcctctttcggagggcaacccctgctgagtctcagcagctctgatgagctgttagttactgtgccttggtaactcaatccaagattgtacaatcagaatctgactcctgagaatttaaatctagataagggccatacgaaatagctggaacctaaccattccaatttcccaggaactatgttttgattgtgagtcctctcactatcccagttcttgctcttgaagcttggttgcttaagtttgccttcaatttctgttaattacctaatatgtttctagtatatttcattatttcatgatgttatccagatagcatttctcttgccagcaaccaaaaaactccaactgataagagagacacattttgagaacacaccttgtttcggtacactatttgtagggcactgtttctcaatgagcatttaaagcactataaaaatcccaccactgcatccatgaaaccctttcagattgtcataaaatcaagagccactcttgtgtttatcctgttagcctaacaaaaccctccacaggctatctgtctattttctaactaaaggtttgaaatctcctgttatgaatatccagtacacagtcaaatgtccttttttgacttgcatatttaacgccttattgcctgtttactgctttacatttatgctgatttattaagtcacatatgcctctattaacatcaagtatgtcatttttaccttagaatatatgcaagtaaaatgcataataacatggactgtgcaaaattatcattcaccataacaataatatgcatagttacatgcacaattcaaaaccacatctctgaagggcaataaacaaacacatgcacattgtaaaatattcataagtcattaaagtaaaacatagaagtccccctaaacacacatttccactgaccctgcaaatctcctctctataaattacagctaacagttggggtgttacatttgtctcagtacctcagcaatgactcactcatagcaatagttctttagaggcctataagcagactgaatggaagagttaaaatgggttagtggttaaaatctcccaccaataacctaaaaaattgagagttatttttatcttacttttctaagatatttttcaaggtaattggagaaaacaatgagtatggtcatattttacattaggaagatgagtcaaaaaaggatttaaatgagtttctgatttaaatacgtttcatttccttaataagtttttccaagaaaaagaagagttagagaaaagaatttgaattttcgaaggaatgtttttacaaatatcatctggctgattcaatcataaacaagagtaatttcataataccaatattgaatcagtcatagctattcattattacattctataagaatttcttaggaggaatactattttggcataatttgagttaacaaaaaatacgtactgtataatttttttaccaagttaaatatgagccaagacttgatctacactatagaccaaatggatctaataaatatttacagaacatttcatccaagagctgtagaatacacattcttttactatgcccatggatagaccatatgttaggtcaaaaagcaagttttaaacattcaaaaaaattgaaataatatcaagcatcttctctaaccacaatggaataaaactagaaattaataacaagtggaattctagaaattatacaaatacatagaaactaaacaatatgctcctgaatgaccagtgggtcaataaagaaattgagaaggaaattgaaaaatttcttgaaacaaatgataatggaaacatgacgtattaaaacctttgagatacacaaaagcagaactaagagggaaatttatagctataagtgtctacatcaaaaaagagaaaaaattttaaataaacaatctaatgatgcatcttaaagaactagaaatgcaagagcaaagcaaacccaaaattagtagaagaaaaaaaaaataaaggtcggaccagaaataaatgaaattgaaatttaaaagaaaaaatacaaaagatcaacgaaacaaaaaattgggtttttgaaaagtcaaacaaaatgaatgaatctttagccaaactaagaagagaggagatccaaataaataaaatcagaaatgaaaaacagacattacaacaaatagtgcagaaattcaaaggatcattaatggctgccatgagcaactatgtgccaataaattggaaaaactagaaaaatgggcaaattcctagatacatacaacctaccaagattgaaccacgaagaaatccaaaatctgaacaaaccaataacaagtaacaagattgaagccataatgaaaactctcccagtaaagaaaagcccaggacctgatggctttactgatgaattctaccaaccatttaaagaactaataccaatccttttcaaactattctgaaaaatggaggaggagcaaatatttccaaactcatactacgaggctgctattaacctgttaccaaaaccagacaaagacacattaaaaaaaaaaaactacaggtgagtatgtctgatggatactgacacaaaaatcctcaaaaaactactagcaaaccaaattcaacaatacattagaaaggtcattcatcatgaccaagtgggagttatccctgggattcaaggatggttcaacatatgcaaatcaatcagcgtgatacatcatatcaacaggatgaagaataaaaaccatatgatcatttcaattgatgctggaaaagcatttgataaaattcaatgtcccttcatgataaaaaaaaaaaaactctcaaaaagatcaggtaaagaaggaacatgcctcaacataataaaagcaaaatatgacagacccacagctagtatcatattaaatgaggaaaaactgaaactctttcctctaagatctggaaaatgaaaaggctgcccactgtcaccactgttactcaacatagtactaaaagtcctagcttgagcaatcagacaagagaatgatataaagggcatccaaattggaaagaaaaaagtcaaattacccttgtttgcagatgatatgatgttatatttggaaaaacctaaacactccaccaaaaaactattagaaatgataaacaaattcagtaaagttgcaggatacaaaaataacgtataaaaattagtagcatttctatatgccaacagtgaacaatctgaaaaggaaataaaaaagtaatgccatttacaatagccacacataaaattaaataggaattaaccaaagaaataaaagatctctataatgaaaactataaaacactgatgaaataaattgaagaggacaccaaaacataaaaaaatgccatgttcatggatttgaagaatcaatattgttaaaatgtccatactacccaaagcaatctataggttcaatgtaacccctagcaaaataccaatagatgttattcacagaaatagaaaaatcaatcctaaaatttatgtggaaccacaaaagacctggaatagccaaagctatccttaagccaaaaaaaaaaaaaaaaaaaaaaaaactggaggaatcacattatctgacttcaaattacactacagagctgtgataaacaaaacagcatgatactggtataaaatcagatatacagaccaatggaacagaatagagaacccagaaacaaatccatacacacacagtgaactcattttctacaaaagtgccaagaacatacaatggggaaaagacagtctcttcaataaatggtgctgggaaaactgaatatccatatgcagaagaataaaagtagatccctatgtctctccatatgcaaaaatcaaatcaaaatagattaaagacttaaatctcagagctcaaattatgaaactattacaaggaaagattggagaaaatctccaggatattgatctggacaaaaaattcttgatcaatatcccacaagcacaagcaaccaaagcaaaaatggacaaatgggatcacatcaacttaaaaagcttctgcacagcaaagtgaaaagatgactcacagaatgggagaaaacatctgcaaactgcccatctgacaagagattaataactagaatatatgaggagctcaaacaactctacaggggaaaaaaatctaataacctgatccaaaattagggaaaagatttgaatagacatttctcaaaagaagacagacaaatggcaaacggacatacgaaaacgtgctcaacatcactgatcatcagagaaatgcaaattaaaactacaatgcgatattatctcacctcagttaaaatgacttatacccaaatggcagtaacaaatgctagtgaggatgtggagaaaagggtactgttgcacactgttaatgagaatgtaaattagtataaccacaatggagaacagtttggaggtttctcaaaaaactaaaaatagagctaccatatgacccagcaatcctacagctgggtatatacccaaaagaaaggctatcagtatatcagagagatatctgcactattaggtttgctgcagtactgtttacaataactaatatttaaaagcaacctaagtgcccatcaacagatgaatgaataaagaaaatgtggtacatacacacaatggagtactattcagttataaaaaagaacgagagcttgtcatttgcaacaacatggatgcaactggagatcattatgttaagtgaaataagccaggaacagaaagacaaacatcatatgttctcacttatttgtagactctaaaaatcaaaacaattgaactcatagatgtagagagtagaaggatggttaccagaggctgggaagggtagtgggagggttgtggggagttggatcagtaaatgggtataaaaaataagtagaaagaataaataagacctggttgggtgcactggctcacacttgtaatccctgcactttgggaggccgcggtggacagatcttgaggtgggtggatcacttgaggtcaggagttcaagaccagcctggccaatatggtgaaaccctgtctctactaaaaatacaaaaactagccagggatggtggcatgtgcctgtagtcccagctactcgggaggctgaggcagaagaatcgcttgaacccaggaggcagaggttgcagtcagccaagagggcaccactgcactccagcctgggcaacagagcaagactccgtctcaaaaataaatgaataaataaataaataagacttactatttgatagcatagcacaacaaggtgactatagtcaataactaaattgtatattttaacataactgaaagagtacaactggattatttgtaactcaaaggataaatgcttgaagggatggagaacccattttctataatgtgcttatttcaccttgcatgcctgtatcaaaacatctcatgccccccgtaaatatatacacctactatgtacccacaaaaattaaaagtataaataaaaaaataagcttgaccctaaaatttacattcattttttctaagagcatgctattcttgaagttttgtttccttggctcagccacttctttttgtctcttctggcttctcctcctgctctccaaaaagtgggtattcttttcacgtgtggaggcagagggtacataggaaatttctgcatccccaatcagcctaaaaatgctcttaaaaatacatcttcaagacatcatacttcagctctcctctccaaacactccttaattctatctattgtctcagcttcagttacctcctttaaaagttccatgtcttccaaattcctgtccctagccatgtactgtctctggagagtacccacgactcccatctcctgtcttctaaacatctctgcctgcacatcctgttgacagttcacatgcaatgtgtcttagataaaatttatgttttctactttacctattctatttcccatatttcttggtcatgccagctcaaaactttccaactcatctttgatcccttacacacactcctttcttccctcttcattcacagcagttggcatatcttaggaattccactcaataatgttataccatctttcccttttcaatgaccacagctactgttctacttcctctttatactgtctattatctagctattgcagtagcctccaaactactgcccaccactgtctttccacttccgtttcactccccaccatctaacggattaaccttcttgagtaaaattctgatcagaagactcttgtttattgacactccaaagctcttttcatgttctatgatgaagccaaattaatgtttgaacttccttctttccccatacttgtcacatccatatgtttactttcagattttccttcatttggacactagcattccctctttcctgtctctgtatgcttaaatcttaaatattcttttcttttttcctgcagtttttttacataaatatattgcataatggtaaggtttgggcttccagtgtacccatcacccacatagagaacattgtacccaacaggtaatttttaaaccctcactcctctcccatccttcctctttttagagtccccagtgtctgttattagggtaaacatgtgtatccattgtttagctcctatttataagcgagaatatgcagtatttggttttctatttctgagttatttcactgaggataaatattatttaagaccttcctcttaaaagtcttccttgacttctaagatgagagtaatcattctattctgtcctctgaattttcatctctctccttcttcctcaccccctctccttctctctctctctctcagtaacgcctctcaatttaattggtgtaacagttatttctataatcactatgttgtcaccaggccttacccatctatgggcactgatgggtccccttaatagtaataaattcaatgtcaccaactcttgaacctgctgatacaggattactaggcccatacaagttacaagtacttctaggaggcttcaagacatgtttcccatgtattggtgaataaggcttctctcactacagtttttatttagatgctcacctttgtttgcatggggctcagacatgaatctattgagggtgggagtattataaaaccatgaaaaacaaacattatcatcagaattgctctgtctcaatgtccaagaccaaatcaagctaagaatagctggctcttcttttctgaggaaaactctctcgcagaagttttgttagatttttatccagctaggcttctctgagctcactcagcccatctaccagctttgccacgtacctgcctattcttctgcctagactcatcctgtagttagtattcactaccgactggatggtaaactttttgagagtaagccccatgtttaagtaatatatatcctcaccaaaacatttaacatagcttcttacacacagacaaacctcaagggtaaaactaaaataaaatttaaaaagtaatccaaattaatgattacttaacagcatttaaaaattaactccaatatttacaatcttttttccttttttttaattattattatactttaagttttagggtacatgtgcacaatgtgcaggttagttacatatgtatacatgtgccatgctggtgtgctgcacccattaactcgtcatgtagcattaggtatatctcctaatactatccctccccgctacccccaccccacaacagtccccagagtgtaatattccccttcctgtgtccatgtgttctcattgttcaatgcccatctatgaatgagaacatgcggtgtttggttttttgtccttgcgatagtttgctgagaatgatgatttccaatttcatccatgtccctacaaaggacatgaactgatccttttttatggctgcatagcattccatggtgtatatgtgccacattttcttaatccactctatcattgttggacatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccttgaggaatcgccacactgacttccacaatggttgaactagtttacagtcctaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttgtttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttagttagatcccatttgtcaattttggcttttgttgccattgcttttggtgttttagacatgaagtccttgtgcatgcctatgtcctgaatggtactgcctaggttttcttctagggtttttatggttttaggtctaacatgtaaatctttaatccatcttgaattaatttttgtataaggtgtaaggaagggatccagttccagctttctacatatggctacccagttttcccagcaccatttattaaatggggaatcctttccccattgcttgtttttctcaggtttgtctaagatcagatagttgtagatatgcagcattatttctgagggctctgttctgttccattgttctatatctctgttttggtaccagtaccatgctgttttggttactgtggccttgtagtatagtttcaagtcaggtagcgtgatgcctccagcttcgttcttttagcttaggattgacttggcaatgcgggctcttttttgttccatatgaactttcaagtagttttttccaattctgtgaagaaagtcattggtaacttgatggggatggcaccaaatctataaattaccttgggcagtatggccattctcaggatattgattcttcctaaccatgagcatggaatgttcttccatttgtctgtatccttttttatttcattgagcagtggtttgtcgttctccttgaagaggtccttcatgtcccttgtaagttggattcctaagtattttattctctttgaaggaattttgaatgggagttcactcatgatttggctctctgctagtccgttattggtgtataagaatgcttgtgatttttgtacattgattttgtatcctgacactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactctgttgaataggagtggtgagagagggcatccctgtcttgtgccagttttcaaagggaatgcttccagtttttgcccattcagtatgatattagctgtgagtttgcatagatagctcttaatattttgagatacatcccatcaatacctaatttattgagagtttttagcatgaagggctgttgaattttgtcaaaggccttttctgcatctattgagataatcatgtggtttttgtctttggttctgtttatatggtggattacatttattgatttgcatatattgaaccagccttgcatcccagggatgaagcccacttgatcatggtggataagctttttgatgtgctgctggattcggtttgccagtattttattgaggagatttgcatcaatgttcatcaaggatattggtctaaaattctcttttttggttgtgtctctgccaggctttggtatcaggatgatgctggcctcataaaatgagttagggaggattccctctttttctattgattggaatagtttcagaaagaatggtaccagttcctccttgtacctctggtagaattcggctgtgaatccatctggtcctggactctttttggttagtaagctattgattattgccacaatttcagagcctgttattggtctattcagagattcaacttcttcctggtttagtcttgggagggtgtatgtgtcaaggaatttatccatttcttctagattttctactttatttgcatagaggtgtttgtagtattctctgatgttagtttgtatttctgtgggatcggtggtgatatcccctttatcattttttattgcgtctatttgattcttctctctttttttctttattagtcttgctagtggtctatcaattttgttgatcctttcaaaaaaccagctcctggattcattgattttttgaagggttttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgcgtctttgttctcgttggtttcaaagaatatctttatttctgccttcatttcattatatacccagtagtcattcaggaacaggttgttcagtttccatgtagttgagcggttttgagtgagtttcttaatcctgagttctagtttgattgcactgtggtctgagagacagtttgttataatttctgttcttttacatttgctgaggagacctttacttccaagtatgtggtcaattttggaataggtgtggtatggtgctgaaaaaaatgtatattctgttgatatggggtggagagttctgtagatgtctattaggtacacttggtgcagagctgagttcaattcctgggtatccttcttaactttctgtctcgtagatctgtctaatgttgacagcggggtgttaaagtctcccatttttattgtgtgggagtctaagtctctttgtaggtcactcaggacttgctttatgaatctgggtgctcctgtattgggtgcatatatatttaggatagttagctcttcttgttgaattgatccctttaccattatgtaatagccttctttgtctcttttgatctttgttggtttaaagtctgttttatcacggactaggattgcaacccctgcttttttttgttttccatttgcttggcagatcttcctctatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgcttattttgctcattagttgacgcagtttcttcctagtctcaatggtctttacattttggcatgattttgcagcggctggtaccagttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgcaaattcttttctttaagaatgttgaatattggcccccactctcttctggcttgtagagtttctgccgagagatccgctgttagtctgatgggcttccctttgtgggtaacctgacatttctctctgcctgcccttaacattttttccttcatttcaactttggtgaatctgacaattatgtgtcttggagttgctcttctcgaggagtatctttgtggtgttctctgtatttcctgaatctgaatgttggcctgccttgctggattggggaagttctcctggataatatcctgcagagtgttttccaacttggttccattctccccatcactttcaggtacacaaatcagacatagatttggtcttttcacatagtcccatatttcttggaggctttgttcatttctttttattcttttttctctaaacttcccttctcgcttcatttgattcatttcatcttccgtcactgataccctttcttccagttgattgcatcggctcctgaggcttctgcattcttcacgtagttctcaagccttggctttcagctccatcagctcctttaagcacttctctgtattggttattctagttatacattcgtctaaatttttttcaaagttttcaacttctttgcctttggtttgaatttcttcctgtagctcggagtagtttgttcgtctgaagccttcttctctcaactcatcaaagtcattctccatccagctttgttccattgctggtgaagaactgcgttcctttggaggaggagaggcactctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccacttcagaccctgtttgcctgggtatcagcagcggtggctgcagaacagcagattttcgtgaaccacaaatgctgctgtctaatcgttcctctggaagttttgtctcagaggagtacccggccgtgtgaggtgtcagtctgcccctactggggggtgcctcccagttaggctgctcgggggtcaggggtcagggacccacttgaggaggcagtctgcttgttctcagatctccagctgcatgctgggagaaccactgctctcttcaaagctgtcagacagggacatttaagtctgcagaggttactgctgtctttttgtttgtctgtgccctgcccccagaggtggagcctacacagacaggcaggcctccttgagctgtggtgggctccacccagttggagcttcccggctgctttgtttacctaagcgagcctgggcaatggcgggcgcccctcccccagcctcgctgccgccttgcagtttgatctcagactgccgtgctagcaatcagtgagactccgtgggcgtaggaccctccaagccatgtgcgggatataatctcctggtgcgctgtttcctaagcctgtcagaaaagcacagtattcgggtgggattgacccgattttccaggtgctatctgtcacccctttccttgaccaggaaaggaaactccctgaccccttgtgcttcccgagtgaggcaatgcctccccttgcttcggctcgcgcatgatgtgctgcaccctctgtcctgtgcccactgtttggcactgcctagtgagatgaacctggtacctcagatggaaatgcagaaatcacccgtcttctgcatcgctcacgctgggagctgtagactagcgctgttcctattcggccatctgggctcctccccactttttttcttttttttttttgagacagagtctcgttcagtcacccagactggagtgtagtggcatgatcttggctcactgcaacctccacctccccggttcaagtgattctcctacttcagcctccagaatagctgatactacaggttcctgccaccacccccagctaatttttgtagttttagtagagacagggtttcaccatgttggccaggctggtctcgaactcctgacctcaagtgacccacctgcctcagctgcccaaagtgctaagattacaggcatgagccaccgtgctaggtcaatatttacaatctttatgtcaggtaatcgaggccttagcattttaagaccagttatatgcagttagctacctcttttctctacttttccaataatcacaatcccttaaaaatattaatatcagggatcttttgaaatcagtttcaaaaggtattaaaagcagtgagaattttgtttcaagctcactgagttgtttctaggattaaaaaacatataaagtatttagcatattgtgtagaatgtaatcagagctcaatgcaagtcagtttatattattttcattgtgaaagctagacttatttgaaatggttccaaaaataaatcctacaagaaacatcctcgaaagtgactatttattatattatacataaaagtaccccaaatagtgtacattacctccagcttatgttaaattctgtctttgtcaataataacctctaatttaattgaagttaatcatatctcttaattagctattcccattattataataaagagcagttaccaggaaaatctagccatagtaacccacatataaatgaatgctttcagtaagcaaataaaataatttcaacaagtttccaggccatttaactaagtactgctctacttagatcactggaataagatcagaatatctagatttctaattgaggtggctctaaaacatcccattgaaaacagagccgtatatgtcccttaaccaaacaagcaaggagaactcaagaatttcaagtaaaaacatgacagacttctataggaatgaaccttaattgagttggcaggttaaattgttggcactgatacagtgaaagaagatgaagcccaagggagggacatttcacaatcaaatcggaaatggtacatccttctcctacacacaaatccataattgaaaaaaaagactgaaaacctttcctcccaccattgaccttctgagtaggtgtggtaggacaaatttcatcctcaatattcacaacaagatcttgatctttttagcacctggtcaagtttgcaaagtcactaaataaaacctaatccaattagtttctccccagtcaacttacttttcacttccatgaaatgtgctctttccacacaatagatgaaatagcacccactacatcatcctggttacaatcctcatgagatgacagatccttgcttgttgaggacacattcacagaaagaacagttaagcgagaggaaactcagaggccaggaatagaggttacctacaaagtctacaagtcgtatcaactactgtggtgaaaaaagagtgaacctctgcaattagaccattttttatgactaactttagattaaacacagcgtgactatgcttaccatcaagtggaatatttcagtctcccacacacagtttctgttctattcaatcactacaccttgtataacagctttatacagaaataatcataaccaacaaaaaaagaacaatcttcatttttgacagtgttaaaaatgcttaaaacatttttcaaaggttataaccttataaaagttaatgcattaacttcagacagtgtttgaaaaaaggaaagaaatatctaagactgagccagtaccaaagtgagctagtttcttaacacgagcaagtgtttaacagtattgttttcagtcataaaaacataaaacatgaatcttaatcccacaagaaagaaaataatagacttatttttagactagtctcttctatcaaaataaatggaagaaataatgtctgaaattaataacctaaattttaactttataagagtcttagatattacccaataatttctcatatcaccaagttaataaattactattccaaaggtaaatataaaaaaaagaaaaagtaagaaaagcacagtgtacaatctacatttgacatgtgcattaaaacaaaaactttcaatgtccagtaaatttcgaaccaataatttccttaaacttttacaatttttacaattacatacccagagtaatatctctttgtttatttctgaaaagcataatttctaaagttccttcctgttaacacaattaacatcaaaagaacaaaatcaaaactctgaggatactgctatcctatatatttgatgggcattctattttccagtgttatgaaaacaacttaaaccaaacagtataactgtatgcaaatgtcactcaaattaaaatgaaatataaagaaatacacagaaaacttattgtctgcccagcataacatgtgaaacaatactatacattacattacattacattttaattaagattaaaaacaaagatctatatttaaaacttttccatagttttttaaataattgtatgactcatctctattgcctctgttaattcaaaaaattagtgaacttaccaatatgcaacccactcaaaatgactcattttgacatttaattatttccatgcatgaggtgaacaatatctttaacatatgacctgattataattagatcatacgaaaagatgaaaataacatgaaaatgtgacttataaatgcaagattatatgtctatttatcaaatacaatttattggtcaatgttcaatgtatgtaaattgatctacaattgttgtaacttgaatttgaccctattggggaaaaaataactaatttgcctctaaagatctaatttttattcttttctattgttaggaaactaaaactatgtaacctaatgtatttcccttttaggttttaactgccaaaaactttagagcaatccttatttcccaagtgtttaattttgtttagctcatatacttgaaaagattacttttagcttcctttgttctgatccctccttaaattacttagctggcattgtgctgacatgtggtctcctgaagtcctttcaggaataactaaaaaggagagccttcaacaaaaagacaaagagaagaattatgggaagggaggaagacaggtaggagaaaggtaggaaggtatgcaagtacctgtacacacttgatactcggaattgtcatacattgctgtttctttctgcaaacaacactagatattttctaaatacacacatgttgggaatggtctataattttcaaagttgaggcaataacagtgctatataagtatatataacaaactgagtacagctaaaaataataataatatcattgaatctttttaatgtcctaggcactatactaagtgtttaatcacttattgctcacagtaacccatgaatcatgctttattattattattaattattattaagttactattattatcaccattttactaatgaggaaacagagacttagaatgattttatagccggtatgtggtaaagctgagattcagactaactccggagtctgttcccttaaccagtagcctctcttcactgatattaaataaaatcttcattgttagtttagtatgtattttctaaagtatataactggcatacgcttcatgaggtatatggcagccagctcaaataaaatactgaaatggataataattttatattgccaaaccaaatatttgagtcaactgaagggaagaagaaatagaactggacagaataggaagcgtccctaagacctctttgaagtactctggattcataatcaggtgctacgtaggaaaaacactagagacagcagttgtgatacctgggatccagttctttctctactgctaattagaaatgtgtgacactgattccatgattcaacttctctgggaaccagtttcttcatctataaagctataagtatgattctataacagccaaggatgctgtagttctgcaactgcaacccagatctctccattcacctgttaggtgcactcacagctccagaatggtccaagtatcacactgggaagagaaactgctccaaattattaagggtcaaaacaggtagagcctaaagaccccacttctatttagtcaggacagagaaatccttcttctatgagaaagtgctccaccacactgatataacttagaaaaaatccttgtcctcagacttttccctgaaactccaccaattattagagggacatttgaagctaaaaaataagataaaataaaatcaccactgacacaattaggacaactcagaaaacaagctagtatatagcattagacatgtaagtcatgctgtagcatggaatagtttaatcatattgatagaactgacacttaaaataaacttttaggaatacatgtgctcaccttcttttcgcctcaccctccaaagaaaaaaaatgagcaaaggcaagatgaaacgtaagtaaaactgtaaagaacacaaaatgtatggtctttgtcttttgtttctctcctcctaatgatctgttttcctaggctttgctcaaagcctttcacacccttcctgagctatgcttcttgttcacagtctccctcacctgtcctttctcccatccactcagtagccctcagaagcaagtgtattgaattacttaagtgatttgatctaagctagactcttataactaaagagtgtgatatttgcattttctagcagtggaaattccaggcaaaaattactctgaactggcgggggagagagggttatgatcctcttaaatcatccccatgtacctgtgaatagcacaaatcaaattcccccttaagaaaaacaagggggtagagaggggccaatgaggtatcacaaaagaatttaaaagtctgggattagccagcactagcccttcaagggctttacccaaagcaggaaattgctgtgctgctccatggcttccctacaccggtgcccaggcagctggccaattcactaaccccttccctggcctcttccctggccttgcacagacagcatagtcagtactaccctggccccaccgtaaccctggctggcttgagaaaagttggcagagagagtccagggttgtgctatttaaagctataagcagctactgtggatggagatgagctgctttagcagcagaggataaggccagctgtgtaagattttcactagccctaatgaaattcactcacctgctaaagttagggtacccaaatttgatagaaaacagctcagttccacttattaattactaattatcatctagctatcccatctggcaatttttttcattgttaaattgcctgattgcaaatccttaaattttcctcaaaatatactaataaatatatagaatataaatatacatataaaacagtctactaattagtaattaataaaatatactaatgaaatttatgtgtgtgtgtgtgtgtgtgtgtgtgtgtgtgtgtagagtccatgtaggtttttgctgtgtacacatcaaaatacccagaaggacttttatataaccatatacacatgcatatctttgtatacactacacacatatatagagacagaaaaaatatatacatacatatatatatatatatatatatatatatatatatatatatatatagacagagagagagagagagagagaggaatccatacatgtatctatgtttcaatccaagctgcccacactatctcaaatattaggtgaacaaggataaaataatggtcaaaagcacaggttgtgaatgcaggtatctgtgtcttcagtgaaacacaggataagataattctctggatttctaatctgtaagtggcaattgttgacaaggttaagatgattcctataaaggacagacctttgcttggaacacaatagttagtattcatcaattttaactagtgttagcattatgataaaacatccatggtaactcaaaacaacaactgtagcagtatggttttcttctaaaaatcaaacattatctcagacagccctgacaatctgaccctgtcgtctccttgtgctcttacttctcaaaatgggcttgacaggtactttatcaagggaactcctcttcatccttaaaagctcagctcaactagcatttccttacagaaaccttccttgacccttagcctaggtcagataacactgttacttatttcaaaaagcagcataccttttctttatagcatttatgccagcttattatttacttagttcagtgacttttaaaaaagtaacacctgtatttcccactctaacctcatggggcaaatactatgcctgcttttgctcattgttgcatccacagcaatgaaagtatcaggtacacagtaagtgatcaaaaatacttattgaatgaatcaatgactcagccaagttctatctagatgtccatctatttatatactcccaagaagcagcgagagtaagaatttggtcacagaaaaataaaagaatcctggaagtttcccagaggaataaaagttagaaaaaacaatacttgtcgaaaagaagtccaacaatccagaaaccaaagagacatggctttctgtacttggcttgagaaccctcctgacattccattacgaagaaactttaaaagaagcacagggttacaaggccgagctctgggtaccaagaggaaggaaggacagggattctacccagaggaagaattcatccaactaagaatcctgaaacctagagggggatagggagcagagtgtagtgtcatcaaatttatgttctgtgtcttcattcagtcagtaactcatcagagcacctaccacatgagatgtagtgcctggacttgtggatacagaagtaagcatgacagacacagtcaccactctcatggaatttccactttatttcagaggagaaacaggacattaaacaagtaatgtacatgtggccagtgctcacagaactacaagttgctgtagtaataacactgactgaaaagtcagtacatacacatattttgtatttgtccaaggaaataattccaagaatatttttatgatctctctttttttaattctctctttaaaaaaaaaaagtttccatgctaatttgtattggtttctgttgcttagcaggagtaaactaatttaagagacacactatatatctactattaggttgaactcaagtgaggatttggtcaagatgatttcaaagtagttaaaagagagtattttaaatgttctgaccacaaaggaatgataaatattggaagcaatcaatatgttgattactctgattttatcattctatggtgtatacacataagaaaatatcacttttaccccataaatatatgcaattgttgtttgtcaattaaaagtgaaaactaaaaaaaaaaaaaaaaaacagatgctgcttctccttcactagcttgtacgtgaaagtagatgagatggaaaatgagaggaaaaaagaacttatgcaaacaaaagcataaaaacactactcaggaggatggaatttatttatataaaatcttaggtacctcaaaaactttcaagttcgtaacactctctttattttatgaaagttacacaaaagggaaaactgaaaacatcaaagaaaagccctcaattcacctctcaagagtggtatttaattctccattccaaaatccataccaatcagtctgtcaatattaatttgttgagtacacactctacgccaagaattgttaaaaacccaaggaaagagttctcctcagtagacccatgccctccccaacaataaatgtacataaaaaatttaagataaacttgagatgccaataatggctaaagagaatatcaaaagcaccaatatacggtagagtaatcagggtttctgctttagctagaatggtcaggaaaatcctttctgaggaaatataatttaaattaacactcaaatgatgaatatgaacccctatttattataaaagtccagaaaagaatattcttacagaagaaaagctgatccaaaaggccagaggcaggaaaattttaaattgtttgaaagacaaaaaggccagaatggccgaatacagtaaacgaagtaaggagttgaggggaaatgacatcagggaagtatactgaaaccagttcttgtaggacagtggctctcaaaatgtagcatcatatgggaactgttagaaatgcaaactttcaggcccctctacagacttactgagtcagaaagtctgtggtggtgcccagaaatctgttttagcaaggcttccaggggattctgatgcctactaagatcagtggcctcttgaagagaacagtaattctcaacctagttatatattagaatcatttgtagaggcattcaatctacttatactgagccttacccaagaccaaatgaatctctgtatctggagatgggatctcgatatatacacatatatcaagatgctgtacaggtttgcagcctggcagcaataatatatataatattatatataatacattataatatatatataaaatattaaatattatttatatattaaataatatatattaatattaaatataatatatattaattaatatatatttatttaatatattgtatataatattaatatatgttaattaatatatgatataatttaatataatatatattatatataataatacataatatataacatataatatattatattaatatataatatataatataaattatatataatatattatatattatatataaataatatatattataaatattatataatatattatatttatatataatatataatatattatatttatatataaatataatatattatatttatatataatatataatatattatatttatatataaatataatatattatatttatatataatatgttatatataacatattatatttatatataatatgttatatataacatattatatattatgtattataatataatatatattatatattaaattatattatatattaaactaatatatatttatattatatattaaattaacatatgttattttaatatatatatattatatatattaaatatatataatatatttatattatatataatatataatatataataacatataatatataatataattatatattaaattcatatatgttaatataatatataatatatattaaattaatatataaatataatatataatatatattaaattaacatatatgaatttaatatataatatatattaaattaatatatgttaatttaatatatattatatattaaatatattaatttaatatataaatatatatttatatacaaatatatatttatatataaatatattaatttaatatatattaatttaaaatatattgatttaaatattaatttaatatatattaaatatatattaatattaaaatatatattatataatatatattattatataatatattatatataatattatatatattatataatatataatatgtataatatatattgtatcatatattatatattatatataatattatacattatatattatatatattatatattatatattatatagattatatatattatattatacattatatattatatatattatatattatatattatatagattatatataatatataatatataatattttatatgatatatattatatatgctctttagatatacatatatgctttttaggtaattatgatacacaatgtttattgcaaacactgaaatggagtcttaaaagtcatagtaaaatgtttggaatttaatgggaagccactgaaatcttgtaaacagaacattttatcaaacttagaaatgccaatgcagcttctatgtgaagaagggggcaataattggccgaaaacaccagtcaggaggtcattgtcatatccagggaaaagatgacagtggttttgtccaaagctgtaacattggagatataataagtagattcaaacatatttcatagaaaaacctaaaaatgtattatggatttgataggagatatttgagggaaaaataagaagagtctaggataataagaatctaggtttttggcctgagaaatggtgcccaacttttctttttggaggaaagcattcaggtgtgtctatcaagggttgatctttggccaggttaaatttagacagccaagtggagatgctgaattggccgcagaatatacatatgattctggagctcagaagagaagtcagagccaaacccagacacatacaaatcatcactgggtatttgaagccacagaatcagatgaggtctctaggttgagagtagacatgcaggagagggttgggtaaagcacagagctggtgtaggaacagggtacgtggctggctcatgggagcccaagaagagtgatggtcctcaggctgttgaagcgcaggacaactgaagatcttaggctttctctgttgccttgtggcacagttctacccagttcatggaggcaaaatggctttagaaactcacaagcatttcttaatgactactggccaccaaataacagcaccaatatccacttcaaaggtccgcattataccaggcaatctttccctgaaccaaatgaggaaaccaaggatcagacacattaggtggcttgtctaagttcacacagtttctgtatgctgccagaacatagcctggggagatggcactcatgtgtgcctacaaagaacacatagcttccaagaaaggggactaaaagagggagttaaagttgtgcaaagttaatccaatctgggactgacaggtactgagtcaaactggcagggattatgactgagcattgggaaagggccagacagtattacagacaaaaaaaaaaaaaagttgaaatttcctaccagaaaaaggaagtcagctagaaaaaaccagtatccagtaccattgcacacatacaagaaacagacagtagagttttagggtctgtcagtaactgagagcatgacagaaatgcaaactttcagtcccatctgcagacctactaaatcagaaactctgaggtggaacccagaagtctgttttaataaaccctccaggagatcctgatgcccactaaggtcagaagccccttagggaaaacaatgattttcagccctattgcatattcctcaaatgcaacacaggaggactttccagggaaatggaaatcatcaatagagctggcacaacactcctatcttgaagaaacttggtgcttccctaacagtccatctaagggacagttccttctgctcttaataatttaatatgcacacacacacacacacacacacacacacgtataactttatatatatctatctttacactagttaattataatacagtcatgtgttgcttaatgactaggatatgttctgagaaatgcattaggtgatttcatcactacgtgaacatgatatggtatacttacacaaccgtacatagtgtatcctactacatacctactacatacctaggctgtatggcacaacatattgctcccaggctgcaaacctacacagcatgctactacactgaatattataggaaactgtcataacataggaagtatttgtgtatctaaacatatgtgaacatagaaaagaaatggtaaaaatacggtataaaagatttaaaatggtacacatatatagggcactatatggagcttgcaggactggaagttgttctgggcaagtcagtgagtggtaagtaaaagtaaaggtctaagacattattgtaggctcctgtgtaagcaccacacttaggctacactaaatttattttaaaaatatttttctttctccaataataaattaaccttagctgactgtaacttgttactttataaacttataattttaaaaaatgattattttataattatacttagcttaaaacacaaacacattgtacatctgtataaaaatatattttctttatatacctattctataaggcttgtctaattttaaattaaaaaaattgtttttggtttttaaacttttttgttaaaaatgaagacacgaacatacacattaccttaggcctacacagagtcagattcatcaataaaactgtcttccaatttcacatcttatcccactggaaggtcttcagaggcaataacatgcacggagctgtcatctcctgttataacaatgccttcttctggaacacctcctgaaggaactgcctgaggctgttttacagcagctttttttttctaataacagaagtacactctaaagtaatgattaaaaagtgtagaacagtaaataaactagtaacaaagtcatttattatcatcaagtacataattgcaggtgctatacttttgatgtgactggcagcgcagtacatttatatgtatacacatatgcacatatgtatatatacatatatatgtatatgcacatatgtatatatacatatatatgtatatgcacatatatgcacacatgtatatatacttttttctttacactggttatttccacatctcattaggagacaagctgaaacatcttccaaagctgtaatagcagttaggtcctctgaagccttcaagtacacagagcttattcagaattagaggattaaaaaatacattttaaaaagtagaaaaagtgctattataaagtaactatatctcagcatttgaaatagtaaacatttatacatgcaatttcttttgcaggccataattaatgagtaatagttaatttggtgctttgatctcttcctcggccagaaggacactgtccataaaaacaaattagaagacaaatttagatattgtcatagaacatcacagtccccggctgggtgcaggggctcacgcctgtaatcccagcagtttgggaggccaaggtgggtggatcgcgaggtcgagagatcgagaccatcctggctaacacggtgaaaacccgtctctactaaaaatacaaaaaattagccgggcgtggtggcgggtgcctgcagtccaagctactcaggaggctgaggcaggagaatggcgtgaacccgggtggcggagtttgcagtgagctgagattgcgccactgcactccagcatgggcgacagagcgagactccgtctcaaaaaaaaaaaagaaaaaaggaacatcacagtcccagaaggaacctcaaaaacttaatagttaatgatttcctaattctagctccctagatcttaagggaccagtggaagcaataatgaagatctgagaatgaatgtcattgtttcataagactggacaaaatggtacaggtctatgaataagttgttttattggaaaagggaatcaaccagtgtagaggaagagtaatttgtactcatagtgaactttgaccagaaattttgtatgtttttattttattaaaaagtagaaaaagtgatcactatacagtttggtttacaaaccattttaaataacgttccacaaatggaacaaaaagaatcactgacctaattcaaactcctggtttttaagtatggaaaaaagtagcaacatagtgccatgaatacagcccatatttcaaacattctcatagatgaacatgttcctaattttttttccaagcataacatataaaaagagatccctttctgaaaattttagatcaatggttagggtctaggaccaaaatggctcaaagagtctagaaaaatatggctcacagtgaaccaatatggctcaatattagtgtctagaaccaatatgccacaaagtcttctctcatttttatatgctaagtctaggtgtgacaccacaattgaagccaaggctggaagtgaggtgcagctgaccaaatagagatctcatggtgacttattttatctggacccacatcactatgcttggtctgctttcttgtccaggcagccagttaataccattctcagagccaggtatgcaaaataaaggactgtaagaagccaggaagtaaagtgtaaaatattggtacaccctaagcaaagtcaaatatcctgcaagcccaaaggaagtattaccccaagagtccaatcactatgttaaaggcatcctgtttcactgataatgctaaatgaaatgtttcccattgtgtttgggttgctaacatttgtaaattctctcattaactactgttcttcattttctctcaggcttcgtacgatcagctcagaagttgactttaagactggatcccattaggttaatgagacaccccagcatctaacagtacagtcctctcaatctataaatatcttctacttttagagacatcaccagacagaagtagaccttccagaagtctcctacattttaaattgaggttggaaagttttatcagctagtcagaaccccaaagacctactttgataatgctattcaagtctaaaaactacattttctggtaattggagctagacacccctatgccacttctttcttcattcctttcaattgcctccacagaggggcagaaaacacccactccttgctggatgcttgtttttatcaaagactctagaccagaaaccacaaaaaaagatataaggtagcatattaaacaccatcacttaaaaaaaaagacagcaaaagaatgaggttgggaagattctgaacaacagtataaactatctgatgccataaaaccctttaccttctatcccaaatacatctcatcctgagattcctaacttaaaatatttgaccaaaacaaaaagcctgagacaaatgttaaaattgtgacttacgccaggttaattctattccagctagggtttgaactacatcacaccactgaaggaactgtttcctacagcagaggtcattttctatatggttatttgtgacatagtgcactacatggtggtcaattgtgtaaaacctcattatcgtaatgacaacagcaataagaagtctatcatggttattatatttttgtctcaactccgaagattcaaataagtggaacaataactttctatatggtagagttatatataaataagatggaaagtaatgggttttttatctttagaactcttcaggagagcagagattagagtaaccctcagggaagatgatgttaaaggagccatacatgacgtagaaaaggttatcttaaaattacaaggattttcaccaaggttctaattttgtggaagactatattttccacaaactggctcacaggccgaattgggttactgcagcgtattttattttgcaaacttaaccatcattattattaatcacaaaatgctaaaacaaatcattgtaaatggaaaaagaagaggatttcagtaacattgatttcctaagggccaggctgtgtggaagatgcattaatgctcttggtaatgccctaatctgataagcattacttccccattttactgaaggaaagagaccttagcaaggttaaataacttgctcaaggtcatgaggctggtaagtgatagaactggaactagagtccaagtttgtctaattctaaaacaacactgtgatcaatcccaacatgagtcctttcctttgaccattttacaaaaggcttgacttctgtcatcaacggtacttacttttttaaaaaactgaactctcccaaagtatcataactcagaataatttggccactattcgttttcattcatgcttattgattattcccactaaaaaaacccaaatttaatatattccaaacattttataaaattaaaatgtaacaggtaatattgtaaaaaggtgatagaataggaagcaccaagaatttccccactaaggcaacaatcatactggcagaatctgtctgatgataggattttggaactctgtagtctactgaaggcttaccacttccaggggaagactcaaataataaattacagttaattttagtcaacttcagctcttagcacagtagcagttaccagtaccccaaccctcagccctgtggcaggcagctgtgcacatattcctagagcagcttgcataaaacctgcaggagcaaatgtgggcaaaaagggccttgttctccaaatatctgggatccatgccctgatcactgatgcttctgatcatggagatttagacaaagagtgatagccttttttgttactccctccattgttgcaaatccctcctcatctgactgaaatgatttttagggaatttatagagatagctttttttttcatttttctctttttctccttttgtgaaccagagattgaatactaggatagtcaaaagcaactacatatacaagaaaaatttgaaagtcattgtgcatgcccagggaaaggcacaggctcagaaaagacctgagaagaccttaagtttacagttcagcctaatcttcagaaaagaggcagcctacaacaactacaaacaaataaacaacaacaacaacaacaaagcaaacagcaagcactgaggaatgggaggaaatctgatttccagagatacaacactattaggttcagaagctcaatttaaaaccaaatatcacaaggagcacaaaggaacagaaaagtatggtccattcaaaggaaaagaaaaaaacaatagatacggttcctaaacaagacctagtggcagtattagcagatctaccagacaaatactttaaaacaagtgtcttaaagatgtttaaagaattaagacacacatggagaaagtcaagaaagagatataggtaaagaaatgaaaatatcaagaaagacataaattctaaaaagaaaccaaaaagaaagtctggagttgaaaaggaaactaactgtactggaaaattcactagaggaattcaaaggcagatttgagcaggcagaaaaattagtaaacttgaagggaggaccacggaaataccaagtctgagaaagaaaaaagattgaagaaaagtgaacagaggctaaaggacctgtggaacaccattaagcagaccaacatagatattgtgggagatccagaaacagcagagaaaaaggaagaagcagagaaaacatctaaagaaataatagatggaaaattgccaaatttgatgaaagacataagtataaacatctaagaagctcaataaacttcaagtagcatgaattcaaagagactcataccaaaatacattgtaattaaattgctgaaagacaaagacaaagagaatttttaaagaaggaagagagaagtgattcatcacattacaagggatcctcaagacaatcagcagatttctcatcagaaacttttagattccagaggcagtggactgatatattcagaataacaagagaaaaaaaaaaggtacaccaaggtatggcaaaaaatcccttcaaaattgagggagaagttaagacatttctagataaatacaggctgaaggagttcattaccactacaccttctgcaataaatgccaaagacttttttttggcagaagttgaaaaacccatcttaaattcatatggtatctcaagggaacccaaatcaccaaaacaaacctgagaaaaaaagaagcataaagctggaggactcacacttcctgataacaaaacttactacaaagctacagtaatcaaaataaagttatattagcctaaagataaacatatgcagcagtggaatagaatagaaagtccagaaataaattgttgcatatatggtcaaatgatttcagaaaggggtgccaagaccattcaattgagaaaagacagtcttttcaacaaatggagcttggaaaacttgatatccacatgcccaaagcataaagctggatccttacctaacaccatatacaaaaattaatacaaaatggatcaaagacctaaatataagacataaaactaaaaactcttgttaaaaaatatatatatagggcaaaagcttcacaacattgaattttgcaatagatttcacatcaaaggcacaggaaacaaaagaaaaaataaattggacttcatgaaaataaaaagatttttgtgtatcaaaagacgctattaacagagtaaaaaggcaacacacagaatggaagagaacacttgcaaaccatatatctgataagagattaatatccagaatatataaactcctaaaactcaacaaaaaacaaccaccagattcaaaaatgagcaaatgacttcagtagacatttctccaaagaaaatatacaagtggccaacaggcacacgaagagatgttcaacttcactaaccattagggaaatgcatctcaaaactataataaaacaccacccacctcccaacctttaggatggctactatcagaaaaaaaaaaaaaaaaaaaaaacagaaaataacaagtgttcacaagaatgtggaaaaaaatcaaactctgtgcactgttgatgggaatgtaaaatggtatagctacttatatggtctggctgtgtccccaccaaaatctcatcttgaactgtaattcctacaattcccatatgtcatgggaggaacctggtgggaggtgactgaattatgggggtgggtctttcctgtgctgttctcctgatagtgaattagtctcacaagatctgatggttttaaacaatgggagtttgcctgcataagctctctctttgctgccatccacttaagatgtgacttgctcctccttgccttccgccatgattgtgaggcttccccagccacatggaactgtgagtccaattaaacctctttcttttgtaaattacccagtctcagatacatctgtatcagcagcgtgaaaatggactaacacagtaaattggtaccagtagaatgaggtgctgctgaaaagatacccaaaaatgtgaaagcaactttggaactgggtagcaggcagagggtgggacagtttgaagggctcagaagacaacaggaaaatgtgagaatgtttgcaacttcctagagacttgttgaatggttttgaccaaaatgctgataatgatatggacaatgaaatccaagctgaggtggtctcagatggagatgaggaacttgttgggaactggggcaaaggtgactcttgttatgtttcagcaaagagactggcagcattttgcccctgccttagagttttgtggaactttgaacttgagagagatgatttagggtatctgctagaagaaatttctaagcagcaaagcattcaagaggcgacttggatgttgttaatcgcattcagttttataaggtaagcagagcatagaagtttggaaaatttgcagcctgacaatgcaataggaaagaaaatgtcattttctgagaagaaattcaagctcgctgcagaaatttgcataaataacaaggagccaaatgttaatccccaagactatggggaaaatgtctccagggcatctcagaggtcttcacagcagcccctaccatcacacacccggaggtctaggaggaaaacatgatttcatgggccaggcccagcgttgtcatgctgtgtgcagtctagagactcatgccctgcatcccagctgctccagccatgactaaaaggggccaagcatggcccatgacttcagagggtgcaagtcccaagccttggcagattccacttggtgttgagactgcaggtgcacagaagtcaagtactgacgtttgagaacctccaaatagatttcagaggatgtatggaaatgcctggatgtccaggcagaagtttgctgcaggagcagcactctcatggagaatctctgctagggcagtgcagaagggaaatgtcaggtgggagcccccacacagagtccctactggagtaccacctagtggagctgtgagaagagggccaccatcctccagaccccagaatgatatatccaccaacagcttgcaccacatgcctggaaaagctgcagacactcaacatcagcccatgatagcagctaggaggaaggctgtaccctgcagagccacaggggatggagctgcccaagaccatgggaacccacctcttacatcagcatgacccagatgtgagacctggagtcaaaggagatcattttggagctttaaaatttgactgccctgctggatttcgaacttgcatgggccctgtagcccctttgttttggccagtttctcccacttggaatgggtgtatttacccaatgcctgtacccacattgtatgtaggaagtaactaacttgctttgattttacaggctcataggtggaagggacttgccctgtctcagatgagactttggactgcggacttttgagcccatgctgaaataagttaagactttggggaactgttgggaaggcatgattggttttgaaatgtgaggacatgagatttggcggaggccagggtggaatgatatggtttggctgtgtccccacccaaatctcattttgatttgtagctcccctaatcctcacatgtcatgggaggtactcagtgagaggtaattgaatcatgggggtgcgtttttcccatgctgtttttgtgatagtgaatatgtctcatgagatctgatggttttacaaagggcagttcccctgcacatgctctcttgcctgccactatgtaagatgtgcctttgttcctcctttgccttccaccacgattgtgaggcctccctagccatgtggaactgtgagtccattagttttctttttctttataaattaacccagttttagttatttcttcatagcagcattaaaatggactaatatacaccctaaatgttatttactctgtgtatgtattcatatttagaataatgactcaaatttaatcatagttaaaatgattaacttttaattagaaagtattctagtaaaataggtaaattttatggttaaactttccttaaacatggataattattgcacctaatttactaggttgttgtggaaatgaacaaactaatacatgtaaaatacatgtctcatcctaagaagtactaaacaaatgttaactattgttatcattatttgttttgttttctttgttttgagacggagtcttgctctgtcgcctaggctggagagcagtggtgcaatctcagctcactgcaagctccatctcccaggtttatgccattctcctatctcagcctcccgagtcgctgggactacaggcgcccaccaccacgcccggctaattttttgtatttatagtagagatagggtttcaccacgttagccaggatggtctcgatctcctgaccttgtgatccgcccgcctcagcctcccaaagtgctgggattacaggcatgagccactgcgcccggcccctgttatcattattttattgttatcgttgtcaatccattattaacagaaacccatagtttaacaataaattgtgttctgttctacctgtataccattctggaccagaatttgagatattaggaacttctttttatagtttttctgattttcctaatgactgtgactacatgtataaataaatgaggaaagagacacttgggaggcaaactccaaagtatgacccatgacttccttttctcatttctgttctacataataaagttctgattgggatagacaaaaagtgcttcagacactccaaaatatcagctggagctgaagagaccagaattagaaacacaacatccagtagaaccaaggtctcaacagccttatttctagttttttaattcacttaaaaactttacttgtttggaaacatacagattttgttgttctttcttttcttcttctgctgctgctggtaatgatacacacatttgctttttatggtgtctttttctctcggaaagatatatgtgtgagaaagcatatcatcattaaaatactttctcaatttcaaaataggatttgcagtataaataagcaagtattaagaggaaacttcaaaatgttcatggaatatgtgtattatgaaaaaatatggataaatttctaaattattttgcatcaaaataaacttgtactaacttatcacatgtctgaacaggttctagtttaaggcactaagaggaataagacataaacctctctcttttgtacattacccagtctcaggtatatctttatcagcagtgtaaagatgaactaatacagctaccatggggaacagtatggcaatttttttccaaaaattaaaaatagaatgaccatatgatccagcagtgtcacttcaggggataaattcaagtgaactgaacacacagtcttgaaaagatatgtgtacactcatgttaatggcagcattattcacagtatctaaaatgtggaagcaatccaagtgtctaacaacagataaatgaataaataaaatgtgacacacacatacaatgggatattatacagccttacaaagtaaggaagttctgacatatgcttcaaaatggatgaaatttaaggacgttatactaaatgcaataaactagtcccaaaaatgaaaaatactatatgattccacttatatgaagcatttagagaagtcaaaattgtagagacagtagaattgtgattgtcagaggctatagggcggtagaaatgggaagtaattttttaataggtatagcatttcagttttgcaaaatgaaaagaattctggagatggatggtagtgatggttgcacaaccatatgaatgtacttaacaccactgaactgtatacttaaaacatgcttaagacggtacattttatgttatgtgtattttatcacaaaaaaatattggaagaaaaagtaggctattacaatctagatagtgcatctcaaaactcgtcaggctaatatatatatatgtcttatttttcagtattactaaatctggagttagatctcagttcaattatatattactgtttcttcaatcaatacatgagaattttcagaaattatggaagatctgaatctgtttactgacacctatttaggatgacaaagcaccataaaactaataataatctcttgatacatttagtagtagtctagtattgctcaaaaattaatcaactgttttgaaaacaaagtgtttaaaatgtcttgttttagaggcagagaattcagcctaccttaataaaaagccaaattgatttttcaacccctttttttctttgcaattttattgttatagagtgacaacagtaaagtctcccttttaaattgtatttatgaccaatctctctatatttctaatagtgttaaatcatacaacttaatttatttccagtactctttgaagacaagagttacacttgaccaatctcagtacttaccacagcaatcagtgcaacaacttaatactagtgcttcaaaatgctttaacttggatcaggattcctagaattgaagattattaagtcaaaccttgaggctgagtttagttttcaaggaggctgtgacctcagggcatgattactacaaaggcatcatatcaattctgtgctgtgcttttgttcttgttttaattataatttaaccagaagaaaatatttcagatgtgctcaagcaatattttcacagttcttaaagcatttctttattatcttcaaaaacttacactagttataatgacatcatggttttcatggcattaaaaagaatagaaagcattacttttcaggccaacaatagaaagaaaaagtacttcccatgcctctattattttctgtttgtccaggtctatccaaaaagaaatgtgcaattttccctaatttttaaccatctttaaatttaatttttaaaaattattatatcaaagaagagatacttgggaaaaactataatcaaattgatgtatataaaaagcaaactgtgaccaggtggtacttataataataaataaacatgaatggtttaatttaactacaaataactattattaaaaatattatttaaatttgaaaactcttttttttgtttgtttgtttgttttctactttattccaagatcacatccttggatattctttgtataaaataattagtcacaaaagagaaatacagatttttaaaaaatgaaaaaggcttgacatatgtatgattctagccatatgaaaattagacatgagatgtgaaaatgatcaaggactatgccaaatcttccctcttcatcctaaataagcacaaactgcctgcctatttgaagaaggaggaaaggtggatgatgtatccaatagctcagacctggcataggcaagcatacaacactaggtacattctgtcagctctcaaggggccactgcttgaccaaacctcaggaagggagcaatgaagtcaacagtagttcttccagactaattaaactggaggactctcatcattcttcattctgaaaggggccaatgtctgttgctttgttcctactccctggaaattaaaggatataagagttttaagcgtcttccagtcctggtgtagcctggtgtaggtacctggaggtgaaacattgcttcggtcctttattcttcagaccttctaaagtctcaaatcagcatgtaatccatgaaggcacagatatctcttctgtctcatcaataacacacacaacaccttctgtggacatcttccacaggaggaataggtgaaaggcaacaggtcttcagacatcgagttctctcattacagcagatatgcaaatgtcaacatgtcgaaatcagccctcaaaaactttcttttctaaatccactgttaatagctaaaaacttatgcctatttttagtatcaaacatttcatttaccagattaagctgtatcacagctcacaatcaccagtcaaatgttctcaatcataggcatattggctcatattttttaagtggactttttaaaaagtgcctctgcagctagacttactaaaataggcatggcaagaatatgtttttgaagggatcaaatcacagagcaaaagtcttaaggcaggtaactagggctgttttcattgtaactttgcagctgcccacaaagacttcatttagtcctgctcaaaatctaacaaaggtaaaatgtctctgatattaaccagatgtgactatcagatattttagaagagaggctctctttatggttcccaaattgttaacctcaagcttccaagaacccctaccctaccagtaaagatctctgttagatgcctcagggagctcaacagtggtatgaactgaggacaagtcaggagggagagtgttttgaccagacctttcctgagtttatccaatttacactctattttattagataacctctagtgatttcatctgaacgaagaattacaaatgttaaaaaaaaaaaagttgaaaacctctgtcctagataaacccccttgatcttaaaatcagcccacagggaaatcactgagctaggtaacccagtagagccattagctagtcagttcttccactcacaaccagttccctctgacgacagtccagaggaattagcaaggagatgctgttctagcaagttgaaaaaaatccaatttctttagattatgaaacacatcacataaagcctactaaccaaaaaaacctttattttggcaaattgtagaccacaaaatatgattgtgagctgccactactcacaggggagattttatggtattagagagtaaatgccaggactctgtgggagaaatctatttcatctgggattctcatccagaagtgtcttcccaagaagtgtgtaaaatgcctgccattgtcatgactcctgaccaccagactttcatttcaaaggtgtagaagtagggaggaaaagcacatcaacacccccttgccaaagaccaccagaagcacgtctttagttaacaagctgggtttgttacacgttgctgagatggagaacgtacagcagagggaaccatgagcatctcagtaagagactgttgaaaagaacctattattaacagcatttgggctttggctgggtaattttgagaaaagtctaaagaagtagagcatttttctagattggatgctatcagaaagtggggacgattctatgattgaatatctcaataattcttacctataattagggcagactagagcaaggataaagctgtaattggtaaaggattaacagtcactcatacatgataatattgactgagaacaggaaagggtcaatgctagacagaaaaagacattgttcttgattgttcacactgggtaggaatcattgtcaattcctttgtacaggaaaccctgttgatttcagaaactcactgagtaatatctatgtctagatcatattccaggccatagctacatacgtcactcaaggcattcttctgtcctctttgataaagcctatgttaaattgcctttcatgcgatcatctcatacagttacctggataggtaatatgatgatttcagtcacatttctgatgtccagaatgggcgaaatcagctaagtgtcactgcctgtttctcaaactatctatggtgaagagacagtttttctccccagtcagtaccagactagtattttagtacatataaaataaatacaatttgataaaataaaaactaattactagaataataaaatgaaaaaagacagaaaacaccaacacatttttaaaactgttattattagacccaacagacacattaactgtcaaaattgctataaaagttcctaaacacttagcctgactattggtatttgtcttgtcacaaacctgagtctacgtagcacacttaaccctcaaccacaaaactgaaaagcaacatatgggtattaaatttgaaaatgaagaattgaagccaccgcacagaaagtactgcatcttgcattcataaagtaatgttatttggacaaattctgacagagaatctgctcatttcccacattagaattctgtgaggaagctaaagaacactttcaaaatactttctttacgaggatatccaaagtttccacataaggagtaaaatacggtcattttgaaggaatctatgcttctttggaaagttttcagaatactttgaacaaaataaggaaataaaatcttccaatgtaatacaaggaaaaacattaacaaaaaaaaatgctaaaatatttgacttttgtttcttggaataatgtcgtcttcgcattattccaagaaacaaaattgtcacaaattaagccaaaatgcatatctttgacagcaaaatgctttctagtgtctttttctgaacttaaaatgtaacataacaatgaagcctcctttccacctccaccttccaaactatgcagaagccatggctgcactcccagcacctgcaaacatacgcacaaaacagaaggagtcttaccagaccatcacagttgctgatggcaacagaggttcctggaatgtccacgatgtcaccaacataagcacagttagtctgcaaaggctctgttctccggattctatacgtagcacttcctggttgatggttgttaatgggatcggttatattcccaggcaccagagatgtctcatgccactccacaacagccccaggagctactagttgagtgttgggctttagtcgcagatgaaaatcttttccaaatgccgtgatgttaaagaacaactgctcagggttggaagacacgtccctcgctgacctctttttgtgactcgcagaaagagtatgggagagatagcgtccttctagatttgtgctgactggagtcaccagctcatactctctatatctctttattggtaaatctgtggggtgaaaaacagaactgtcaaaccctgtacaataagagaacacaggagaacataacacagacaaaagctgcccacctcacaagaccatacttcaatgtgcataatatagacattcctgaatcagctcataaatattaaattttgagaacaaaaatcatttctcaaatgcatttaagtaaccctgtgttcaatgaatcattttttacttaaaatagtattaaaattacattgtaaatatttacatctcattaatacatttgcaaacacgaatataatgtgtccataaactataaatggcttgcttaaaatcaaggcatgcccttaattaatttattattggcataactgacatctgctaaaaacttttaacaaggttattatgtagaaaaaagaattctgattgttttcattttttccctgtagaaatcctggaatttagactaattacaataactatattacatgagtctgtaatgtatacactgtagcttacaatgctgtaatttatacacattttttccaccataacaaccctaacaaccatacttcacaggtgagaaaactgagattcaggggtaggaggtcctttgtccaaggtcaaacaactgcaaagcctgaatataaatccaagttgtactcctaagcccatacactcattctatcctaccatgctttcctccataaacctccatttttagaaaattagaagaatgggtaaagaagacataataatctttaaatcaaatatgcaggtactggttagtcaagagggaacagcattctcattttgcaccttattccttaagtgggacagatatctattagaatatgaaagagtatttgggacccaccttacaatatgggcagacacttacatgttaaactgaatttcacaattagcacttaaacccctggcttagccaaatataagtattttgtctatcaaaatgcaaacacccttgggaaatagaacactttaaaggaactattataagaatgattttaagaccacaggacaatggatactagagaaggaaacaagcagcagggcaacaagggtaaaaaaaaaaaaaagaagaagaagaagaagaagaagaagaagaggaagaggaagaagaagaagaagaagaagaagaagaagaagaagaagaagaggaagaggaagaggaagaggaagaggaagaggaagaggaagaagaagaagaagaagaagaagaagaagaagaaggcatagaaagggaaatctaaaaacatgaactaaaaagtttcccactttcacaattctagccttacgctaatcctatagtgtgttaaagtgccctaaaaaatggtatgattcacaaaactgctcacctatggagatcacgagttttgtcatccaataatgtatttagagcatgagatctgtaaatgaacctacgtcttatgctcataaagtatccttgtagaatcactattttcattattttcttgctttttaaaaacctcaggcaataagtgaaatgccagaagacaaataaaggcatttacttgtgcaacattttaattctttctgtgcatgtttgctgtaattatgcctcttaaaattaccaatgtatttaaatgaactatcccattttactaaatgaatacagcaagcaacacttgtaaatatttactaggcaaagaagcagtgaggactgtagtatgagtcaagtgaagcctgattccaaaactggacagacagtgcagtccctgctgaactagactaggcaccagtataaacacagacttggtcttccaagaaggttgtgaggaagatttggtcttcctccatggtgaatacttttataaactctggtttagagagaaaaacaaactcaaaatataagagaatgagcacaagtgtcacgggtgcagagtgacagaggggaaagtttccaaagtaaggagatgaatcaagcccttgtatgtgtactgacaaaacatagcccaaattaactacaaagtccttaaagacaaagaactccccattcaacttggtactcccaataccatcatacaagattttgtatgtgtcagggtgtcttgccagttgaatttgtttgatgcttattaagttagtaataccggtaaccagagaacactcgccttgtctaagctgctacacacactgacttacaagacacattacccaggcccatgagtgtctggctgtcccagtaatctcagttatagctttttctctaaccatcggctgaccatttcaagggaaagaggaagcagtgcttaatttcaatgtatggatttcccatctccactgaagggaattcacaaaaccaaagtctaaatcagtatattgtactgatgcatggattaagtgactagagaacaagaacatttagaaaaacgcagggagccttctccatacccaagaggatactcacagcctcatacgtacagtaagccatacatcctagatgtatgttccatttttatactgtcaggtattatgttctaaatttttattcaaaatatgaatggtatgtttctataaagctttattttctctaatgctaaataataaatcattcctaaaaagtatacataataaacatttcttaaatgtttgaatgagtcatttttctgttggcaattaaggtaatgaggaaaaagatacgattggcaaccctttggattaccatctcctggatggtagttaatggaactacccagtcacctgccatttattagcagaaaaagctccaagctctatgatttgtgtttgagaatatatcatctctaatactcacaacaatcacagtaggtaaatcctattacccctattctataaacgagaaagcagacctagaagacttgacacatataagcaaagagccaaaggaaaattcctgttctgatcattttgactctgaagaccatgctcctatgctctcgttcacttctgaatagatggagcatcttgctgtcaaagtctaatttaagatctgatttataaaagagaactaccacaagaattacaatgttctacctacctgcagccagtcaaccaatttttcctctagtgtagcatcagaaatttctgtaaaaggctcttacattctaggttttggaggaagaaactggaaggaggggcagaagctcaaagcaatcaaaagaattttaatctcagattacaatcacagaagtaaaaccaaattatatccaacgttaatttactgcattcataattttcacattttacaggcccaactactttcacaaagcaggaaagcctatggttattgaatgaactgcaaagtcagaaagcactaagttgagtccacttgtgatcttcagcaagttctttattttctcttaggctcagtttcctcaactgttaactggaggttagtaatagttacaacttcataggtttggtgagagttttacataaaatcatgtagaagattcaataaatatcagctattactaatttaagtgtaagttagccactcattaaaataatgttgtggttcaactttaaagttagaaactataaaactgttagctgaggtggctgaggggccacagtaataggtatgtgaaggcttttgtgggccgtaagttccacaggcacaatttcgaatgtgcttcttaactgttctccttgcttctgctcttccccttaatggattatcctcaaaatagagccagaataattaaagtgtcaaatcttatcactcttctcctcaaacccatcccactcaaagtaaaatggctcataaggtcccagggcttgaagctggggattctcacatctcaaagattttgtacttgctgattcctctgccaaaggatctttctctcagctgcctggctcactctctcaattgcttcagacttttgcttaaatgtgaccctctcagtgaagtctttcctgaccactagcaaccattttaccctctgtcccccttctgtgtcttacctttcgccataaatcctgtcaccatctgacatcctataaattttacttatgtgtttatttatatattcttatatctaccagcatatatacttcatgaaggcagaagattttatctgttctcttcacctcatttccccactgcctaaaaaagaacttgaagttactcaataaatatccatgaatgaagaaatgaagaaatgcgtgaatgaatgagagcagtttgagtcggaaggggtatgtgaaattagcatgcatcttcttttggctaaatagtcattttatcaccaagccattaatgacggcaaactgtacaagtcatctacctctaaagccagaattttgcttggaaagcttgtgtatatttctcacagttgctgctgccctacaaaccaaacatttcttagtatccaggtcttaccttttaagctaccaaaaacaagaaatggatctaatcattaaaacagacctcctgtaagacatacacagagccctgcattcttaagagcaggaagcaggaaattagcccccactctgccatctctttggatattcatagaattataactatacaggtcaaaaactaaaaagacccagaagttagggtccctaatccctgctctttcttacagttcagaaatctcaagtagatgggattattttttctcaagttagtggtagagagcctttaacctgctcctgctctctggaaggaaaggtttttctctgagcactccaggctgctctctatcccttcactcacccttccctggtggagaagagtgaattatgtggttgggaagtctgggaagcataagaaatttgcaaacctcagcacctcctcctcattctgcttcctggaaatgagtctgataaggggtacatgttctcttccactcagccaggggcagcgctgctctggattggggaggcctgacaggcacagggtggagtattagtagccagtgcacttgcctgtcaaagtggaagcctcattctccacttcagccttttctgtaaaagatattttctttttacctacatctttagtttttctatttctcaacttgttcagaagctaggcagtcaagaagggtattttttattcaggatctcctcagtaacttgaactacccccaagaaaaactgttgtcatatctccactggcagcctaattataatgtaaaaaaattttcttgtcagggaattctcttttatctaaattcctcattctagagtttaatgtaattccttcttcctccttgtactatgtgaaataaccacatttttgtatatatgtgcatgagtgtatttgtgatatgcatataaatttgtgcagacatatgcagttaatatgcacaacctacatcaaaagctttgaagaggcaatgttctttatttcaatatacttagaaattttttactttctatgttaatgtcaaccatgttagattttcctagtggtttccaaactttaatcattatgcctttacacatatctgtgttttagcatgataccctgcaaatagtaaaccctcaataaatataggttaaaagaaaatttcccttaaactataacctgaacggctctgttctctattgagaataacttgtcttactctctcttcatccttaatatatctaaaccaaactgaatgttcacctatttggcttgccctcctgacttcgctatttctgttcatgatgtgctgattctcccaaatcaggctagagagctattttatacatgtcttataactttcccccatatgacatcattcaagtcctactgctgtttctttagcaatttctctcaaactaaccccttttcttctaattgcttttaagatctcatcacctcacactgaaaagctgcaagtaccaagtccaaattccccacacagaatttctcactactaagtattatacaaattataccaaaatactgtctaaattgctgtcaggaaaattattttaaaggtccagattgaaaatacttaggttctaccacttactaccctagtgatttgggtcactacattagctcttatctgtaaattacgggtaatagtattgacttcataggcttgttgtaaaatttaaatgagctaatcaattcacagtgcttacaacactgtctggcacatagtaaatattcaataaatgctggcaattaatgtcactacattattccacctaactagcctcagtagctcaccatcactttaggataaaagatatagattcacaaaatctgtatctttttcacgtcagacctaaaatttgcttaaagaccatctactaatcaaaccctcccacttcaaaagtagaaaacagaaaatcagagattaagtaacttaacccaaataaaaacttaggtttggtatttaaagccctctgcactctgccccttatttcttttcaatatcatctctcatattagcctactgaaatattctgtctaatgtgctcacaagacctggcttaagcatgcctacattcacagccctacactgcagcatcactacagtagaggatcactgttttctctccaccaaggcaaactgaatggggccgccaaggcctatctcaagccccatcttttccaagaaaccttcttggcaacttatccacagagtacagacctcctggcctgagcttccatagcactccctgtcaaggcatttaacaaaaactcatgcaatgtctgtacaaaagttttttaaaaatctctctgggagaagagttatatgcttatgtttcatcctttcagaaactataagatctttgggtcagaaatataatatcttaactatgtttaaatggcttggtatgtttggatctgtgtccccactgaaatctcatgtcaaattgtaatctccacgtgttagaggaggagcctggtgggggtgattgaatcatgggggtggacctcccctttggtgttctcgtgatagtgaatgagttctcatgagatatggttgtttaaaggtgtgtagtactttccccttagctccctctctcctgctgccacatgaagatgtgcttgcttccccttcacccttccaccatgattgtacatttcctgaggtcccccctgtcatgcctcctgtatagcctatggaactgtgattcaattaaacctcttttcttcaaaaattactcagtctcaggtaattctttacatcaatggcaaaacccgcaattacttttgcaccaacctaagagcagtgtgagaacagactaatacatagccttagtgtatattacaggaaggaaggaaggaaggagagggagggaagtctaaccaatggctctgtctggaagtggagcttcttgggagattgctctgtgctggggctggtaaggtgcactgtatgacatatgacagacacagtggcccatgctctaggatcatcttaactcctttacatgttcagccagatatgctacaacttgaaacagatatcttggtttccttctaagtatgtagcagaatgagacacaaatatcccctaggggataccagatgtccccaatacattgcaaagaccacactatagaactgtaaaagaacagaagtcttcagtagtattgtcaacattgcaatgactttgagcgacttcagtataaatctcttatatgtcacacaaatttttaagggtctaatcaataccaaagctaccccaggcacatagaatattgaaatacttgtgattgatgcatatggctccaagcaaggaagagatttgggtatgatggttgagcactaaaggtctggagtcagaaagcattgcatttgaattctagttcctgactgatgcacgctttggcatcttacaagcaaattctgaaaattaaggctcgcagaggttatctgtaaaaataaaaataataatggggaccaaatgaagtgaagtatacaaaggacttggtccatctaataacactttaataaatgaaaagtgagctgttatcatcacctctaactagagctatagaaaaagaaagccagtttcagatttcttccaagtcccagcaccccttcaggcctctctcccctataatcccacccagcctgatgtgatacagttagaaggaccttaaattccacatcaacagagggcctaaaatccaatctggctgtaacaatccatgccccattacccaatctaaaagactggaattctctcccaagaattggctggttaactacgatgaagtggcagttcacacaggcaatttcttttatcaggtataaattctcagtatgcaataatctggcctcaagaatgaaatcgaataagcattttcaagatcatctaaagaagcagctccaacaacaacatttccaaatcctgagccaagagtaagagaatgactttcatcagaaatgatgggagccagctgctccaggaaagatgcaagcagggcgaagaatggacattaaggaggacgccaaatgccaaagggctcagcaaagccgtaaacacttaaggggaatggtacacatcttccctcaaaagcaattaaaaattaattgtgacacatgctgaaattctgaacacagtcaaattcttttttcctcacttcaaatcctctaggctcttatcaccacaagtccgacaccctctttggtgtgtcttttattttaattgcaaatctattttcatagtataatatttttatgaaactatttgaaaaataaaggtcatggcttttttattcattattaagaaagaatgaatagttgtgtacttaaattcttctagtttttaaaaatctggcttattaataaatatttgttgcaattgcacaatatttatgttcaaaaaagccatttaggaaagaacaacacattctttactgtactagaacatgaaatcaggtaagagaagatatttcaaaaaaagaaaaagcatgctttgaagaaaaatatccaagcattttatttgctacatcttaaaatgaccaaataatcaataacaaaataagtaaaaaacattttgtttttaagtgaagcccaaatgccaaaattttaatattccaatctcagtttttaaataagtacttctgcttatttagcatcattaagaatcttacagactcgagagctatgttaggcactctaaaaattaatatttctcacacctcttataatttttgctagatagaactttgaaagattaatattgagtatagaatttgaagctataaaaattaacatttgtctccaagagcaaagcctggggaaaataaaataaacaagaaatgtggacagcactgttaaaggttttcactgaaactttacttgcgataattacattttccaaatctaaaatagcctggctcatacttttgtcaaaaagtaggagaaactgggacagtctactaggtcactgagctaaaatcaagtcatcagcagggctgcattccttttggaagctgtaagagagaatctgtttccctgctttttccagcttttggaggccaccgacatcgcctggcttatggtcccccttcctccatcctcagaaccagcaacaggggactaagtcctcctgctaccacctctctggttctctctctttcacctccctcttccatttataaagactcctaccctgataatccaggataatctcgctattttaaggtcatttgattgtcaacctcaattccatctgcaaacttaatccccctttggcatgtaacataacatactcgcaggttccaaggatccaggcacagacatctttggcgtgccattattctgcctgccacagccactatctcccacccaatgtgctggaaagctattgcatttgaggtattactgtatgatgtgtgactcttcagcatgcatccctcctttttctttaactgcacaccgatttcccttcaggttaaccatgtcatactccagtcacactccttacaaatcagaggtaaaatgccccaatccaggtgaatcaaagtactgcatcccctgaccacagtgaatgattcaagcttatgactaaatcaagtagccaataaaatctctaccaggaaatgtactggaactgtcaaaaaagaggcatctctcttctggagtgaaaggtagaatgacagcctggagatgacagcaacagtctttgccacaacttgtgggaggtgtagggggaggtgaaccaatcctactctgaaagagaaataaaaccaatacagaggaaaaatgagaaagatacaaggaaaaagagaaagagggaataagagaaagagagagagtccatgagagtatcatttgaactctagatccaactatacctgactttgaaacctcatcaattttgttttccttaacctgtgtgaactaggttcctgtcactagcatccaaaggagtcatgacttctacatgacttctgttagcaaactggaatgaagggaattccaacaaaataaggtgtaagaagtaaaagagttgtatctggtaaacataaaatatagttggcatggaatccatatggaataactggttttgcaccattcctttctcaactccctctctctactgctatattacaattaattaaacaatactacactgagatacaaacatgaagataatacatgaaaacaaaactctcaaagagctgtcacatggtgagctgactggctggacagtttacaagtccatggcacaggaaattaaagttcctggaaattcatggtgataggcagacctacctaaaatgtacggattagaatgaagtacctctctttgagtaaaagtttttttaaaaaaagaaaaagaaacagcacaagtcaaagacacactaataacaatagttatgattctatcttgtttacagcgtagcagcattttatgaatgctatgaagtaaatagtagtattttcacaagactatggcaaagtaatttatggattcaatgctattcccattaaactaccattgacattattcacagaatttttaaaaaactattttaaaattcatatggaaccaaaaaagagctcatatagccaagacagtcctaaacaaaaagaacaaagctggaggcatcaaactacctgacttcaaactatactacaaggctacaataacccaaacagcctggtactgacacaaaaacatacacacaggccagtggaacagaacagagaactcagaaataacactgcacatctacaaccttaaacctgacaaaaacaagcaatagaggaaggattccctatttaataagtggtattgggagaactggctagtcatatgcagaaaattgaaactggaccccttccttacaccttatttaaaaattaactcaagatggattaaagacttaaatgtaaaacccaaaactataaaaaaaaaaaacctataaaaaccctaaaagaaaaatctaggcaatatcattcaggacataggcacagacaaagatttcataacaaaatcactgaaagcaatttcaacaaaagcgaaaattgacaaatgggatctaattaaactaaagagtttctacacaacaaaaatgttcattgcagcactattcacaatagcaaagacatggaatcaacccaaacgccaatcaatgatagactggataaagaaaatgtgatatatatacaccatggaatactatgcagccacaaaaacgaacaagatcatgtcctttgcaggaacatggatggagctggaagccattatcctcagcaaactaactcaggaacagaaaaccaagcaccacatgttctcactcataagtgggagctgaacaatgagaacacatggacacagggtggggagcaacacacgctggggcccattgaggggtggggtggaggagaagagagcactaggaaaaatagctaatacatgctgagcttaatacctaggtgataggttgataggtgcagcaaaccaccatgacacacgtttacctatgtaacaaacctgcatgtcctgcacgtgtaccctggaacttaaaattaaaattaaatttttttctaaaatgtagtattatgcatatgttacacacaagaaagtaacactttgagaggttaaggttaccagctagaaagcggtggagttaggactttaaactactcagtcaacagtgtctgtgctcctgaccacttgatagaggaaatatgagtattaacaggtcctctcctggatatatagatttagattttagattaagaaatggggccagggccaggcacggtggctaacactgtaatcctagcactttgggaagctgaggcgggtggatcacaaggtcaggagttcaggaccagctggccaagatggtgaaactcgtctctaccaaaaatacaaaaattagccggcgtggtagtatgcacctgtagtcccagctactcgggaggctgaggcagagaattgcttgaacccagaaggcagaggttgcagggagctgagattgtgccactgcactccagcctgagcaacagagtgagactctgtctcaaaaagaaagaaaagaaaaaggaaatggggccagtgtagtcccagctactcgggaggctgaggcaggaggatcgcctgagctggggagatcaaggctgcagtgagccatgactgcatcactgcactccagcttctgttacagagcgagaccctgtctcaaaaaaaaaagaaagaaaaaaatgaactttacatgtaaaagagagaggttcttacacgtaaaggaaagagaactggaactcatgaataatgccatcaatcattctttttgtttgcatatctaaataaaaatatacttactaaatattaagaaaaattgttggaaatgtgatttactatctaagaccacagtacctgaggaatcatatatttaatcctgttttacttgctacaagtttcctaatgactatttttgttttatcaatcacttcaagagcaaggtataccttttcatgctgctcacaatttgttctaaattccatgcagattcatcatgctgaatttgtggcaatcattttcataaacaagagactgacattttaccacaaaatttctcctagggatttacagttagtcagcaaagtcatgtaaacttctttggaaaatcaggaggtataaattatatgtgggaacagaggttgctatgctaggaaacttcccgtgcttcactgtccattttcaggaatatacaactctcagattgcactgtatgaggtagatgagtcttctcgcagtactaataaaattacaaaaacatttgtataatatgattattcatatttattgggtacttgagagttagaaaaattacgaattcgctgcatctttcagattgcataaccaaatatttaaaaattatattcaaatatcaaaaagaagaaagaaataattctaaagtgaaattttaaaaatcaatactttcctaagttgctagtaggagttcagatcatacagacttgttcaaaagccatttgtcaaaatgtatcatgtgaatttgtttttactcagtaaccaacttgtggggctctctcctaaagtagtcacttgaaatgcaggcaacgacatatacatacacaacactgtgtggcaacattcactatcatgggaaaataaatactgttaggaaaatgattatacaaattagagtttattagtatgatgagattaaaatgaagttcagaaggagtttgtaattatgttgaaaaattgtactaaaacattaaacaaaacaaaaacagttatacaaaaaatacagtgtgtgtactgaaagaagtttgaataagaacatgctaaattataacagcagtttgggaactggaatgattttcaaaaatcttaagaatccagaaaaattaaagaatataattacagtgggcacttgtaagacatcaacaatctgggaaaacactgactaattaaaaagaaaaaattcaacaacttataataatagaagtagtatagtttaggaataaaatttgatctctactacacgaacactaaagagaagattctcaaaattctgataatagcaatcctttttaaagaagcattaaagttccattgaagtcatcattgtcaatatatcctttccaagcacaataacccaactcttcatatcaaaattactcatgattttgccaggcaatttggaatggttcctaatggatttccaagataatctgggttggctactcaaagtaaagaatgttttaagatcatcattctggaagcagaggcgaccttgagggttttttaacatttctgagcaatattataattatttggtacaatgacaaggaaaagcagtgaaagcatggctaaacaccaacactaagttgtgataatggtgatacatagcatgctgcacttaataaaattttcacctaagaatcttgaagcagttaacattcaccataatcatgctcaatggagggacaaaagataaatcagtaaagccaactccattacctttagttacaagaaagaataatggcttgagtagctaaaattctaaattttacaaaggatccccctaaacctccttcaccacactttctagtactgctgctggcaaattggattgacagattttaatcttagcttagcttatctttcctgatgccagcaatagggcaaatgatcccaagtaggctgtagttaaaaaaacaaaaaattagttggcattccaaaactgcacatagaattcaattcaatttaccaaatacttattgagtacaaacagaaaagcatacaaaaaatgataggcctaggtccctgtgctttgtggggtggaagaggagtcccaagaggccttgataacattgaataattaattgtatagccattgtcaccatcttcattttcttagggaccaattcagcctggagaaaggcacaaaacaagagcattcaaggaaattcagaacatagataaaccttaatataataatatcctgcttgctagatctattcattgaataaccaatatttgaggacccacaagctaccaagcactgttttatgtactagagatacaattggcatcaaaacaaagtctttgctctcatgagggttaatctagtgacaatgtttactggtcaataactaggtaagtgactcacactaaaccttacaaactgaaacctgaaaatggtgaaaaattatctcttagtaaactagatatctgagagagtaagattagcaactttatttttttaagattgggatgtaatggaatttgcaactgaggaacagaaataggacagatgccccaattccaagaggaatcaggagatggaagatatgccccaattccaagtggggtcgggaaagggaagacagcttaacactaaaggatcacaatgctttttcctcaaatgatactcaagcaatctcagtggtggcttatgaaacaaaaggactcagagaattctttttcagattttccagtgtctacagaactatgattatttcctaagccacatgtgtcattgagcaagcctccttacccaattggaccagccacaccagtttcccacaattaactcaggcatcctaccaaggcaatactctgagtcagaaatgacagtgctccctgatacgccctagaagtatgtcaatgatctcatgaaacatacttacacatatatacagaaacatactcaaacacacagatatatatgtatgtatgggtataggtaggtggttagagaggcagttcctatctggttgacaaagaggcacacaactaggtcagggttcaaaacctatttacccattttttctagggtgaatcctactttcccacataccaagaaggtattattccactggctgaagagagaaggaaggaggcaatatcctgcatgagacactatattggtgacatagctatacatattctaacctgtccccatcacaaactgccttctctttacctaaataaaagccttcctagtctagagggttgaagcatataagatatatttttgaaaattgaccttctaagttaaatactaagaagtacatatcctgtgactctagttacaaagagcatgaaaaactgacacaatcaatttatcctgttagaagtcaggagagcagtcacctttcataacgggagaatgcttggcagttggcatgagggacgtacagggattccagtaatgttcaacttattgatccagctgctgactgctgactgcacaggagcattcactttgtgaaaaatcagcaaagtacacttatatgcaccctcctacatctatactacacttcagtagaaagtatttttaaaatttagtttcttaacaacttgtggtttattactcatttatatttaacccttcctgaaacattaaattatttagaaattattcagggccatgaaatttattttctagccaatttgttgaaaaataaataaataaaatctacaaacattatttgtctttcctaatgtatttctgatcaaataacacgtccccaggtagttatataaaactacttctaaatcagttaatagaaaaaaaataaataacgtgttcaggagtgcatttcaccaaatctccaggttagcagtgtagcagtgcctttacacatgggaacaggggagcaaaactaatcactgtacataagattttcttacatatgatacataaaccaaagtgaaatgatagttatacttttgctatcacaagacctgtgggccaaaatctattttattcaatctgttcttctcttcattcaactggaaaacgataaataagaatggtaataataaaagagagaaatcccataaaacagatgaatatgggaacaagtaaatcttcagcactacaccctaagagggctccgcctcctctctttcatactgacttatctctcctctgccaaatttaaggacacctgtactattttcttccctttaaaagggctaccatagtaatttacattagcaaaacaactgaaccaaacttcggttcaatccagggcctcttatatgagagcatcctaattctatcttaaaattctaatcaaagctatatattttatgaaattttttggtggaatgggtgatcttaagacatctttttaatttgcatattgaaaagttgggacgtgtaagtaatcaaatatttaagtaattaaaaataagacaactttcttctccctacttaagagttggttaaaaaaaattctttaaaaagataaggattgatggctgaatgttatcaactacgaatgacaagtatctgatcataaacactgtacttttagggcagttctcagtgcctttcctccccactgttctcctcttgccgtcgaggtctaagcttgggaaatacatccaacaatgctaagcactgagtaggaaggagcattttgatatatgctcatatattacaggctacatatacacacctctgggcttagctcttgggtttcttagttaacaagtgtgaatctccactgtgtactataacaggtagctatgcaacctctcaagcttcattttcctcatctctaacataggcacaatagtatccccacctcacagtgtggctgtgggaatcagttgacataacacatgaaacaatcaacactgtgcctggcatttaataaacggccaatgacttgtaactatgtttgcagcagcagttataaaaacttttcttctaaaagacagctttacaatatcacctgacaaatacagaattgacagagactaatactctgccaaaaagaaaaattatcttttaaagtaatccaagtaaaatgtgtatgaaaagactttgaatgtagcctggcttcttgccagatgactttcagcctccgcattcacaacaaatacattattctaaacagcttcaagaaagaccatggacttctgagtgacctgttgcaagtcacttacactctctgaatctcagtctcctcacccataaaatgggagtaagaatctccacaccatcagaagagtactgggattttagatattagcaaaaggcctaacagtatctttcacattaggagataattattttaaagcagattgaataacagaagtcatcagaggatttacccaaagcaggaaagattgtaagagaaaaatttccatgctctgtacttcattgttctcttctatgtagcattcttgccttctgttgtactcaaatgtgctcctcctaaatgctacagaagttgatgattttatttcattcatctccatatcatcttacagcccctccatcatcttccaagtacatatcagtggcttgtacaaagacagtaataaactgatgcttgaaatgtccaactgcaggagaatttttacctcactataatttagccccaggaaagtgggaccttcctccagaaagaggaagagaagaacagaaatgtttccggactacagattattttttttaaccaccagtgggaaacatttcagaaacaatattttgcttagctcacttcattcccttactttcaacttaagataagagtgacatctgagaacaaagcttacctatttgcaccatttcttcattaccagcctggaaaggagggggaaagcaagaaaaagaaagttactgggtttcatcttatcaccttgtgagttttatttctaccattaatggtttccaagagctaactaatcaggagatgctagagactgggattggtgcctaaagcctgcaccttggtttgtagaaggttccatgagccaattccataacaatttggggaagggagttgtttgccccttttcattttaatttaacacttatgaagccagcaaaaatacatacagactctcaatgctctcttctgaaatgtcgtactgggtctggattagaaaagaaagtatgaatttaacaggccaaaatacacctaacagggggcctgattaatcagatttaaggtcaggaatcaactagacaattctctactttttaccctatggtcgttcagaccaggccgaccggagaagctacaaaaactaacagagaaattctgtacccaaagtcccatcggcccagtgctgatatgatttactacaaacagctcccctggcggagccttctcaaggactcttctgagagcatcgggcttcaccttgagcctccaaagggttgggggcagggccgaaaagaaacagagctgcactcaacttagctttaaaaagaggaggagttgtgcagagggggaggggagaaggcggccggcgcctgcagcctctgcccaggaaaacggagggcaggaaacgtctccagcccccctccccaactgtcaaatcctagcccggccgtggtactcccaggacacgtgtctactggatctctccctgtccggcccaaggacttcctgaaacccccgcctccggctgcccgaaaaaaccgtgagtcagttcggaggagagaaagctccaggaacccgactctggcggcagcagccagagcgctgggatcccggacccagcgtccagaacttcattcaagcgcccagaccgccctccagaaaggggaagcccagatggcccggcgaggatgggaactggctgcggtttgtcactaggaattgttacgaatgtcgcagactggtgaagccctaggtgtgacaagactgggctcccggagtgggagtcgtaacctcccgtgcaactcaaccctctacccccaaaagcccgcacgctgcgcccagccctcaaaacaccgtttctgaacgcaaaagataacagggaagggtgggaggagaaggaggaaagagaggagggtagagaggggaggaacttttcgggaaaaggttgggtttgagtttttttttattgttattattttccacttacttgtccatcagctgaagtcctaacctctaccagagcggctgctatcaaccaaagtgacaggagaaccatcacgagtcgagttcactttccaactactgggcaaagc

SEQ ID NO: 2429 - DNA, 109467 bp, Homo sapiens
atgttttcaagttctgctttattattaaagttgtaatcccttgatatttacagagcaggcacctcggtgccaaggaccaggccatgcccgttctggtctgggaggcagaacctggggttgggtgagccacggggtctgcaggttgcatccgagacccccaggtcctattcttccaccccgtaacaaaaccagaaacctccccaaggcagaacgccaaaggccaggtgtcacccacaccccagcagttccccttagcgccagatggggctccctgagccctgtggctgaagtggggaacacggccatggggcttgtgtggactgaattctcatgtggctgcagccctttctgtagtacagactggggttgttaacatagttcatggtgcctgcagccccttcatggtgggggtgcctggtttgtcctcccaggagaagcagatggtaacactgctggacctggctggaaggagcctgaagcatcggccacgtccactggcttacctgcatgtaacctttcccaatctcagcctcataggatactacacttatggcaaggctaaaggagaggggataagtcacagccccagcacccagcaacacacacggtgagcggccgggctggagtgcagcagcatgatctggctcactgcaacctctgcctcccgggttcaagtgattctcctgcctcagcctcctgagtggcgcccaccaccacacctgtctaatttttgtatttttagtagagactcctgacctcaggtgatccccctgcctcggcctcacaaaatgctgggattcccgtacctgggccgggctgggaattttaaccatgactctccactccaaaataggtccagatccttggcagccaaagatgatttccagccccgggctcagggcagccagtgcgtagtcctcacatccataccatagggccaggttccgagggcatcatggctgctaggctgaaaaacccgcccttctccaggcaccagaggtcatcctggctttacacgtatcctttgagagtctgtacctgattcaaacacggagaaaccaggaccccgagcagtttgagtgtactggtaatggatgcagctttggccaactagctgagtgagaacacaaggagccgtgactccgacgcccaggcctgtgtcctggatgggccgtgtgcagcgaatccgttggcgactcctaactaccaagaaaaggagctctcggaggagatttcgtcgagtgctacgtgtggctgtgataagggcaggcaaagcgtcttagcactctacagctctggcgtggttggagggagggtgggggtttctccatctctggaagctctacacttaaacattttaagttaaattacatttatatagtattttcataatttatattgcttaaaattatgatttgcatgctaagatgcaaacttacgtgatatcttctttagacataatgctattaagagcacatgctttataaaataaaactggtctcattcatatcaggtgcagaaagccagtcctgaaagcatagactatcccttattctggctgttattaaggaaaaaattcatttaaaaaatacagtaaagattgaaaccaagtttactgtttcttgaacagaataggaagaaaatattttaaatggctgagctggtcattagactattactcatttatcttaaaggcagaaacttgtcaacccaactacgtgaaacagagaagcatgatttgcttaagcaggcgacattagagttaggcctctccactgaagcttcccgaccgtcagcacgtggcagacaggatgcgcccatcattccgcaagggagaaccggagaggcccgggagagtccttggctgtcctctcatcgaatgatgggtgccgagcgatcattcgtcacagtcgggcggagtttcacagtggcaaaggggttttctccgctgcaggggataagaaaaatctttcagaacttctgctctacgagggaaactggattttaacagtgctaataacccgttcttgccctgtgagactgggcggctgaccacctccccagcttgtacaggtcccagcagcgttttctgagtgtgaaagttttgttcagtgatgattcctacaccataccacctgctgcagaacgatcccaggttttaagcgttctggacgtgggcacccacacctctttagtcctgcattgtgtgtgacatgggggtcactctggggtggggaagccctgctcccagcgtggtctaaagtagttggtaaagcgagcagggggctgcactcccccatggctccacaggccgaggcctttctcaggctggaccccctgggctgggcaccgaaggcccttccgggggacactacagggaagagcaatgtcacacactgaggctcacgtaggaagccacgcctacctgagaaaaggcggctttgcagtcccgttggcatcgttctgtgagaaagataaagaagtttatggagggcttagaattggtcttttaaaaattattttaggtagagatggggatttgctatgttgcccaggctggtttcgaactcctgagctcacgtgatccttccaccttggcctcctaatgtgctgggactacaggtgtgagccgctgcgactggcctgtattggagatttttaataagacccgaaggtaaagacatctaaaacataagggatgtttaaaagtgccctgtcccaatctgttagactgtctaaattcacttggaagaataaggcaagaacagaaaacgctctgaaaggcggtagcggccctcccaggtgtcagagcgtgaacagagcatggcactgcctgcgcgggtcacccgtgatgtcgggagctcacatgtgaacgagccgcctgctaaactcggaaacagtttcacaaaatgaagcttgagcaacagagcgacatcacagaagaaaacatttgtgccaaacagaacctctcagactcggggcaaacagagatcccacaggtcctcagccacggtcttttgaacgcagaatctagtgactgggatgtgctttttgggagctgactcctgaagcatgacaaagaaacaggaaataaaaataaaaccccactggctttggggctgctagagccagggatcttgtaggaagctcaaactgaggaaaagagaaggtggaaccaaagtgcaaaggtgcctacagggctcgggtggggagcaactccttccagcacctgccacccagggcgagccagggccaggtgtgtgcgcgccttctttccctcactccaaaaagcctggagggtttaacactctttcctgcctgcacacagggagtggagtcaggcagccgcccaggagagggcagtgtaacactgtgtaaccagcctgtggcccggccacaccgtcctgacagccccaggaagcgtcccagcacccccagggggtctcagggagcacgcagacctctcaagattgacttaggggaggccctctcatgcccgatgccagcgctagagcgcaggccgttcctggacatggaggcccaggccaggcctcctctgggatggcctccactgcatgttgggtgtacaggctgtggagacggaaggcagtttgggagccccagggctgtgcctgagacctgtcccaccctccccagatcccctgggcagggcatctggggccaattcattgtctgcttttcatcactggagcacaaagccactgacctgccttgcacatcctacagggctttaaatggccgcaaaagtgacttcctgcggggcactcaacgcttccctagcaggcctcagaggaagtccttgctggtgtgaggtgcatgctctgcgattatgatgggctaatttatgatttaaatgcaccagggtgcctgtcgcatgtgctcacggtgctggcattcgtggactctgttgcagaagggccatggctgggcctgaggcacgattcatgccaatcctgactccactctgccctcccctcctctcccactggagtcatctgactccttggggccaacaccatctccctcacatgtgcagcttatgctaggggaaggcgcttcccaaactagaaaccagaaacaccctccacccaccccaagcacaccccggagcttgttcagagcctcctgggcccccacgggactttaaaaaggtcccagtaaatcctcacaaagaacgcagcaagaagcaccgactcctgccaggaggactgaggaggaaaaagaacgcttaagatgacagctggaagccactcagtgttgggccaaccccgtgcacgcatgcctggggcccaacaatcctgctccctgtaggaacaagcagggcacacacccatgggcaccgagacactcgggcagccctggagaaacagcccagaccagaaacaccagacgcccgtcaatgggagagtcagaaccagcttctgtgcagacagcaggtcaccacacagcactgagcgactgtccctacggggccaccccagacagccatctctgtgccagggcttggggagtctggtgttggagaagggatggtcacggaggtgggccatgctgggtgatcgtgggggccgggaacgtcctgctgggtatacggagtcacatcatgaaaattcattgtgtgcttttctgtctgtggtattctgtaatacaatgtttactttaaaatatgtattgggccagggacagtggctcatgcctgtaatcccagcactttgggaggctgaggtgggcgcatcacctgaggtcgggagttcgagaccagcctgaccaacatggagaaaccccgtctctactaaaaatacaaaattagctgggtgtggtggcgcacgccggtaatcccagctactcaggaggctgaggcaggagaatcgcttgaacagggaggcagaggttgtggtgagctgagattgcaccactgcactccagcctgggcaacagagtgagactccatctgtaaaaaacaaaaaaacaaaaaaccaacaaaacaaaaacagaaacaacaaaaacatattggacgtgttcaggcagatttcccgtttaacatctgcatgtttctcagggacctgaaaccccagcactccttctggatacaaggctggcaggagcctctctgcctccctctccactgcaaaggagacccacgagggcaggggcttggcacatacggtgcctcttatctggtggcccccaagggtctcacagcatcctccctgcgtccctgtctcaaccgcatacctcacactcagcccactgtggtggtcactgaacatagacctgccctcctctctgttccctttccttgcagtgggggacacctccaagccacaggcagcactgccaccggcacccagggccccgcgggcactgcctgctgcatgtcctgtgtccccaacaagacaggagaccactaaggccacgaaaccagcagccactacgagagtggttgggctgcaactggagactatagagcgaggccaccaagcggctgactgcggccagggtggacacatcttgtgatcccccatctcccgcaagaatccaagaatccaaaatgtgtgtgtggacactggctgaccacccatcactcgatgcctggtccacacccccttcccgactgtacggagcttccagggtgcccaccacatagccatgcgcccaggttgggggactagttgacctggctttcagaggggtcccgggcagctcggagcaccgagcaccactttttcccttgggctgcagcagagaatgctggtggccctcactgcagagggcaggacagagtgaacagggccagtgcaggtggccttgctcctgagcagaatggaacagccctaaggaacatttccaagccagctggaggccagttactcgcaacaaaagtggccctcactgacacctgtcttcagtgtgaaaacccattccagtcctcgtctgtggcccggacttgtcttccagttcacttctgatctagttcaacccctttattctcaaaagggggacgctgaggcccaaacagggaaaagccaactgctccgagccactgggatctttttggaagccgaggcacccatgttgtgacgcaaacgaagatgcgtgcaggcctgcaccgggggcactggcggctctcaggaggggctcacgccacgtgagggcgcgctgtgaaatgcaggcttgcttttacaaaggagagctgtgtgcttatttaaaatgttgggagggagccaatacttcctcacttggaactgcagtagaaaatacgtaaattaaaaaaattcaggccgggcacagtggctcacgcctgtaatcccagcaccttgggaggccaaggcaggaggactgcctgaggtcaggagttcaagaccagcctgggcaacataacaggatcttatcattgttaataaaaacttaaagagatatcacgtgacctgtggcaaacccctagcttgagtcctggcaagtctcccctgcccccttgggagaagcccctgctctcagatcgtctaataagacgcgccgtcacaggacagctgtggggcttcccaggtgagtgggatgctctatggacacctaaggttaagcattccagtgtcacacgacctgtaactcacaggagctggatataaaaccatgtataaaaatgcttttaaaaaacattaggggctgggtgcggtggctcacgcctgtaatcccagcactttgggaggccgaggcagacggatcacaaggtcaggagatcgagatcatcctggctaacacggtgaaaccccatctctaataaaaatacaaaaaacttagccaggcgtagtggcgggcgcctgtagtcccagctactcgggaggctgaggcaggagaatggcgtgaacccaggaggtggagtttgcagtgagccgagatggtgccactgcactccagcctgggtgacagagcaagactctgtctcaaaacaaaacaaaaaaaacatgaggatgctttcccagctctcatggatcccagtgtttggcctgggatataacacagctttccccaacatcatcagctggtttaggcattttggttagggaaagctaagttattaatcgaggtggacataaaaaggctgagacacataattccaggactgtgtccccagccctcaagggtgccagaggcccccggggctttcaggtggcaaaggctgccattgtttttgagacaggtcttgctctgtcacccaggctgcagtgcagtggcacaatgacagctcactgcagcctcgacctcctgggctcaatcgatcctctcacctcaggctcctgagtagactacaggtatatgccaccatgcctgactttttaattttctgttttttggtgttttttttgagatggagttttcctcttgttgcccaggctggagtgcagtggcgtgatcttggctcactgcaacctctgcctcccgggttcaactgattctcctgcctcagcctcccgagtagctgggattacaggcgcctgccaccatgcccagctaattttttttgtatttttagtagagacagggtttcaccatgttggccaggctggtctcaaactcttgacatcaggtgatccacctgcctcggcctcccaaggtgctgggattacaggtgtgagccaccacgcctgactggttttttagttaattttctatatagacgaggtcccactatattgcccaggctgatctggaactcctaggctcaaatgatcctcccgcctcggcctcccaaagtgctgggattacaggtgtgagccaccgtgcccggcaggctgccatcttttgagcctcagccatggtacctgcttcttgaccaccacgttatggatcaagcttatttttatatatagagagagatgggtcctttctctgtcgctcaggctggacttgagttcctgggctcaagtgattctaccaccttggccttccaagtagcagggatcacaggtgtgagccaccgtgcccagctagagcaagtttttaaatggaacactgtactattttgtatgatctattcctaactgtccaatgtggcaaccactagctgtatatggctacttaaaataaaatttgccgggcgcagtgactcacgcctatattcccagcactttgggaggctgaggcgggaggatcacctgagatcaggagttcgagaccagcctggccaacatggtgaaaccccgtatctactaaaaatacaaaaattagctgggtgtggtggcatgcacctgtagtcccagctacttaggaggctgaggcgggagaattgcttgagcccgggaagtggaggttgctgtgaaccaagatcatgccactgcactccagcctgggcgacagagcaagactccgtctcataaataaataaataaacaaacaaacaaatgtaaacgtctagttccttcgttgcaccatccgtttttcaagtgctctgctgccctgtgtgccctgtggctgctggactgggcagggaacatttccatctgtgctgctcgtctctgacacacacatgcttgatccatgatccctgctggtgaggaggctgtgaggccaggaggcccagaacacacagccattccccctgctccctgctcccgcccttggagcagcaccaatgcgtctgtaggctgtttcccacagctgcgctcccggaactcctgactgggattggtctggatgaaacgtggtcacttgtctaacaggagtgctgtctacagaggctggatgcgggtgacagttgcagtccctccccgcaatgcttttgcagtctgcataggatgttagaataacagcatgcagatgaccgcgccatgtcttatcaggaaagcgtactgatgtggaggccaagaagctgctggctgagatttcagaactgggtttctaacctgccgtgggccttggacagcggctgccattcttctgtgcctccctttctccatttcacgaggccccgctatccctctacctccccaggaggtcccagcacaggcactgctcaggaagcaccaccgtgaggtgcgaagggtgtgaaggtacgaaagacaggagggcaccacaggctggcggcaccactcccctcgcaggccagccagaagccaggcagcagtgtggaggctcatcctgcctctctggctggtgcccgaccccagctcttgagccccccaagtcaccgcaacgcccaggccttgtgtttttgccgaagctcgtgcctcagagcctggctccgacgctttcctcctagaagcctcccctgatgcgtcccaggaaccctggcctctccccttgtcctcaccccatgcatcgagcgctccctggactccacccctgcgtgggtctcattcctctttgtgtcctgagggcttggctctaggccgcccagtagaggccggctggatgaatgctgatgggacggtctcatctctgtccacaaaacccctcccccacagccataccctcactgccatgtgactgtgttgacagaagtctgctggcctcagaggtctgcggcccaggaaatctcagctgccatcagtgataaacatgacctccctgtgggcgtcacctccacccctgtgctggatgggccttctcatcgatttcagtgatcatgaagttaatcagcagtcagcactcaaacacgtgcagaatcaatgacaactgaaatgattagaatccgcataaggagggcattctcatgaggtatctggggcttttgaatgttcttggatgaaaccagaaatgaaaggctgctaaaatgaaagcctgaaagccttctagctttttttttttggtatatatatatatatatattttaagtggagacgggatttcaccgtgttagccaggatggttttgatctcctgacctcgtgatccgcccacttcggactcccaaagtgctgggattacaggcgtgagccaccgtgcccggccaagccttctagctttcaagacagaaagggggaacctgaagatgatggtgtgtgtgtgtgtgcacacgcgcgtctgtgtgtgtggtgggggttagagggagggtggtcttggggaagtgagctttggcaggtgcggcctgtggaggcagccggggactggatgactgggaatctctcccgtggaggggacagcctgaagctcgcgggtgtgagctgagaataccagctcaggtgggaagggtggtggtggtgtccacatgggccagctgcgctggtggaggctgcagggcaccaggtcaccccctgcaggcagccccagctcagcccaaccctccaggtcagggccctcggggacagtggtgtgcttaaagctctgctgcccgaggaagtgggaagccggtaagaggcgtgcaccgtgcgctggcagtctcccgacactgacagaatgtcatgatccagccaacgaagaggtttaagaatgaagccaggtcacctttccactccccagtgctaagtaaggaggaatctgtcattactgagtacactgatacttacaaccaggcttcttccatttatccaattccctgcagtaagaatggcggcgacagtactttcttcaccaagctttatccacacgataaatacgctgacaatgacacgttttcattttctaacactgaagactatccagggttggccaaagtgtcagtgctctcacttacaatgccagagctgtgatttttgggggcaagattcttttaccttaaaaggcattatccaacctcaataaagcagcaggctaggcgaacatcaacagctactaacatcacaaaaagagatggacgtccacacgtgcctcctcactggtgaaatgctccagcaaaacacaacagtcaaacaagcaaaacagcaacagactctgagcagggcctgaggtctaactaccaatttacagaaatacaggagacacgggggaacgcagaaaggacaccaacagcaaaatccagatgggggacaccctccaggacaaatgactggttcttctacaaagagactgctaaggacaagaggcagaggggggacctgtagctagaaaaggcctcacgagccctatccaccaattataatgtatggagctgatttggatccagattcaaacaactacactgtaaaccatttttctttttttatgagacagggtctctgtcatccaggctggcatgcagtggtatgatcacagttcacagcagcctcgaacttctgggttcaggctatcctcccaccacagcctcctgaacagctgggactacagacatgtgccaccgtacctggctaattttttatattttttgtctacatagggttttgctatgttgccagtttggtctaaaactcctgggctcaagtgatcctcctgccttggcctcccaaagtgttggaattacacagacatgagccattgcacctggcttcaaagacattttgaatgaagtttcaaaagctagcattcctaaaccaaatcatgccaatgcagtctacaatgaggcaggtctacgttcccagactcctcaaggctcacgcgtaggtctggggcaggcacatcttagaagcacatccgtttcatatcatcaagacactccacacctgggcaccactcacagctgaactaaggccccggacacaaggtataggggcctggctccttcgccccaaagcaagacagctcctggagcgaggggtgcagacaccaccacccagcctcctccccttcacccacaggtctcacaccagggcgcactaacctcagccaacccagcccgggagtgatgtccagccgcgctgctccccaccacgccatcacctcaccttgtgttattctctgcatggcttctagtgtcagtgtttttgtttattttttattgtctgcttcctatcactagaacagaagttctgaagaggcaggcagagtccggccttgttctcctctagctggagagcccacaccagggcctctgtgcggtggcgggaatggatgaactggttccgggagcccaggacctccatgctgggcccccagaggcacgttagggttatctttcagggttatcgttaaccctaaacgccgtgcctagaaggtttagggttaaagataacatccacagtgcctgggagtaaagactttctgaagaaagatgaagttaccacttttaatgtaagcctctcttcagaaaataagaaaatgaaagaaaatggtgattcaatggctagaagactgcagccaggcaggaaagataagaaacctaataaaatctagcaaactagaggcgactgtgtgtaaactctcactgacaagatagagtccacatgaaagaagggctgaagtcaaggaggtgaaaggctgcatgacaaagaagggaatctagaggatcaaaggcagcaagtcccctcctccctcctccccggggacaccactctccccctggggacagagcagagcaaggcggtcaccacaggacctgcgcctcccagtcggggatggcgagtccaggacccaggacgccctgctgcggctttactcacaggagccgcggtctcgggcttggacgctggggccttaaaggtggatgtcgtcctggccgaatctgctctcctgtcggcagctgcccccatggacaagcattccaagtagtcgggtggggggatgacaacactgctattctcagacaagttcacggtgctgatgcttctcactggtgtggggctcaaacccaaaaaggacacagcacgtgttagataatgtctcaccaccaaaccccaaacatcctctgtgtccctgaccaaggacaacagtaatagtacatcaccaatcaaaacctgatcttgatctcacacacacagacacacacagtacatatatcaatacaaaacactgtattttttaaatttttttgcgacagagtctcactctgtcacccaggctggagtgcaatgacatgatgtcagctcactgcaacctctgccttctaggtttaagtgattcttctgcttcagcctcctgagtagctgggattacaggtgcacgccagtgtgcccagctaattttttgtatttttagttgagatggggtttcaccatattggccaggctggtcttgaactcctgacctcagctgggattacagcatgagccaccacacccggcctaaaacactaatgtttttagtggtttctaaacatatcctcacaagaaatttttttttttttttttgagatggggtttccctcttattgtccagggtggagtgcagtggcgcgatcttggctcactgcaacatccgcctccctggttcaagtgattctcctgcctcagcctcccaagtagccgggattacaggcgcctgccaccacgcccagctaatttttttgttttttgtttttttttttttttttttttttagtagagacggggtttcattatgttggccaggctagtcttgaactcttgatctcaggtgatctgcccgcctcggcctcccaaagtgctgggattacaggcatgagcccctgcgcctggccaaaaaattatttaaaagacatgacaaaaggagaggaaaccttttaaattaggggctggctcttgattgatttaatctaaggaaagaaattggagactagcaaaagctggagtgagcaatgagctaagagttaaaaaaaaaaaaaatgtaaacacttgaaattttaacatcctaaaagtgttactcagtttttgttccccagcacaatggcattttagctcttctgctagggatgaagattgcagacagcatcagaccctggggaatgcaacgtcggacctggaggccttctacctggctagctggatgggttatgggggttctgtgaacttcgatcctcccgcctcagcctccagagtagatgggacaatgggcatatgccactatgccctggctaattgtttattttttttgtagagatggggatcttgctatgttgcgcaggctggtcctgaacttgtggcctcaagtaatcctcctgcctccatctcccaaagtgctgggattacaggcacaagccaccgtgcccggccagtttcctcattttttaaagtgggggcccacctcatgggtctgctgtgagaattaagtgaaaaaatcaatgcaaagtcctttggacagtctctaggcaataactactgttagtatctgatctggaatacggatttgggggttttcggcatggaggtgctcagcaaagcccatcagtgtatttcaagccatgggagtggatgagatggcccagcacaggcaggaaggatggacccagggtgactcccaagaacactgatgtttaattgatgggcagaagaggggtgcaaagagctggtgaggcagaagacaaacagagcacaggtcaagcagccggggccagagaacattccagaaaaagcatacaacagcgttaagggctgtaagataagaacggtaagataagtgtaagataaggacggaaaacacatggcttgggtttagcgaccaggaggggcagggcacagggagggagtttcagagggctgcaggactgcgaggagtaggtggcctgggctgggtctcctcacagcagcaaagctcggggacaacagaaatcacggcagacagcactgtgagccgcggtctcatctctgactagtccacgagagctgaggcttagggcagggcctgcgacacagctagatggtggtgtgttacagaaacgacaaggcaggggtttctgtcaccgggagagctcagccacgttcagggctaccttggcgtgggcacggtcactgcttctgtctcattttcttccagcaacttcgtgtacgacgacgggaaccaacccctcctaccggcaaagagggagaaaagaccctatcagcagtagacatgtggacggcaacctccctgaacaacctggtgagagctcagggcagacaggtccactgctccagaaacgcccatgtgtggaggaaatgaaattaaggcttttaataggtaaatatggactttcacatacactgaacaatgtgtattgttaacaatttttttttaatagagacagggtctcgctctgttgcccaggctggagtgcagtggtgcgatcatagctcacagcagcctcgaactcatgggctcaagcaatccccctgcctcagcatccgagtagctgtgactagaagtgtgcaccaccatgcctagctaaaaagcaatatatgttgtatgtataacattaatttgatttggattacccctttttttttccatattggttttatttaatacatctgaacaatctgtctagaaaactgacaagctagttacaggaaggcttgtgcacataattatggctgaaattaagaggattgcattcaaactacctacgtgctaaaccttaacaaagtatatctgatatgcagattatcttcaataaatcaaatgctaattttatttatttttttgagacagagtcttgctctgtcacccaaggctggagtgcaatggcgagatctcggctcactgcaacctgcgcctcccaggttcaatcctgcctcagcctcccgagtagctgggattacaggcgcctgccaccacgcctggctaatttttgtatttttcgtagagatggggtttcaccatgttggccaggctggtctggaactcctaacctcaggtgatctgcccgccttagcctcccaaagtgctgggattacaagcatgagccactgcactggccaaatgctaaattttttttaaaaacaaaagaatgtttaaactactttcagacaggtgacttcatacgctctaataactatgcatgcaccaaatgtatctctacatgcacagacatacagaaaatagcctgggatcgaataacttcagttaactaaactagaactaaaccataaacttaactttggctaaaatgtgagcatgtccacgaagacagtttgcagcttggctgctctggaagggaggggccgtctggtgccctgcggggaccatcacgcccagacttacgccttggacacgtcgtgttctccatagagccagccatccttctcctcggggatgagcagcgtgatgacatctccctgtgcaaagctgagtaaggtcttgttggagcccgcagtgtgcgggaagatggtcttcactttctgcttcttcatcatgttcagtcccgttgcaaccgaaactgatcgctgtaaactgggatcttcggaagtacctgttggagggagtgtagcagtaatggcttttcaaagcatgagaatcaataggcacattccaatgagcaaaccccaggaatccacctgttctcatcttgccaacaatgctccttccacggaaactgaccctgtcctatttcctcgctttgatcattgcccagaaggaacagggactgttgagaaacagaggcagcgtgcagcctgaaggcatgcaccgtgcagaagaggatccctgcggctgcgggctcttttccaggcccaaggacaaggcggtgtgtgccgggttgatctgcactgctttagccaggatggctcttcttagagagacaaaccgctccaacgccaaactgccctcgcaattccaatcgcaaaggcaggctagggccacagttcaaacccaactgccaatgtccacaaagaaaagaagaaagctggaaatgcagttggtcttgccatgctggccgctcagcttctcacccccaggcctaagaaggacaaggtgaggatgagttccatttacagagtcctcaccaggtgccagtcacgatctcaatgtctcacagctgccatcccgccaggctcccaggaggaaggtgctgctatttattatccacaggacagaccccacagctggcaagtggctgggccaggaaccagctagggcaggtttgtcccatactctctacccatgagcacgaggctgtgctgttcatgtctccattcaaacacaggctgatatttccactccaggggaaaaaaggtagaaaaaaatatatatatatgtatgtatatacatttgagacagagtctcactctgttgcccaggctggagtgcagtggcaggatcacagctcactgtagtctggacttcccaggcttaaaggatcctccctcctcagcctcctaagtagctgggactacaggcacacgccgccatgccaggttcatttttaaatttttttgtagagacagtgtctcgctatgttgcccagcctggtcttgacctcctggcctcaagtgatcctcccagcttggcctcccaaagtgctgggattacaggtttgagccactgcttctggccgttttttttttccattcaaattttcccaggctagtaatacaacaagcatctttaatttaaaacaatgcaagatctctttctgctttattcttgcagattcttcatgattacaacataaacctgcgcccccttaacctgccactctctacttcgctggtgttgaacccaccagcagttttctttcttttttgagacagagtctcgctctgtcgcccaggctggagtgcagtggtgtgatctcggctcactgcaacctctacctcctggctgggttcaagcaattctcttgcctcagcctcctgaacagctggaattacaggcgcgtgccaccatgctcggctaatttttgtatttttagtagagacagggtttcaccatattggccaggctggtctcgaactcctgacatcgagatccacctaccttggcctcccaaagtgctgggattacaggcatgagtcaccgcgcccaatcctccaccagcaattttcattctgcttttaccaataagaaccagagtcatctgaatcactgggatgcacagagtattacatactttaactgtgtattttagttaactgacaggacttccttcaaaggcaaatgcctgcagaccatcatcttcctctactgggccatcctagtcatcattctggaaaactctgttcttttgcccaatagcttcacacgctgtggtccagggctctctctcacaaacagcttgactgccgcaaccttcacaccatgggggcctgtgagacaccccacgtggatgggttggggccatggcacaggtctcgagggtcctgggtgctaaagactgtgcagaaggacggggtctgaccagtgaagcagccggcaacatctgcagacagtcactggctccaacttttgtttttgtcactgtgtcacccaggctggagtgcagtggtgcgacctcagctcattgcaacctccgcctcctgggttcaagtgattctcctgcctcagcctcccgagtagctgggattacaggcaggcaccaccacgcctggctaattttttgtatttttagtagcgatggggtttcatcatgttggccaggctggtctcaaacaactgacctcaggtgatccacctgcctcggcctcccaaagggctgggattacaggcgtgagccaccgcgcctggcctccatttatttgtaaatagataattctcaacagtatgtttactctggataaacatcagtcagtgcgtagaactggtaaatgtcagagaaatgtatcacttatcagagcgtctcacagtctagtcctgtatttcttctgaactcacgctctgcaaagccagggctgaatgtatctaccatacctgcttgtttacctccaaaccttgcaatacatttatacaaaatatttatttcacagcttatcttaaaacaaatgtaaaaggtatcttcaaataaatcagactgaatctcttacctgttgaattatttaccctttgtgaattcggggcagccgtggctgggttattaaacatatcgatcaagggactggtatatgctctgcctgaaggagcggggggcatctttggtgagcatttagaaagggtgtcgtaatctttcctaacctgtgaaaaattctttattagtccaatattagtatagtgcagaaccggaattacacagattcccaaggctgttttttttttttaaataataggctatttatttatttattttgagacagagtctcgctgtgttgcccaggctggagtacagtggcacgatctcagctcactgcaacctccgcctcccagtttcaagtgattcttgtgcctcagcctcttgagtagctggataacaggcacgcactaccacatctggctattttttgtatttttagtagagatgaggtttcaccatgttagccaggctggtctcaaacttctgacctcaagtgatctgcccgcctaggcctcccaaagtgctgggattacaggtgtgagccaccatgactggccacatttcagggggtttgagatgggcagaaagagtggatccatgtgttcaaagtacctgctgcatcccaatctccacagagcccaggttcaaagatcagcaaactacaaatgtgtgaattcattactgtgaatactttgatgcctattttttttcctgaagtgccttacgttgtgatgaatgccatcagagtgtgtctaatttattctgagacacctatacttccttacttgggagtaaacttagttggaatgattacaaataaaaacagtaagtatggttgggtgcagtggctcacgcctgtaaccccagcactttgggaggccgaggtgggcggatcacgaggtcaggagatcgtgaccatcctggctaacatggtgaaacccggtttccactaaaaatacaaaaaaattagccaggcatggtggcgggcgcctgtagtcccagctacttggaaggctgaggcagaatggcgtgaacccaggagacggagcctacagtgagccgagattgcgccattgcactccagcctgagtgacagagcaagactgtgtctcaaaaacaaaaaaaataaaaaaaaaacagtaaggataaaatttccaaaacaaagataatagcgccaaacatagtataaaacatgtgcccaacttatggtggctcatgcctgtaatcccagcactttgggaggccgaggcagacagatcacgaggtcaggagtttgagaccagcctgaccaacatggcaaaaccctgtctctactaataatacaaaaattagccaggcatggtggtgcgccccagtaatcccagctactgaggaggctgaggcaggagaatcacttgaacccgggaggtggaggttgcagtgagccgagatcactccactgtactccagcctgggcgacagagcaagaaagactccaccttaacaacaacaaaaaacaaacatgtgcccagctaccttcgcccctaaaggtaaggggatagaggtgcgaaaaggtggtcctggaagtaataaagggggacctgtgattcccaccaacacaggcaaatttggcccagatcaagttaggaaacacacgattgaaatctggaagagaaaactggctcctaccacattgcttctctcgatcatgggtgaagcctgaggagttccagacacgggggtagaggctggggtctttatttcttcgatcatattcatgattttctctggcactttgatggcatcaacacaggtctcctgccaccgaggcagcttggaattcagtagttctgcagactgcaaagccaaaagaagaagactaaagacaaagaagattgtctgaagagctgagaaaaatgacatcacgtcatatcgctgataacagattactggcttagcaccaggagtgtgggggccctgggttaaactcggtgagcactttaagcacctagaggatcagctgtgtctcaccggctgagaggggcaaaggctctgactcaaaaggaaatttcctgatccctcagtgtgaatacagagcatgggactaatacggggatggtaaatggttaagagcaagaacagaaactcaaagggagggagggagcaatctgtatgaatcccgttttccaggtggccccagaaacgccaaccatcactttctccctcccactcctactaaaagcagcacctccaacacaggccacgggccccgtagttgactctgaccgattcagacattagagaagtgaatcagacactgtcctgagagtctgtctatggggaagagggactgggtgagtggtgggcagtgctgagggacgcccccaccacaggccaaacaaggttttgcagagcagacctgaccagcaggggtgagaacccgcaaccctggaggcagagtgcccctccagcacccacaagcctggctctgctcctgacaactggattctcagaggccccccaagcgcttccagtgagcaccttttctgaagagcactctggttgggaaaggggaggcaggagcctgtcctgcggctgtgtgcatggcagtcacactgcttttactcagcctctgagtttatcaagagtggtggggggctgatgtcagtcctggggaagggcaaagaccccctcacaccacccctgtccccaaatgccaccccacccccaactgtcaccccacccccaactgtcaccctgacactctgcagcaccgtggaccagctgcttgggcctgcttcatcccaactccacagaaaggactgaggcgctttagctgaattaagggaagccacaaaaccagttttcagatactcgaagaaacttccagcatagaaacgagcagatttggtctgcgtcactctagaaagcattactgggaccgatggttaagtctaagaaagactctgctgataactggagctccctgaaaaggtgctaggctgcctcatgacacggtggggatatcacgcaggaagagaacctcaaggtcacctctgtcctctccagcctgcgaccctggtgccacaggatgccctcactctgggaagagaagattctaaagtgaactctacattcccgaaactagtacagacatgctgttgacaaaagtgatcacctaatacagcaactatttcctttgctgtaaccattttcttctgcttttttgagagaggattttggctctgtcacccaggctggagtgcactggcacaatcacagctcactgcaacctcgaactcctgggctcaaacaatccttccacctcagcctcctgagtagctggggccacagatgcacatcaccacaactggctaattaaaactttttttttttttttttggtagagatagggtctcgctatgctgcccaggctggtctggaactcctgggctcaagtgatcctcctgccttgggctcccaaagggctgggattataggcatgagccactgtgcctggcctgctgtactaattttaaatcttatttagggagctgaatactcctttttcttcctttttttttttttttttttttgagacagagtcttgctctgttgcccaggctgaagtgcagtggtgtgatctgggctcactgcaacctcagcctcctgggttcaaacaattctcctgcctcagcctcctgagtagctgggattacaggtgctcaccacatgtgattaatttttgtatttttagtagagacagggtttcaccatgttggccaggctggtctcaaactcctgacctcaagtgattcacccactttggtctcccaaagtgctgggattacaggcgtgagccaccatgcgcagtcctgaatattccttaaagttgtaaaaagtttatagaaaatacaacatttgcatacatacaaggccaaagtatttttcctttaaaacaaagacaaagctgacttatattcaagctcttgcaaagcttctcctatattggaacactctctaactttactatgaacaacaatgaatttctgacctcaaccagtgctagttttggatgtttacaaaggcccaacagagttcataatttaaaacaaaggaaaggaaatgtgacatgtgttgcatcatgattcctgggggttcgaacctcacagctgtgtgtgttggaaggagggtgatgaggtcattcagttgaataaaccaggaaccaataccaccaagaggaatgaacgcatcactgagcccagctgtcctgatgcgcgtgaatgggggcccgtgggctggggcagagctgcccgtgacccccggacacggacccatgaagggagcatctcaaatcgcccaggtggggtagacctgggcccgctgggactcaccagcagccatggtgaagacactgatgctgaggacacatcagaaagggcctggggaaagctgactcgcaggtgagaagagcaaacatgtgctatttttcaatgatgaagcattattttatgaaggactttaaatatggatgtattattaatttattaaacattatacatggacgtttgaccatttcagctgtatttctataagtttatatgttcaagttggccaaacacagtttctctggaatcttttcattggcaaaatggcccactgctttatattgggcatgtgtggaaggtgagtggcgtgcatgtgtgtatatctctgtacgtatggactgattgagacagggtcccgctctgttgctcaggttggagtgcagtggcacaatcatggctcactgcagcctcaacttcccaggctgaagggatcctcccacctcagcctcctgagtagctgggactacaggcacatgctaccatgcctggctagttttttttttattattttttatagagacagagttttgccatgttgcccaggcccacctcagcctcccaaagtgctgggattacaggcgtgggccacggcccagccttctggggcatttaaatatgaaataaagttattaatacgctcaaggcaatttgccaccacacccacctgtaagtgataataatgtatgtggtttgcaaagccacagtgcttatcaaccagaaagcagaagcgcctcttctcttcaagcagagcctctttgcaaccatctgcaatgaatttctggatttcactctgacgagaagtaacggtctccacatactaaaaaaaaaaaaataataataataataattatataagcatgacatgagcatcagatagcgtgcagcctgacgtttatcttctgccatctttacacctgctttatttgaataatagagtaaatacatgagaggaaagaatgctgtaacctgacctaagtagataccatcgttctccttgaggtccctgactcgtgtgcagagagaagttgcccaagggcttgacattcccacggggcaatttgcacaaatattactttgtacttcagagatatgatcgtgtcctactggaaagcaccacgggctttggaaccagaaagttccaggttcaaacccagttccaaatgccaacaataggtgatatgctttggctgtgtccccacccaaatctcatcttgaattgtagctcccgtaattcctatgtgtttggggagggacctggtgggaggtaattgaatcatgggggcaggtctttcccatgccattcttgtgatagtgaataagtctcacaagatctgatggcttcataaagggagtttccctgcacaagctctcctttgcctgctgccatccatgtaagacgtgacttgctcctccttcccttccaccatgattgtgaggcctccccggccatgtggaactgtgagtccattaaatctctttcttttgtaaattgcccagtctcggggtatgtctttaccagcagcatgaaaatggagtaataaaatatgatttaacctaagcctcattttccccatctgtacaatgggaatagtaacactgatcatggagagtcccttcttctttcagagccaggataaaaagcccatgttttggcaggaggtcactgattaattatacttaactcagggaaactctacagccttcagctctcagtcaaaatgcttatttttaaaaactgatagattatatatttatagggcacatgtgataatgatcaaagcagggtccttgggtggccatcacctcaaattcttattgtttctatgtgttggggacattccaagacctctcttctaactattttgaaataatgcatcgctgttaactatagtcaccctactctgctattggacactagaacttatttcttttatccaattgtatgtttggacccattaaccaacctctccttcatccactccccagtcaacacaatgaccatcctcagctatctagagaatgacaggtaaccatcattctactccccacttccatgagatcaacttcaaaacttttttttttttttgagatggagtctcattctgtcacccaggctggagtgcagtggcataatctcggctcactgcaacctctgcctcccaagttcaagcaattctcctgcctcagcctccgagtagctgtgactacaggtacctgccatcaccccagctagtttttgtagaggcaaggtttcaccacattggccaggctggtctcgaactcctgacctcatatgatcctactgcctcggcctcccaaagtgctgggattacaggcgtgagccaccgcacccggctaacctcctcttaaactgtgcaaattgtcaacaacaaaagaaaacaagatattgttgaaaagctcacctcaatttctttgtgttcatatttgagtgcgtttcggcttccttggcttttccttctgatcttcttcaactcagcttgggatttctccaaagactctaatttattcttgtgttctgtttggtatctttttagagttgcctgtaagttaaatggctgtgcttattttactgtggcaccacacgaattgtcacacagtttgcctttactcacacttccactgtgtgtggctcaacggggccctgacaccctcacttcacaccatcctcacactggctggggcccccacacccacaccagttcacaccatcctcctgctggccggggtcccatgcccacacttcgcaccatcctcatgctgaccagggccctcatccctcagttcacaccgtctgcatgctggctgggaccctcaccctgcagttcacaccatccacacactggctgggaccctcactcatttcacaccatccttacactggctgggaccatcaccccgcagttcacaccatctgcatgttggctggggacgctcaccacacagttcacatcatcctcacactggccggggccctcgctcatttcacaccatctttacgctggctgggactgtcaccccgtagttcacaccatctgcatgatggctgggaccctcactctgcagttcacaccatctgcatgctggctgggaccctcaccccacagttcacatcatcctcacactggccggggccctcactcatttcacaccatccttacgctggctgggaccctcaccccgcagctcacaccatctgcatgatggctgggacccttactctgcaactcacaccatctgcatgctggctgggaccctcaacccgcagttcacaccatccacacactggttagagccctcacccctcagttcacattgcccccttcatgcaactttaatgtcttggctttgttctaaaggttactgtttaaatgaggagcccccgaccagaagccaagtctctaaggacatcttctctttcttttattccttctttcctcaaaggctttttgatgctgggtggttaactttcttctgccacccaaagtctcaaagttccatccaaagcacttagccaccaaggtggttgcagcaagctgagatcgcgccactgcactctctgcctcccgggttcaagtgattcttgtgcctcagcctctccagtagctgggattacaggcgcacacaaccacgcccggctgtatttttagtagagaccaggtttcaccatgtcagccaggctggtctcgaactcctgaccttggatccacccgccttggcctcccaaagtgctgggattacaggcgtgagccaccacgcccagtgaacacagggtcttaaacggacccgcgtcagaattcaaatccttgttttccctataatctgtgaagtgcagataagaaggatgtctggccggcatggtggctcacgcctctaatcccagcactttaggaggccgaggcaggtgcaccacgaggtcagaagtttgagaccagcctggctaaaatggtgaaaccccgtctctactaaaaaatacaaaaattagccgggtgcagtggtgggtgcctgtaatcccagctaattgggaggctgaggtaggagaatcgctggaacccaggaggcggaggttgcagtgagccccgagattgcgccactgcactccagcctaggcaacagagcaggactccatctcaaaaaaaaaaaaaaaaagaatggtgtctatgttttggagtttctgaaggcatagcaattagataacgtatgtaaatcacttggcatgaaatgcaccttagcagctgtccgggtcctgtggcctcctgccgggagggtgcagccaggcagcagtcctcacgaggacgacaggggagggatgattccagggcaactcgcacactcactgccacatgggggtctgggtgagcaggaaggggactttgggtggcaggagaaagttaagtactctatagagcaagggaagatggcaagagccctcaataccgggtctgtagggccaccctgaaggggacctggataaacctgctgaaatggacaaaagtggatagagaaggggcgccatgcaggagcggtctctgcagatgggccagggcacaccgggagccccggacggtgctctcccgcacaccacccacagcctgaagtgctgctggcttaggaagtgttatgtctgcatcagctgcagcgacagaagcacaaatgtcctacagcgtgaatgtattctgtgaagacaatgctttctggaagcagtgtgatttcctgcaatactttttcctatgccttttttttttttttttgagatggagtcttgctctgtcgcccaggctggagtgcagtggcgcaatcttggctcactgcaacctccgcctccccggttcaagccattctcctgcctcatcctcccgagtagctgggatgacaggcatgcaccaccatgctcagctaatttttttttgtattttgagtagagatggggtttcactatgttggccaggctggtcttgaactactgacctcaagtgatccgcctgccttggcctcccaaagtgctgggattacaggcatgagccaccgcacctggcccctatgctttctaataagatcccaagtgttagcgaaaaccggcccacacagcccaaagagagcttgtcggtttcatgcatctgggcatcatcaacacggagcttctctcctgtctgctgctgatgagtcaacagtgggaacgagttctccccaggctgggaggtcaggcagcccaaggctggggctggaggaaaaccatgcacttacgttcatatatttcacgtcaagttctatcttcttctccagctcatggataatctctttgtggaattttttaaactgttaacaaaaggaaataaattcataccaggtttgagattttaagcaaaataagttctaaaacctgaaatgagtgtattttgtaaatagaaacacagatcacgtacattttcatcaagactctcgttgagtttcttgtgggtacttgaaatctctatgaggacatgtcctgggaacaaaaccagatatgttagcgggaagccattgcgtatttttttgttttgaaatggagtttttgctctgtcgcccaggctggagtgcaaaggcacgatcttggcccgctgcaacctccgcctcccgggttcaaactattctcctgcctcagcctcccaaatagctggattacaggtgtgcatcaccatgcctggctaactttttgcatttttagtagagacagggtttcatcgtgttggccaggctggtcttgaactcctaacctcaggtgatcaactgccttggcctctcaaagttctgggattacaggtgtgagccgccgcgccaggcccattgcacagttttgtaaagtattaggaaaagtgaaacagaacagggaaacacagaaatacactgtcctcagggtctctaagcatcatccctgagacacatcaggagcacaacagggtccccacagtggcttccagggggacacagctgagagcaaacagcttctacaacataattaatcagacaaatgcaaactctgttcaaattcacatgagtctttctgttctgtcttttgttttttgagacagggtctggctctgtcacgcaggctggagtgcagtggcacgaccttggctcactgcagcctccacctcctgggttcaagttatccttccacctcagcctcccgagtagctgggactacaggcgtgcaccaccacactcagctatttttttgggacattttgtggggagggtttttcaccatgttgcccaggttggtctcgaactcctgacctcaagtgatccgcacacctcagcctcccaaagtgctgggatgacaggtgtgagccactgtacctggcccacgtggccctttctatatgcactttttccctaagccaagttctatatatctgattcaaattttgaaattgtctcacaaatgattacttcggtcatcacagtagctaactctaggaataaaaaatgatttatttttatcgaatccccagagtaatctgattatctgtcaggcacgagagataaaggctatttcttttttctcacgttagttcttacaatgttttggaaaatactaacgccaggggaacccgcagcaggaagagtgctcagccctgcctctgctgggaatacaccagcccctgaaaccaagcacagtcacatgatgggcaggatgctccaggacagagaagcctcaccgccgagggcagcaatcacgcccccgggtttgcaatcatatctctgcagtgagtggcagtgcgccagctctctgccacctttctacaggtgacatctgataaaggtgaacaagggcctctctctgccaacttatctgcaggaaccaaacgggtttcctagggtctgacacctaagaaatggagaaacacatagactcatctggaaccaccgttaccaccaccatcaaacaatgccgaccaacagcaagatgtgccggcggaccatcctacagctcagcggccagataaaaatgaattccaggccgggtgtggtggctcacgcctgtcatcctagcacttttgggaggctgaggtgggagtatcacgaggtaaggagttcgagaccatcctggccaacacggtgaaaccccgtctctattaaaaatacaaaaattagctgggcatgatggcacgtgcctgtaatcccagctacttgggaggctgaggtgggagaactgcttgaacctgggaggcagaggatgcagtgagccgagatagcgccactgcactccagcctgggtgacagagtgagaccctgtctccccgccccccaaaaaaggaattctagtggggaactgagaggctgcaggggaggaatcggaatgaggactgtggtagaatatggggagagagagaaagcacagactggactatggcctcggctatgatcaccatacaaatgaccctatcatgtcctgttctaggtacatctgaagacatctgagtctgacactggccacccaggcttcccttgtcccagctcaggattcaacccttgctgaacacgaccacgcagacgtcccattgggcacacctcatcctcgacatgtctcaaagtgacctctctggctgccctgcattctctaattccagctctcagctgccagccagccaaggatcaacttctcgcccatgtgtaatacctgacaatcccttggggataggaggccatcatcggagccacctgtagggtgcagccatgtcccttcctaagctctgtggtctcttccctgcccaggagagaaggcatggggcatggcgtgtgaagtcaccaagacatgttcaccaggtgatctgttccaccagagatggcggaggattctcccatccacccccagcactcacgtcccaccacgtgggctttcgaggaggtcctctctcatgcctgcccaaccccaatgcctgcttccatccctcatcctctctctggactcccagcttgttctttcccagatcaccttcctcacagatgccagggatctttccaaaatgcaggcgtaacatgtcgctcccctgctcccgccatggtgttccagggaaaccagcttccgagctgtacttcagagccctctgcaaacagtgctacctagacaaggtggggtcagaggctctcagataagcagaacttgcagggcttgtgacaggtatataacctagtccttaagccctgtgggattttacagcgctctgacggagtaactcgatggctaaacacggggagtaaagacagaaccatcccagcactcagggctccaccctccgagtaagcgagcttcccactccacatccttagcaacgctggcttcatcttccagaacggggcatgagaaaaccgacagaccagaattcttcacaaaagctgccttcacacagccaagagcataattccattaatatgccattttatagcccctcagtcatttcagatacaaactcagttactttcacatctattttaaacccacaaacaattcctcattggggatgaaatataaacaacaacaaaacccgctccagttatttagaaaatcagacactctattcttggcaaaggagatctacttaaaatacataaataaataaacatctaaaaataatgtggctcaaagcattcggtgatttgagctagaggaaacgcattcacattttttccctcatactgttctctttcatgaactttatttccacaaccttatataatgtggatctctgggaagcatggtgccaaaaccaaggtgtgtgctagggtggacgccaacaccgttgaacctggtgctctggcctggccgggcctctgggcacgctccatgctcctgcccgtggcttcccgcagcatggcggagaggcgcagtgaagcagctctttcactctgcgggcaggcaggcaacacctggccttgttattcctgtccctcactgctcctggaattcagatgccgacctcacagcagctggccgccgcggagtcagcggtcacagaaaggattaacacacatcttggctgcgattctgcaagtagccgaaagagtatcttgaagcggaagatgaaaacaccctttatgttcaatctgcagaagtttcatcttaaatagagcaagtgttactttatgtttaaaatgcgatgccacattggtttgtttgctcttagttcggtaacctactttttcagaaattacatttgaaaagggggaaaaaaaaaacccggagggtggggcgaagcaggcacagcctggactcagaagaagcaaagctaagcatgcgccccaataagaaacacaccactgtgctgtgcacactggggcgcctgcttcctttttcccccggttacgtttggagtcacccttttgggaagaaactcagcgccgtcattacagtactgtgattcagtctgaataagtggcaatatacacgtatttcaaaagcaggaactcaacataactcgaagacattttctgccatcaatttttcctcaatattcgcagaaataattcacacagagtgttagagctctgcaagagcttgtctagcaggttgtggaaatctccaacaaaaaaagaatggttaatggtggtatcactctgattttagaaactgtgaacaaatatgcccaacattttggacactattgtataaagagatgcatttagccaataggtggtatggagttaaaacaaaaaaaggacaaaacttcaggaagattattggtatgaatgcctagaacattttcattggaaacacagggccaggtgtggtagctcaagtcccagcactttttcgggttcaggcgggaggatcgcttgaggccaggagttcaagaccagcctgggcaacacagtgagacctccaccatctctacaaaaaaaaattaaaaattagctgggcttcatggaacatgcctgtagtcccagctactcaggagacagagcaagaccctgtctccaaaaagaaaaataatacagtcattggactattaatatattttcttcatcagttcacagtacaaatttagaggaaccagatggagattactaatgcacctgaactgcataggacatgtaggcataaagattctttccatttatatctgatcatggataatcagaacctgcttcatttccagagaacgcagagcaacgcctgagtcacgcactacttcctacacatcactacaagtggagtcagacagtaaaaagtggaagcagccaatctagtactgttctaaagctatgctgcagagattaaagtaaaattgattaaaaatatcattggaggccaggtgcagtggctcacgcctgtaatcctagcactttgggaggcggaggcaggcagatcacaaggtcaggagttcgagaccagcctggccaatatggtgaaaccctgtctctactcaaaatacaaaaattagctgggcatggtggcaggtgcctgtagtcccacctactagagaggctgaggcaggagaactgcagaggtggcagtgagccgagatcaggccactgcactccagcctgggcaacagagcaagactctaaaataaataaataaataataataataattggaggccaggtgtggtggctcatgcctgtaatcccagcactttaggatgctggggtgggtggatcacttgaggtcagtagtttgagaccagcctggccaacatgggaaaactccatctctactaaaaatacaaaaattagccgggcttggtggcgcgtgcctgtagtcctagctactcaggaggctgaggtaggagaactgcttgaactcaggaggcagaggttgcagtgagccaaggtcgtgctactgcactccagcccgggtgacagagcaagactttgtctcaaaaaatatatacatacaaaaaaaaaataaaaatgtcattggaaaaaggactgaatttttctgacaattttccaagtttcaaatggaatgaggagaaaacagtggaagtaaaagcaaaccgctccccagcacacacacgggatgcattaaacgagcgtgagctctgaagattagagtcaccacactgaatcagtgcggaggcagatgagcaaccacaaacgtgatcaaatttgaaaggctcggtcagcatctgagaacctgcagtccctggacgcagttggaagtgaggtgccctcctggggtcagtaccaacactgcacaagcagcggggtgcaatggctcacgtccgtaatcacagctcccagttttgggaggccaaggcaagaggattgcttgagcccaggggatgggccacacagtgaaaccccatctctccaaaagatacaatgataagctaggtgtggtggtgtgtgcctgtggtcccagctactcgggaggctggggcaggaggatcacttgagcccaggaggctgaggttacagtgagccatgactgtgccactgtactccggcctgggcaacagagcaaggcacagtctcaaaaaaccaaaacaaaaacacgtacaaacaaccaatgtgcttgtaggggtgaccccaaataagtgatagggtgagcattgcctggatcattcctccgtgtctagctgctgacttaaataacaacggcaccacatcctaatcaatgtcttacaaggagacattgtaagttactgtacactgtgctcaaaactaactaactaacttaactaactagcgggtatgccacaagagccggcttgaaggagctagtactggccatgtagaagctcatactgggacaacttgagcaccaaaataaaggcagtcacaaattacaagtcatggaaaagtctaggaatctgcgagtccacagtaaacagattagaaaaaagaaatgggggaccagggacagctcttgctagaagtagagttgcacagtgccaatcagtaaatgaagagggagtacagagatggaaaatcatcaccacagggcagggaagacttgtctggacaaaaatcatcaacagatgctcaactagggcacaagtgttgacaaggaaagagaggtttgtatggtctgaaagtgttttccccacaaattgcttactagtcgtgacaaaaaaaaaaattaactacacagtgtagagatcagacaacaccttcaatggacaatcaaaacaaacataacaaatgagaggaagatgaacactgtgtgctgaaattttatactcagcggacataaaatgacttggacagtattccagctgagaacacacaatctgaatctaatcagggagatctggtatttgaaagtgaggatcccggccaggcgcggtggctcatgcctggaatcccagtgctctgggaggccaaggcagatggatcacctgaggtcaggagtttgagaccaacctggccaatatgatgaaaccctgtctctattaaaaatataaaaattagtcgggtgtggtggtgcacatctgtaattccagctacttgggaggctgaagcatgagaattgcttcaaccagggaggcagaggttgcagtaagctgagatcatgccactgcactccagcctaggcaacagagcaagaccttgtaaataaataaataaataaataaataaataaataaagccaggcgtggtggctcacgcctgtaatcccagcacttttggaggccaaggcaggcggatcacctgaagtaaggtgtttgagaccagcctggccaacatggtgaaactctgtctctactaaaaatacaaaattagccgggcatggtggtgcacacctgtgatcccagctacctgggaggctgaggcagaagaatcacttgaactcgggaggcagaggttgcagtgagctgagattgcaccactgtactccagcctgggtgaaaagagcaaaactctgtctcaaaaaaaaaagaaaagtgaagattttgtattcctgactattcatccttgtttagcatttctgatgtgggttcgtgcctgtgccaattctttattgcactactaaatggatttacttatttctttttagagaggaataaattgatttcatccacctccggcggttaatccagtgtggttgagggaggtaagggggaaatggagaagtgtgttaacaggataaatattattaacgctttgcttaacagtaaaatctctggcaacctcaattttagaaaatgagagacatggctgaagacttggaggtgaaaagccaaaaagagctgcaagcagaaacccgaacattgtttttttttttggagaatgggttcccttttagacacagcacaaatacaccttcattttatatataagtctagaatggattgctcaaaagacattgatttttttcatactaaaaagtcagaagcgactgctgacctctgagtaatagaatacaagatctttaggaagaagagctcatgaggaagatgggaaggctggctgaggaggccggagaagggccaggcaccacgaaagggaaaagactggacgcagcttcagaaggcagaaggttctggatcagcctctatagagaactcaaggacacgaagacggggcaaaggtcacagcatccgcaggaagatgcaatgacatcagacaggcctcttagtacctgtgcatccccgggaagttccctaacctctttctgcagtatctcttggagctgtggtattctcatctgtgtagagtgcctgctccacaggcttcggtgggtactgtgctttccagtgttctggagagaaacactggctgctgaggtgccccagtccagacacgtggagcagatgggttcaataatgcactggcttatacctggagtcccagctacttgggaggctgaggtgggaagactgcttgagcccagaagttggagaccagcctggcaacatagcaagatcccatctcaaaaaaaaaaaaaaaaaaaaattcatgatacacaccaacaaaaatgtgcccacacactcctcaacaggccattttctaggcgagtacttgttttctggaaataaaatccacacatgtgattgttcagcctgtagtcaccattttttggtgcactttacacatatccatctatacactcagctcgacacttctgtcatagcctttctttccccagtcccggagtcctcaaaggaaaaactgtcaatctcctgttatctaagggaacatacctgtagagtatactttattttcctctatcttttaaaaccttaaacagaatactgagaacctcagtctgaagtgctgacatttctcctatagtttaagttgcatccatcaggattgatccatcagagaacacacacatctggtcaccgttgatgcaaaaacaatcgcaaaggcacttccggtttccactccagcacgtctaagagcttagaggtcgtcactcccttataataagaaaaagctaaacaaatggaaacaagctaaaataagaaacagtaattctgagacgcatgacaggactaagctcacagggtgaagatgtaccctgaaaaccagacggacaggctgacgcagagactcacagttcacagggagcagagaccaatgctggggccattcctggcagaaactcttacaccgcagtggaagaactgctgggggcttggcatggaggagtctgagagttgcaaacttcagggggtcagtctttgcgggcggtccccacactttcatgagttttacgtctaggagtcccaccacattctcaaggggaggttggataagcttcccctgaggcttctggtagagggggtgggaggtaaacattctgaaatatgcccagagctttgttctgttccagttatgttctctgtacggaaggccgggcctcaagggaatctgctgtaataaagccttatctgaccagggaaagggcgacttgctaactccagccccctccagtcttcctgtctcaagtaaagggatttaaaaaaaaaaagactcagaaactcttccaaaaggcatcccaggaactctggcctatcaccccacacccatccaaacacagggatttaaacataagaggaagattcttcccctccccagtacttggccaccaagttatccatcaacagggctccgggataatatctgtggattacagcacagagccgtaagtaagacacaggcttcatttagaagaattttcttgggaaaaccaaagacaacagcagcgagaaaaaacaaggacatcagaggaaaaccaaagcctctgactccgttacaaatacagcttcctctatcgttaaatccatgctaactcctagccagataaacataaatcctcacactaaaggctcatctacctcagttcctattatctgacacgtcatgttcagcttctaaaagcagcaaacattacaggcatgctaagaaaaaaaaccagattcagatgtggtagagaatctggaattatcagacagagaactaaccaccaccatgactaatatgctgagggttctactgggaaaaagtgggcaacgtgcaagaagagatgggtaatggaagcagagagatgatgtgttagtccgttttgtgttgcttataaagaacacccgagactgggtaattcattaataaaggaggtttaggccaggcgtggtggctcacacctgtaatgccagcactttgggagaccgaggcgggcggatcatctgaggtcaggagttctagaccagctggaccaacatgatgaaaccctgtctctactaaaaacacaaaattagccgggcgtggtggcgcacgcctgtaatcccagctactcgggaggctgaggcaaaagaatcgcttgaaccctgtaggcggaggttgcagtgagccgagatcacaccattgcattccagcctgggtgacagagcaaaactgtttcaaaaaaataataataaaaataaaaaataaaggaggtttatttggctctgggttctgcgtggtaccagcatctgcttggcttctggcgagccctcaggaaacttctactcatagcagaaggcaacgtgggcacaggcatgtcacatggtgtgagagggagcaagggagtgggaggggtgccctctctgttaagcaagcagatcttatgtggactaatagagtgagaactcacttattactgcaaggagggcaccaagcctttcacgaggaatctgcccccatgacacaaatacctcccactaggcccccacctccaatagtgggggtcacatttcaacataaaattgggagggggctgatatccaaactatatcaaatagaaactcaaagattcaaaaagaaatactagaaatcaaaaacactgaaatgaagaaacaaagaatgcctttgataagttcaccagcagactggacacgaccaagggaagaatgaatgagcttgaagatacgtcaacataaacttccgaaactgaaatgcaaggagaataaagaacaaaaaatgaaacagaatatccaagaactgcgggaaaattacaaaaggtataaatagccacaatggaaataccaggagaaaaagagagaagggaacaaaaacaataaaaactgatgtaataatatgagaatcttccaaagttactggcagacaccaaaccacagacccaaaaagctcagagaacacaggacaggataaatactagaaaatctgcaccttggtatacatattcaaactgtagactagcaaaaagaaaaatctttttttttttttttttttggagacagactttcactcttgtcgtccaggctggagtgcaatggcgtgatctcggctcaccgtgacctccgcctcccgagttcaagcgattctcctgcctcagcctcccgagtagctgggattacaggcatgcaccaccacacccagctaatttcgtatttttagtagagatggggtttcaccatgttggccagactgtgtttcgaaatcctgacctcaggtgatccacctgcctcagcttcccaaagtgctgggattacaggtgtgagtcaccatgcctagccaagaaaaatcttaaaagccagaggaaaagaacaccttgcttctagaggaacaatgataagaatgacatcagacttctatttacaaaccatgcaagcaagaagagagtggagtaaaatacttaagtgttggaagaaaaaattcaccaacatagaattcttcagtaaaatcatccttcaaaagtgaagaagagataaagacattctcagacaaacaaaaactgaggggattggttaccagtaggtctgacttgggaaaagatgttaaaagaagttcttcagagacaaaaatcacataggtcggaactttggatctacataaagaaaggaacagggctgggcgcagtggctcacacctgtaattccagcacttttgggaggctgaggcgggtggatcacttgaggccaggagttagagaccagcctggccaacatggtggaactctgtctctaccaaaaatataaaaattagccgggtgtggtggcgcacacctgtaatcccagctactcgggaggctgaggcaggagaattgcttgaattcaggaggcagaggttgcagtgacccgagatcgctccactgcactccagcctgggtgacagaacaagactccatctcaaaaaaaaaaaaaaaaaaaaaaaaaaaaaagacaacattctagatatttaatgtcaccttttcagtgaggtacaatctagtcttccaatacctaaggtagtacttagtaaagatgtctcctctaaaaagtataacaaagtatacaggcctggcgcagtggctcacaccagtaatcctagcactttgggaggccaaggcaggcgaatcacaacgtcaggagttcgagaccaggctggccaacaaggtgaaaccccatccctactaaaaatacaaaaaattagctgggcctagtggtgggcacctgtaatcctagctactcaggaggctaaggcaagagaatcacttgaacctgggaggcagaggttgcagtgagccgagatcacgccgctgcactccagcctgggttacagaatgagacttcgtccccaaaaaaaaaaaaaaaaaaaaaagttagctggcatctctcctcagttgacaacctccagaagccccatctgcacccggggttaagaggtagagcccttgccaggactctcaaagccctacgcgacccagcctcatgccttctgtctgcagacctcatcctcgcctgcccctcagccacactggcttacatgtgtgacccaagcccactaaagcctcagggcctttgcacttgccagctcccactagaatgttctccccagacacctgcctgatgagttccccgcagtgcacgtccctgaccaccctacctaaaacagctgcatcccaccccttctatcactcagtggccccttgccttattactacctggatattagacttgtttatctgtccaccccactagaatgttagttccctgatggcagggacttctgtttcattgatttatccccagcaactagaacaatgcctacgagacaggagatgttcatttaaatgagcacactgggccaggtgcggtggctcacacctataatcccagcactttgggaggccgaggcaggcggatcacctgaggtcaggagttcaagaccagcctggccaacttggtgaaacctcacctctactaaaaatacaaaaaattagctgggcgtggtggtgggcgcctgtaatcccagttactcaggatgtcgaggcaggagaatcacttcaacctgggaggtggaggttacagtgagctgaggtcatggcactgcactccagcctgggcaacagaggaagactctgtctcaaaataaataaataaataaatataaaataaatgagcacactggtatttaaatatcaaagaaaaactactgcaatttcttgattattagacatttggttttatgtcattttcagaataccaagggataactaccccgcccaccctccccaaactaagggacaattttccccacgaaccaagaagaaacaaaccctgtacccaatcccagtactccagtcttcatcttcctccctggctcacggctccacgatggtgccaaggctcatgtgtggaatgttacattttaaaaagcggtgcacaaagtctataggcacagggtttaattatgtaaaaagaggcatttaaaaataataaagttagaaattgagtttgatgtttattaggttcatttctcagtaaaggtatacatttaaaaaacacataaagtatattttaattcccattttaaaatgaaagtacatttctaaacttcccgggggactcataagctattttaaaatgttaatatgaaatgagaaattaggcagaagaataaacatggcctaagattaaaatgtttaatcaaataagaagaaaaagagagatcttagtaggtaacaaatttctatagttataaaaatggaagctactaacagccctgccttcgagtttaaatgcctgagtcacacagatcagcatcagtgcacccaagagttataggaacaggcttactctggagtctaaaagtccagcttcattgtaaagagctcaccatttaatatgcctcttcagtcacctagtaatttttattttacctttgaactcatacttctaaaatattagtcagtttttttttaataactcaaaaccttttagtcctaataataccaattcttatttcaatttgaaacaagaacatacaaacccagaatctgcagcctggcacacaaaataacgaggctcattaaggggtttttgtttttttgagacagagtcttgctccgtcacccaggctggagtgcagtggcacgacctcggctcactgcaacctctgcctcctaggttcgagcaattctgtctcagccttccgagtagctgggactgactataggtgccccccaccacgcccagctactttttgtatttttagtagagatgtggtttcaccatattggtcaggctggtctcgaactcctgacctcaggtgatccgcccgcctcggcctcccaaagtgctgggattacaggcgtgagccaccttgcctggccaagtttttaaaaatttatccctggctgggcgtggtggctcacgcctgtaatcccagcactttgggaggccgaggcaggtggatcacgagatcaggagatcgagaccatcctggctaacatggtgaaatcccgtgtttctctactaaaaatacaaaaaagtagccgggcgtggtggcgggtgcctgtagtctcagccactcagaagtctgaggcaggagaatggtgtgaacccgggaggcggagctggcagtgagccgagatgacgccactgcactccagcctgggtgacagagcaagactccatctcaaaaaaaaaaaaaaaaaaaaaaaaaaatttatctcccatgatcctctccatgagccctaaatcccaggtcaatggaaatatcccatcccttctctctgttcccttctccagaaaagatcaccctttccacttccaacgctgaccatggggatattacatatcataccctgacactcagtttccctccacccccacataggtgggatcatctcttcctatgaaatcctataggctttgtaccattttactctagcattccatcctgtattaaaactatgagtataaatgcacacgtgtgtgtgtatatatttcatcatctcctttactgcgttgcaggtatcttgaaggtggggaccaagtcttattaatgctgtaaataaggaccttgatttcaagaaagcccagataaatctgattcattggattagagcccaatactcttatctgatacactcattcagtcaatcaacaaacatttctaagctcatccttaactatatccgattctcacatccttgcctcaccagaaatttataactgaggcaggcagcagtggcacaggggtggtaactgctgccagctcccccgctgggactcctctccggcagatgcccctgaaggaccaccgggacaccttccctcagcttcagtcccattcttgagacactgcagcggcacagccgttcacagttcctgtccaggttttacagaagggcttgtcccaaggccattttttatactgaaccaaattctggcttcctggatcctccttcaaccagactgaaggaatgatagacagggggtctaaatcctccttaaaaagggaaatcatgtcctttgcagtagcatggatgcagctggaggccagtatcctaagtgaattaacgcaggaacagaaatccaaataccgcatatctcacttataagtgggacctccacattgggtactcgtggacataaagatgggaacaacagacactggggactatgagggggggtgggagagaggggaataagggttaaaaaagtaactattgtgtgctatgctcaccacctgggtgacaggatcagtcatactccaaaccttggcatcacatgatatacccaggtaacaaacccacacatgcaccccccgagtcaaaatataagttgaaagtaaaataaataaatgcataaataggccaggcgtggtgactcacgcctgtaatcccagcactttgggaggccgagacaggcgaatcacttgaggtcaggagttcgagaccagcctggccaacatggtgaaaaacgctgtctctactaaaaatacaaaaattagctgggtgtggtggcggatggctgtagttccagctacttgggaggctgaggcaggagaatcgcctgaacccagaaggcagagcttgcagtgagcagagattgcaccactgcactccagcctgggcaacacagcgagactttgtctcaaaaaaataaaataaaataaatgcataaatatatcattctcttacatgcccagtcttccagtttttgaagactgctttcatgatttgctccctgcataggcatccaacatttaagggtcgcccttaagaaagagaatacaaaactacaaattgaaaatgaagtgccctacaaggttttagaaggggtggagagactggaaaggcctaaggttgagtgccgtgagttttgtggtgaatatttcactatccatggaatcaaggactttgaatttaaaccccagctttgctccttacctgttgtgtgtactccttagctggatgaaattagacaagtcactcaacctaagcttccattttcttgtccataaaatgggaataatctctcttacctgagaggactgctgtgaaaactaaatgagactcctgaatttcgtatttccattaatgctaataaaattcatttactgtgcaaagcgcactgagtcagggccaactaaaactcttcacggggtcacggcgaggttacgaggcagcgcacgtgggaagtgctggaaagtgtgtggcacattgtctgaaagatctctgaccaaccaggacccaattctggttttcagataccattttttttttttttttgaaagagtctcactctgttgcccaggctggagtggaatggtgcaatcttggctcactgaaacctccgcctcctgggttcaagcaattctcctgcctcagtctcccgagtagctgagattacaggcgtgtgccatcacgctcagctaatttttgtatttttagtagagacggggctttgccatttgtccacaatggtcttgaactcctgatctcaagtgatccacccaccttggcctcagataccttcttgtgtgaacagttgaggagaataaggcagcaatcagatgttaatggcattgctgccagactgcctgaatattccagagtgccagaaaacactggtcaaataactgctactcctacaggtttcatagttgggtatgtggccgggcgcggtggctcacgcctgtaatcccagcactttgggaggctgagaagggtggatcacaaggtcaggagttcgagaccagcctggccaacatggtgaaaccccatctctaataaaaagatacaaaaattagctgggcttggtgacgtgcacctgtaatcccagctactcaggaggctaaggtgggagaattgcttgaacccaggaggtggaggttgcagtgagccgagatcacgccactgcactccagcctgggtgacagagcaagactccatctccaaacaaacaaacaaacaaatatgtacagctagcctcttgagttattacaatgcctattttactgattttagtatgaattcattaggataccccatattggcatacttaactctttttagtggtataatatacaaaagtttaccaagggtaacattagtacattcacaatattgtgcaaccatcaccactacccagttcacaatcatcttcgttaccttaagagatgccgttaggcggggcatggtggctcacgcttgtaatcccagcactttgggaggccgaggcgggtggatcacgaggtcaggagatcgagaccacggtgaaaacccgtctctactaaaaatacaaaaaaaattagccgggcgcggtggcgggcgcctgtggtcccagctactcagaaggctgaggcaggagaatggcgtgaacctgggaggcggagcttgcagtgagccgagattgcgccactgcactccagcctgggccacagagcaagactccgtcttaaaaaaaaaaaaaaaaaaagacatgccgttaagcagccattccccattcccctttctcgcatgaagcctcaaaatctgccttctcccttgaagcctcaaaatctgctttctatgtggatttgctgatgctgggcatttcatataaacaaaatcatacaataaatagcctttttatctggcttctttgacgtggcacataaccaaggttcacccgtattgcagcatatagcggtacttcattctttttcgtgggtaaataatattccattttgtttttccacttatcagcaggtggacatctgggctgcctccaccttttggctattgtgagttgtgctgctctgaacatttgtggtcaagactatgtgtgggtcaggtgtggtggctcatgcctttaatcccagcactttgggaggctgaggtgggcggatcacctgaggtcaggagtgtgagaccagcctgaccaacatggagaaacaccgtctctactaaaaatacaaaattagctgagtgtggtagcgcatgcctataattccagctacttgggaggctgaggcaggagaatcgcttgaacccaggaggcagaggttgaggtgaggtgagactgtaccattgcactccagcctggccaacagagcaagactctgtctttaaaaaaaaaaaaaaaaaaagactttgtgtgggcatatgtttcatttcccttgggttggtgtctagaatggaatccttggtcatacggtaattctatgcttgagttttaaggaactggcagacagctccaatgtggctgctccattttacatgcccaccagcaatggtcaagggttccaatttctctgcatctttgccaacacttgttattgtctgactttttaattgtggccactctattgggtgtgctgtagctatcttgtggtttggatttgtgtttccctaatggctaatgatgttgcgcatcttttcatgtgcttgttggcactcttacttttaacagttttgttaagtcactcggaagaggaaagagtacatagggaagtgcatttactcccaagttgctaaagaccaaaaaacttctagaaccccacctgcactaacgaagactctaaccccccaccagaactgtctaccctccaccgtggcaccatggtgtgcccgggaatgcggctggcgtggccaggcctcactcgcttcatgattctagccgcatccatctttgagtatccctctcttcagcctgtcacgggagctacgccctttgctgctacctgtgcgtgtgaccgcagcagctctttcttggcatgctctcaaccccactccccaatttgggtgtcataacctagtgttttcgttcctgacccttcactgcaggcccagcatggtgctgtgaaaaagttagaaatccacacctatttgtaagaggatgtaagtagcgcttgtgaacaaggatggtgatgatggcagaggcacagccccaggtcctttgcgccaccccccctcgccatgacaggccaattatccggcccagttgttgcagctccttggccagcggtcctttggctgtggctgacagcgtgaggacagggacacttacgctgtctccatcttgagttactaggacacacaatatacttcaaggagaaaaagaccaatttgagtaactgtgaaaactgggtttaaacaattttctgttcaaacacttaaaaatccaaagatttaagagaacgggcaaacataataaagttacaatgaaaaacaggaaatgacgtttcaggttgacacttaggatgtgcccagtgagcaatctggaagcatgaagtgtgaaatggctaatctgattcaatgattcagcttctacataagtaatatttatttctttatttttttgagacagagtcttgccttgtcgcccaggctggaatgcagtggcccaatctcggctcactgcaagctctgcctcccgggttcacgccattctcttgcctcagcctcctgagtagctgggactacaggcgcccgccaccactcccggctaattttttgtatatttagtagagacggggtttcactgtgttagccaggatggtctcgatctcctggcctcgtgatccacccgcctcggcctcccaaagtgctgtgattacaggcatgagccaccacgcccggctatgtaagtaatatttactaattatagtacattgagtatatatatactcacttcaaagctgagagaaggaatgttcttcttgtaacaacttttgtaaacaagtacaatttataacacagaacatcttcctaaactttaggaatgtacacatacttacaccaatgcgcctacacgacacatggacttccacagtacatgctcttacaggtttttttttttttttgcaggggacagagtttcactctgtcactcaggctggagagcaatggtgtgacctcagctcacctccgcctcctgggttcaagcgattctcctgcctcagcctcccgagtagctgggattacaggtgcctgccaccaggcccagctaattggttttttttttttttttgtctcttacaggttttataaattataaccctacctttctaattattctagctgagacctttcctgttccaaaagggagaagaaagaacatccacccaaaaattgagatgagaaaagccaccttcaaggtctaaaggcatttatcatgtgcttgcttccaggaaaaaaattattttccaaaccccaaactgaaaatactcaagaaaaaaagctggaataatgatcgcattataaatgcttctaagtaaaaccagcaaaattgtgattacagctgagaaaaatccaacaaaatacagactcatactcacatggttagtcagcatggaccatatgatggtttgcaatttaacacaatcctttattttgctgaactctaattggcaggaaaatctgacagccataaagtaaagccgttagaaaagcacagtccaggtgcagtggctcatgtctgtaatcttagcactctgggaggctgaggtgggaggactgcttcagcccaggagttcgagaccagcctgggcaacacagaaagacccccatctctaaaaaaaattttttattttttaaaaaagcacatcttttggacatatagaaaattaagttggcagactaggtcatatacctggtaggtagcctggggtccaatgaaccagccactgaccagatacgcgacctcagcaagttactgcctttgtacctcagtctcctcatctataaaacggaaataacaagcatgggcctcacagtgctgtcatgatgattataggagttaatattacatttataatgtgcttagaactgtgcctggcatatagcaggtacagtgttcagtaaataaaatctcctcttgtttctttgctatttttgtggaagaattttaatctctttaaagtgagtctaacctgtaactaaaagataagtgattttggtcaattataactgctgtggctcagctcagctctttccctactgtggtatgaattcttttatccagatcttaggaatatatttgtaatattgttgtgaattagtaacatttcaaaaatgtttcagaaatttttttctgatttttttttttttttttttttttttataaagacagagtcttgctctgtcatccaggctggagtgcagtggtgtaatcatggctcactgcaacctccgcctcccaggttcaaatgattctcatgcctcagcctcccaagtagctgggattacaggtgtacgccaccatgcccagctaacttttgtatttttagtagagatggggttttgccatgttggcctagctggtctcaaactcctggcctcaggtccacccacctcggcctcccaaagtgctaggattacaggtgtgagccactgcacccaggctgagccaccgttcctggcttctgctctaatttttagaccaaagactgtcagattggattctgagtatcagcaagacaaatctataatgtagtttttaaaaattgcatgatccataagcattctatcaatgattaaaggaaatctatgattttctaggttccctgatagtgaggagataaaatattctgttttgtgcccaatttcagaaactggcccaaacaataaatgattcaaaatgcaatggctgactaaactacaacaaaataacatagcctaaatttacataatggtgagctctaaaaagctcaaagcaaatttataaactccccaaagaaagtcttatttcctgagaagtcaatgagaacatcctttatttttctctgctttaaggatgaaaaaactgactcaaaggttcttctaaagattttggcaaaacattttccccttaccatttctgttttccctttcaccttttcaatattttctgagttataaaaataaaccttgcttgatttaggaacaaaactggaagtttatgaaaatgtcagattccttttttaaatgggcactgctgggtagctgtgctgccttgaactgaactgtgtacaggtaatgaaggattaacctttatcacgtgtgataaaggatttaactttatcacacgtgataaagtcacatgagtgactttaggtacacccactgacaatctgttgagtggcatgaatttgaccccatgacctattatttaacaattaaacagtgggagcggccaggcgcagtagctcacgcctgtaatcctagcactttgggaggctgaggtgggtggaacacttgaggtcaggagttcgagaccagcctggccaacatggtgaaaccctgtctctactggaaaaaaaaaatacacacacacacacacacacacacacacacacacacacagacacacacacacactagctgggtgtggtggcaggcgccagtagtcccagctacttgggaggctgacgtgggagaattgcttgagcccaggaggtggagcttgcagtgagccaagatcacgccactgcactccagcctgggcaacagagccagactctgtctcaaaataaataaataaataaaaataaacagttggattaaaatatgttactggccaaaccctgactactgatctctggatttgggttgacggtttgtttgctctgcccaacaagacgaagaggttaggacttgagtatcccatgctactgtggttgttaggattatgtcgttaatgcaccttaaatccagacacttagctagctggtagtaaagaagtgctttttctttggagaaaaggataccaaatccctcacaagattatcccaattgaagcaagcaactgtatgacacaagagatcttctactgtctgggtaagggccaaattgcaaaaactttaggccttgtgggccaaacgtctctgctgcagccactcagccctgctactgtatcctgaatgtaaccccagacaggaacaaatgggcacagctgtgttccaataaaactttcctggccggcacaaaggctcacgcctgtaatcccagcactttgggaggccgaggcggacggatcatgaggtcaagagatcgagaccatcctggccaatatggtgaaaccccatctctactaaaaatacaaaaaaatcagctgggtgtggtgggtacctgtagtcccagctatagggaggctgaggcaagagaatcacttgaacccggtaggtggaggttgcagtgagctgagatcgcgccactggcactccagcctgacgacagagcaagactccgttccaaaaaacaaacaaacaactttctttacaagcaggccctggtcatccctggctgtagtttgctcacccctgcagttaaggtacatctggtaaaggtgatattttagcaaaatgaaattgaaaggtttcaaattatatgttaactcttatcttcaagtcattgagaacattcagcatgaaaacaactagaatttggtatttctctttaaatcatcaatatttttctatcactttcaaatatacttgaagaaagagcaaggacacattttctgaatcatctatctaatagaatagattctattcataaaggaccttttattttaaggaggaaaatcaagaaatgagttctctggtgggggtaaaatgtaggtctgacagatttgccgatcatttaaatccatcattatttcctaaattttagatactaacttgcaaattttgcatatgtatattaaagtgtatcttcttcctaagaagtaggctgggcgttgtggctcacgcctgtaatccagcactttgggaggccgaggtgggcggatcacctgaggtcaggagtttgagaccagcctgaccaacatggtgaaaccccgtctctactaaaaatgcaaaaaattagccaggcgtggtggcacatgcctgtaatcccagctacttgggaggctgaggcaggagaatcacttgaactcgggaggcggaggttgcagtgagctgagatcgcgccattgtactccagcctaggcaacaagagcgaaactctgtctcaaaaaaagaaaaacaagtgaactatattatttttcagagactcagagaggctctcccattgcttggcatttctacttttcatttcctggtgatttccaatggcaaaacttttacatcttccatgaggctgaggcaggagggctgcttgagcccaggagttcaagaccagcctaggcaacatagcgagaccctgtctttaaagacacaaaaaaatttacatccgcaataaagaggacaaccagcctaacatggaagagaacaataagaggacttgacaaaacccttacagaaagaatccttcatgaacggccatcaagagatacaataaaaacacctagcagaatttgactctcaagaacttcaagcaacggaactgctttataaatgacaaaagtcaatttgcaaactcaataataaaaaaaaacataatttaaaatgggcaaaggatctgaacagacatttctccaaagaagatatgcaaatggtcagtaagaacatgaaaagatggctgggcacggtggctcacgcctgtaatcccagcactctgggaggccgaggcgggtggatcacctgaggtaaggagtttgagacgagcctgaccagtatcgtgaaaccccatctttactaaaaatacaaaaattagctgggtgtggtgggggggtactgtagtcccagctactcgggaggctgagggacgagaatcgcttcaacctgggaggcagagattgcagtgagccgagatcgcaccactgcactccagcctaaaagtcaatttgcaaactcaataattaaaaaaaattaatttaaaatggtcaaaggatctgaatatacatttctccaaagaagatatgcaaatggctagtaagaacatgaaaagatgctcaatgtcgttagtcactagggagatgtgaacgaaagccaaaatgagagcccacttcacactacaggatgtgtaaaatcatttataggatggctatactaaaaaaaaaaaagagacaataacaagtgttaaagatgtacagcaaatgaatggttggatacggttggagttaaatgggaagcaactgctaatgggtgagggtttctttttgcggtgatgaaaatatcctaaagttaattgtggtgataatcacacaactttgtgaatatactaaaaaccagtgaactgtatactttaaatgggtaaactgtatctcaagctgctataaaaataaatacaacaaaaaattaatttgcagatttcagaaaagaactaaataggacttccagtaacgaaagacaggcactaaacaattcaatggaaccagcagttaggaaataaaaatttaaaaataccatttacaataggacaaaacacataaagaatgagtctataaaaaaggaggagacttccacaataaaaaatacaaagtagtgctacagaaacgaaagaaatctcaaataaatgaaagcatctaccattttcatggattagaaaatccaatattgctaagatgtcaactccacctaaatccacccgtaaattcaatgtattccaatcaaaattccaagtgaattttttaaagtggaaattgacaagctgattctaagatataaacaaatgcagaggtcctagaatatccaaggtactctcaaataaacacaaagctagaggacttatgcgactagataccaagattagacagttgcagtaattaagacagtctgctattggtgcaaggacagcagagcatccccacagacagccgagtgtgtagctgcgttgcctccttgtctcccagtgataacccaggcgatgttacaaaaatgagtaactacaagagaaactgctaacaaaactgaagacacagaaatgaaatgggaaaagtagcaacactgagtcaaacgtagatggaattagagaagaaacagctgactggaaatgctgacactgttggcctttgtggcactggatgaacggccacaggaactgagtgaggccaaaacttaccaacataattgagccaagtggctgtgatgaaaaggatgaagatgtttcagggaaagcgatgccagcaaaacaacaacaacaacaacaacaacaacaaaacaaaacaaaacttcaccttaaaggaactcttgaagatacttcacaacattgtaattgcaaggatgaaatgttggaagctgatccaaatttggcaaggagtatggcaatttgctaaagcatagaaaagatgctcgccctatcctaagccatgagaaggtggtaagccctatttacaccactcctggtaggatttttacaaataaaaactctaattcccaatgtttctaatgctttaaagtgtacaaatattagttttactattttttaatttccctatacatttataactgacagtgagtgcgtttttaacaaacatttttaaaggtcatagaacaacgtaattttgcagtatcaaaatgactttgtgtggtttcagcttgcacatttttatgatgccattaccatgcaaaacagggctgcctgtttttaaaattagtgagttaaatgtaccacttaagaaattagaaaggccaggcgcagtggctcacgcctgtaatcccagcactttgggaggccgaggtgggtggatcaagaggtcaggagatcgagaccatcctggctaacatggtgaaaacccgcctctactaaaaatacaaaaaattagccgggcgccgtggcaggcgcctgtagtcccagctactcgggaggctgaggcaggagaatggtgtgaacccgggaagcggagcgtgcagtgagccaagatcgcgccactgcactctgtctgcccgggcgacagagcgaaacaatgtctcaaaaaaaaaaagaaattagaaaaagagcagccataagaaaggatgagttcatgtcctttgcagggacatggatgaagctggaaaccatcattctcaggaaactaacacagaacagaaaaccaaacaccgcatgttctcactcctaagtaggagctgaacaatgagaacatggacatagggaggggaacatcacacaccggggcctgttgtggggtgggaggctagggaagggatagcattaggagaaatatctaatgtagatgaccggttaatgggtacagcaaaccaccaaggcacgtgtatatctatgtaacaaacctgcacgttcttcacatgtatcccagaacttaaagtataataaaaaaaagaaatgagaaaaagaataaaagagtcatttcaaagatacatgaaagagagtaaaggagagaccaatgaaatagaaaacaaagacacaatggagagacttgaacaactggttcatgaataatcaagaaaaatatatattctggccaggcgcagtggctcacatctgtaatcccagcactttgggaggctgaggtggcctgatcacttgaggtcaagagttcaagaccagcctgggcaacatgacaaaaccccatctctactaaaaatacaaaacttagccgggcatggtggtgggcacctataaccccagctactcaggaggatgcatcacgagaatcgcttgaacccgggaagcagaggttgcagtgagccgagattgcaccactgcacttcagcctgggcaacagagtgagactctgcctccacaaaaaaaaaaaaaaaaagaaagaaagaaaagaaaaatgttatatattcttttattacttactttatgagaagaatgtcaatgaagaaaattgtcactgtttttaaattctgaaatatttgcgaatgtgtgaagtagaaagagagaggcatccttctagtctttgatacagaagccacaaggcacatcatctcatttcatctaatgacctggaaggcgtggctgtcacctccatggtgagtaaataacccactgccgaaggtgaagtgttgcccggggtcacacaagttaacagcaggaatgtggcaacgtcaccactcccgagcatctcttaggtgccaggtggcatgctatccagcagtctcaggggaaagtgagatgtggcctggccttactgtcctgggtcaaaggatctttcccggactcgcctgggcggggtgagctctgcaacccaggcagcacccatgtccctaccatccctggaggggtaaccacccccacagtccatgctctgcctagcttggctgcaaaaccccttgctggggacatgtgacccaatgtggttgcccatggaggttatctcttaggcccatgtagaaaaaggtgacagctacgtttacccttagggcctatcagccaccctgaggaaaaacactgcactctgcaacccctgaggaagaagtcacccaggaggctactgaggatgaaatgagacaacagaagtgcccggcacgcggtggacacatccggagacccgtgtttctgtatggaagcacgtggcgcaagggcagggaaatacttctaagacggcacaagagcggagcaatacttctaagaagagccacgcccacgctacgcctctgtgatttccactatccttaccccgtaactcctggcgtttatggttggaaccccagtgaaaccaccatttccaaggggactgtgaccgctaatcatgacacctgccagccattcagacactaacgataacctctcatccccttcttgaaaagtcccctgtcagcctgggtgcagtggttcacacctgtaatcccagcactttgggaggccgaggcaggtggattaccttaagtcaggagttcaagactagcctggccagcatggtgaaaccccatctctactacaaaaaaaaaaaatacggccggggatggtggctcacgcctgtaatcccagcactttgggaggccgatgggaagtttttgtttgtttgtttgttttctgacatggagtctcacctcagggcggatcacctgaggttgggagttcgagaccagcctgaccaacatggagaaaccccatctctactgaaagtacaaaaattagccaggcatggtggcgcatgcctgtaatcccagctactcgggagactaaggcaggagaatcgccaggcatggtggtgtatgcatatgtcccatctacaagggaggctgaggtaggaggatggcttgagcccagaagatcgaggctgcaatgagccatgatggcacagcccgggtttcaaggtaagaccctgcctcaaaaaggggggaaaaaaaaaaagaacatactgactggaaaacaaggctagaaagaaagacaaggatgataaagcgtctgccttagagtgctcacatctcgggtgatggtttttaattttctctattccccctgttttcaaccacgagtcagtggctgctgaccagaccattcaggtaccttggcagcgagaaagatgagcaggggaaatgcaccagagtccatggttacaagatatccaaaggcttaaaaaaaaaaacaaaacagcagaaggctgggcacagtggctcatgcctgtaatcccagcactttgggaggctgaggcgggcagatcacgaggtcaagagattgagaccagcctggcaaacatggtgaaacaataccgctcctactaaaaatacaaaaattagctgggcgtggtggtgtgcacctgtagtcgcagctactcaggaggctgaggcaggagaattgcttgaagccgggacacagaggttgcagtgagtcaagatcgcgccactgcactccagcctgggcgacagagcgagacttcgtctcaagaacaaaaacaaaaataaaaaaacaaaaccagcagaaaaaacctacagctaccctaaggccccctaccccacagcccctatttcttcctctgtgcttagatctccccttcccaaatagaaacagactggaaaggatggctgtggtcttctgggggaaaaaagtgggagggccctggaaaaacagcaattatgaagtttttgtttgtttttttttgagatggagtctcactctgttgcccaggctggactgtagtggagcgatcttggctcactgcaaactctgcctcccgggttcaagtgattctcctgtatcagcctctcaagtagctggaattacaggcatgcgccaccatgcctggctaattttttggtattttttttagtacagacaggtttcaccatgttggccaggctaggctcgaactcctgacctcgggtgatccgcccgccttggccttccaaagtgctgggattacaggcctgagccactgtacccggccacaattatgaagtctgaagtatatgcatgctggtaaaaccacacaccagcccacgagggagaaaaacatcactccactcagacacacaaaaaacgcggaagcaccatgtacacccagagcaccgctaacatttctatcagtcctgccctttcactgaaagttgttgaaaacagacctttaataccagagatgccgacgtgggggctgtcaccaggccatctcctaacagccacatcctctctgacctggtgttccttggctcatgcctggggagctttgctagcagctgggtcctgggagtgtgatctaaattgggccgtggggtataaggggctgtgtgctggagctttggggcaaaggttgtcagcacacctgagaagaaattccccttcctgcctttggagacaatggggagagagaggatgtgatggttggagaggcagtggcagccatcctggcaccatgaggaaatgagtatgaggatgagaagacagagagaaggaacctgggtccctagtgatgataaactgacaacctgctgctcctcatgtggaataataaagatgctgattgcttaactcactgttcattgggtattttattttttacttttaggcaaaagcatcctacattattcacacagcagtgagtgagccgatgccaggagagagctaagtgtaagtatccactgctagacatcagaaatggcaccgctgtcacagaggccgaccctcgaggcgcacagaatgaacgttttgaaatgattcatgattttcatgtatgtgataacaccccttcgagttttctcatatgagagttataaagtttcatgatgaagttgtgaataccaaataccaaaacggagtaactagacaataaaatcttcttggaagatgagaaaaatacaatctatctttggtctttttttttttctatgaattgtccatgactcttccatacagggaatttaaacagatacggggtgcctttttagtctgaactgtatcaataaaagaaaaatggagccagtcaaggaagtaactcctcctgagatagcattgtaccatggaattgttcgaaacgagaagaaaaaccagtaactacatgagatagcaagtattaagcaaaaggacagcttgaaactaaataaaacagaaagttatttctgttccctctgaataaaatacatacgcacaagtggctgggcacggtggcacacacctgtaatcctagcattttgagaggcgtaggcgggtgggtcacccgaggtcaggagtttgagaccagcctggccaagatggtgaaaccatgtgtctactaaaaatatgaaaattagccgggtatggtggtgggcacctgtaatcccagttgctcagaaggctgaggcatgagaattgcttgaaccctggaggcagaggctgcagggagccaagatcacgccactgcactccagcctaggtgatggagtgaggttccgtctcaaaaaaacaaaaacaaaaaataccccatagatatatacatgcacatgaaagaaatttcaccatcacaaaatactttcctcactgaaatgaaagttctaagcctgtgttgtttataccaacatcgttgctgtggaaatagctgtttcaacattaggaactcacgactgactcaagtaaggtgtggagcagaagtcttatttaaacagtggcaggacccataaaacattaaaaaggcaaactgggtgtggtgagtcagagcaccatatgttttaatgtaagggtcacacatgttttctttctgatgcatgacaccaataggatgtttctttttattcatgctatttttggaaccctataatcatctcaacgactcccccaaatatcctaggttttgctgtctgcttctgtctacatccggcagcctccgtattttattaaattcattgtgcttagaacagagttactacagttcagtcctcgctggcacatgcaggattatggcaccaaccagggcacaagcaggattttggaaaacttctgcatgtaactgagtctattaaatatagcagtactgggctgggtgaggccagtcatcctagcactttgagaggccaaggcagggggaatcctagaggccaagagttcaagaccaacctggccaacacagagagaccccctaaaatatatataaatatataaatatatttatatatttatatatatacacatatatttatattatgtatattataaatatacataatatatatattataaatatatttatattatatataaatatatatacatacatatttatattataaatatacatatttacattataaatacacatatatttatattataaatacacatatatttataaatatacatatatttatattataaatatatgtatattaatattataaatacatatatatttatatatgtatattatatgtatatttataatatacatatatttatatatgtatattatatatatttttatatatataaataatattatggctgggcgcggtggctcacacctgtaatctcagtactttggtaggctgaggcaggaggatcacctgaggtcaggagttcgagatcagcctggccaacatggcgaaaccccgtctctactaaaaatacaaaaaaattagccaggcgtggtggcgggcatctgtagtctcagctacttaggaggctgaggcaggagaattgcttgaacctgggcagcagaggttgcagtgagccgagatcgtgccactgcactccagcctgggtgacagagcaagactctgtctcaataaaataaaataaaataaaataaaataaaataaaataaaataaaaaattaaaaaatacatagatcgctttctcgcagtactgacttattcactaacaaggcatcacttccagcatatggtctaccgtgtgcctatggctttatacggagactgtgaggacccagatcgcctctgcacccaacagcccagctcctcaactccactgtcaggcctctcatttgtccctgtcttttatgggtcagttaagagcttcccaaacaatcctaaaaaccctcaggccaaccccatcgagaaaccatgtgacttgcccgcaccttcccttggtgatgcccccactcctctgcttccccttcctacttcttaactggacatggatgcacttttctttaaatacgcacacactttaccatgattttcctccggttaagccagaaattttaccctttgtacaataaaacatattcaacaagttttttaaatgagagtgctgtgtggggccgttttaaaagcccacctttccctaacccccgacagtgaagtgttctataaacagaagcccagatcccctcggcagcgggcactgcccagggtgtaaccgccctctctgcctgcacaggagagcgattcataccagcagaaccggaaaaatcacagctgaaagcaaccagggaagaggcaagggccaagagagcaatgtaaaggagtcggattttctactaggtgagtcacaggaaacactctggccacagcccgaggccccaggaggcccggctcgcccatcaggaatgtaggtcaaactcccagcgggaagggtgagagcccaggcacccagggcaaaagctcaagttcctaggagaacagggaggctggccagaaaacaaggcctccactcgccctccggcaccagtcccagcccaccctacgactaagcatcaatttccacagaccgcggtgaagtagaaccacagcatgctggcccagatctctcctctgttctggactgggccatcccacgcgtttctcttggggttcacaggatgacaagtggggtttatgtataaagggacagatcgctcacccagttcagttgacacgggggacccagtggcaatctcaccgatcttggccactccatcgtagtaggcttttcctgccaggatcatagctagacacaaaaggtgacacacaaaatcgtcacttagacaaggaaaggaggaagcaacacaagttttcttccaaacaccccctggtcccttctggctgcaggaaggtttgggctgtggcaggtgtggctctcaggaggtaagacctgtgttgagagtggtgccggggtggaggccctccagccaagggacagccccatgagatcctcgtctctgaccagccccggggaaccttcagcagcaggtgctgaaagtccagagaaggctcagcttgctcctgatgccagtttcagagtggatgcgttcctaacgttgaactagggctttgcctgggcacggtggctcacacctgtaatcccagccctttgggaggctgaggtgggaggagtttgagaccagcctgggcaacatggtaaaaccccgcctctacaaaaaaaaaaaaaaatacataaattagccaggcatggtggagtgtgcctgcagtcccagctacttgggaggctgaggtgagaggatcgcttgagcccaggaggcggaggttgcaagtgagccgagatcatgacactgcattctactctgggtgacacagccagatattgtctcaaaaataaatataaaaaaagaagatacatcctctccagccagaaatcttttctgagctagttcttctccagcactccaggtctgcaacattcttagttaggagttgtgtgaggtggactaggagcctggtcctttgatggcagtgcttaatttttctattgaaaaaggcattttgagccacaaccaaccaacctatttgttgccaggagagaatatatgaaatttgaaatatattatcattccaaaaagcaacacaattgtctgaaaaaataactgaatgctctactttttcttttttggcaaagacaagaaaacttttattgctacaaggtgggttctaattatcttaaaaatagtactgcccccttcgaactgattctgaagactaaattataactatgtaacctccaggggcaaattacttaccctttctgaaacaaaggttgctcatccttaaaatgccctaagaatgtgagtgacagatgaacaaatggaagctgctaatacacttttttcactttacaatctaggtttgagggtattgaagatgtatgatagagacccagcctggttagtgtaattttggagaaaagcatttatttggaattttactctaagattggtttcagacatagaaatcagtttctcctggagctttggagaccacacagttttggagctaaaagagccctcgggaatcccagaggctataccagctgcaatgccgcaatgtataatgggcaattgttttaacaaggtggattttattttattttatttttttagaggcagagtcttgttctttcacccaggctggagtgcagtggcaagatcatggctcactgcagccttgacctcctgggctcaaaggatccttctgcctcagcctcccaagtagctgggactacaggcacgtgccaccattcctggctaattaaaaaaaaaaaaaaaaaaaaaattgaaggggctgggtgcagtggcttacacctgtactcctagcattttgcgaggctgaggtaggaggatcacttgagcccaagagtttgagaccagcctgggcaacataaggagacccccccatatctctactgaaaacaaacaaaaaaaactagccaggcatggtggtggtggcacacgcctatagtagtcccagctactcaggaagctaaggtgggagaattgcgtgagcccagaaggtcaagactgcagtgaaccacaactgtaccactgtactccagcgtgggcaagagtgaggcccctgtctcaaaaaaaaaaaaaaaaaaaaaaaaaaatatatatatatatatatatatatatatatttttttttttttttttttaagagtaggggtctcactctgttgcccaggctggtcttgaactcctgggttcaagggatcctcttgcctgagtcacccaaagtgtttggattatagttgtgagccacagaattaattcatgtgcaggtccagctgaaggtatgaaaagccaaaacagtagtatattttttctggcacattaatctactttaggatttattgtagagttaaaaatttatagccaggtgctgtggctcacacctgtgatcccagtactttgggaggctgaggcaggaggatcacgaggtcaagagattaagaccgtcctggccaacatggtgaaatcccgtctccactaaaaatacaaaaattagccgggcatggtggcacatgcttgtaatcccagctattcgggaggctgaggcaggagaatcgcttgaactcgggaggcagaggttacagtgagctgagattgcgccactgcactccagcctggcgacaaagtgagactcagtctcaaaaaaaaaaaaaaaaagtacatatatatttatatatatataaaagttatggtttttaccatatacatatccaactttaggaaatgcaatattctatctactgcactattataagactcagaacaaccttaaagtgtaaatgtaaaaagaacaatagcaattagcatttatatacatacttagttaatctatccaattatgttgagacacagtccgtaatgtcatcagcccgttgcgctaagggcagcggagtggagatattctgggacatacccaaggtcaatgttgagtcagcgggaaggcacacagctctggctgggcacttcacttcctcagctctaaattatggtgctttctgattctttggtctcgtctagaactaagaaagaagtgactccacctaaaaacaaggtgtgtagccaggaaactgtcaagttgtaagatggaacatcttagtatgaagatgttaagttgtaaagtactgatcatctgaaaagcaaattagtgcgggaatggaatgcaggattacacaatatttaagcaaaatgtttggtttgcatccacacatgaaatcacaatttttcattaattgttgacttacattgaaaaccatgtaaccttctcggtcttgtaaaatatctttgctatgatgataaagttaaattaacttgaaaattataaaatttagccagaagagataaataatactttcataattttgcctcccttttgtgagcacattaagatattttctactacttattgttttaaggaaagaagcatattagttttttgtttttttttttttaagagtcagcgtctcactctgttgcccacactggagtgcagtggtgtgatcatagctcactgcagcctccacctcctggactcaagccatcctcccacctcagcctcctgagtaactgggactacaggtgcacgccaccacacctagctaattttttattttttctagaaatagggtctcactatgttgcccaggctggtcttgaactcctgggctcaagcgatcctcccacctcagcctcccaaagtgctggcattacaggcataagccaccatacctagcatagttctattttagtggttggccaactacttcatcagtctagaccaatctatgtacttctacttgataatttttccttaaaatatggtttcattgggtgaacattctgctcaaagcctttggtgtcctcccactgcccatgaggtaaggtcacacaccccagagcccgtagtagatttttacagtaatggccttccaggaatcacacctcccggaattcccagcgtatgtggtcccctaccaggtggtgtggccatgggacctgctttgacccacgggttatcagcaagcatgactcctgcagggacttgagaggtgctgggcactggggcttatactcttaggacaccactgctactgagtgaggacagagtctggcctccttgaaggggaaagaccccattgcagggctgcatccagcccacagccccacacgggccgcagaagactgcaggtgcaggagtgagcccggagggtctggagaactgccctgccttataggagaaataagaaactgttgctattcaagtgcacagtgatctgaccctatcccgcccacgccccagcagtgtgccacccatgccagtgtggaccccaggtcctggcttacttgctgtcttttttttttttttttttgagacagagtcttgctctgtcactaggctggagtgcaatggcacgatctctgctcactgcaacctttacctcccgggttcaagtgattctcctgcctcagcctcctgagtaggtgggattacaggcacccgccaccacgcctggctaatttttgtatctttagcagagacggggtttcaccatgttggccagcctggtctcaatctcttgacctcgtgatccgcccgcttcggcctcccagtgtgctgggattacaggcgtgagccatcgcgcccggccgacttgctgtcttttatgcgtgcagtagtgtctgcctgctgaaacctaacatctggcagatagctcatctcctgcagggcctcctccctgttccaggccacaccaacccacaccactcaaattcttgtgacactggtctgtacaatgctcctagccattcacctgtagacctgggtttttttttttttttttttttttaatttttttgagacagggtcttgctctgtctcctaggctggagtgcagtggtacaatcacagctcattgcagcctcgaacttctggactcaagcaatcctcccaccccaggctcctgataggtaggaccacaggagcatgccaccatgcccagctaatttttttttttttctgaggccgagtctcactctgttgcccaggctggagtgcagtggcatgatcttggctcattgcaacctctgcctcccgggttcaagtgattctcctgcctcagcctcccacgtagttgggatcacaggcacgtgccaccactcccggctaaattttgtatttttagtagagacagggatttaccattttggccaggctggtttcgaacttctgacctcaggtgatctgcccacctcggcctcccaaattgctgagattacaggcgtgaaccaccgcgcctggcctgagctaatttttaaattttttttgtagtgacggggtctcgaattcctgggctaaagctatcctcctgtctcagactcccaaagtgctggaattacaggcacgagccaccacgcccagcctgccttgtgttctaacgtaactgtggactgcacacctggcagcctcaactatttccaaattctcaccaaggactttacacatttacctacatttctcaatggcttcagcaaaggcacaaccagatggcctgcagaaattctggaaataccttctgaagtatttactccccaggaggtgctaaagtgtcaagagccctttggggagaagccttgttagcaggaagctaagctgtaggcagctcactggctcaccttgtaaaactctgcagctcatgctagaaagaaaaaaaaaaaaagaggcagctcatgctagaaagaaaaaaaaactgcaggtcacagtgatttccttcacaaggacatctaaagcaatgactttgtggccttgtgactaagcaatcttcgagggagagtcagcagtgcacagctctggctttctggaggacaggggcacttgcagaagtcacggggaccactggagggcaagggagcaaaatcccagacctgctgcatttcctgctgctgaaatctccgaaagcacagcaaggcagaagagtaaatgagcagtatacttttccagcgactacacacaatggtgctcctcctcacccagagtccacagtctagccagctcacaccctttcctggggcaggttcatgctgagcgagagtgaggccacaggtttattttcaaaatatcaacagggagcaaccagtatggcaaaaaagataagaggctgggtgtggtggcttaagtttataatcctagcactttgggaggctgaggggagtggattacctgaggtcaggagttcgagaccagcctggccaacatggtgaaaccccatctctactaaaaatacaaaaattagctgggcatggtggtgtacacctataatcccagctacttgggaggctgaggcagaagaatcgcttgagcctgggaggcagaggttgcagtgagccgagattgttccactgcactccagcctgggcgacagagcaagactctgtctgggaaaaaaaaaaagaaagaaagaaagaaagaagagataagaagatgtaaaacttgatctgaagctgccttcaaatctgtcagaaactacatttctacttatgttacttggtgacaaaagtagagcggtgggagagggtgaaactggggtctgagtgttttggggtgatacttgctacattttggggaagaactgtcttgcccatgttagaatttggtgattgctagcgtttttaaggtgatcactgatgcattttaatcacaaagacaggccaatagcaatactcaagttcattttaaatgaagcatatattttgaaatgagaacctaagtccaactgtttaatttagatgtttttccattcaggctaaaaaaaatttcttcttttttttcttttttgagacagacccttactctgttgctcaggctggggtgcagtggcactatcacagctcattacagcctcagcctcccaggcacaagcgatcatcccgccacacactcctgagtagctgggactacaggcgcgcaccaccacgtgcagctaatttcattcaagctaaaaatattgtttctcatgtaactatcaaaagtgacacatcggggaaaaaaagatgaaaaaagtgatacatctaaagacaagaaattcttttatatacataaaaggagaataatttctgtgctgtaggaccctaacttataaatgtctcatgtacacattttatatttgttagtttaccaagaatttggttttaaaagtagaaagcacggttttatagttaaaagacatcacttagagtaccctcactttcattcaattgacttgtttcaaatacgctaatatcattgtgtactgtcattgcaaagttctgtagattaaattcattgtgaacaatttttaaccacttaaaggtatttaaaaattcaatactaagcatttaaaaataattacatatttactgagtggctttatatataatcaattcagaaaaacagacttaccgtttacagctttctcataatttttccccaggtttattaaatttcgcagcccaggattgaactgttccataacattctgccaaacaaacaaaacacacaaattaataaaataaaaaataaaccaagtcatcttcagattttgtcactgtgtggcccaggatagctatggatgcctaacagcacagtctacaaagtaatgaatgctgatgtaaaaataatgaagcacacctattcccttacctgatggaacagggctcacaggtggcaaggtgcccgtaaccctggcagttctcagttgcccaagaggctgcctggaatctgctataagcggagcaggcagcagtcattcatgtctctaccataccctgcagggactgtaggcctggcatcctcttgggtttgagtggattgctaatggttctcattctagtgttaaggaacgcctgtggaggatcagctacctgtacttacttacaaaggcaatgtttcaaatagatttcgatgaatttctatccactgaatagaaatttccaggagattttgtttttactctgcctaattataggggtgtgggcggggagggacgtgaaagggggcattggtagcatgttgctgatggccccaggacacaggcctgcctggaaacttctggatgtccctggcattttttctttttttttttttttttttttttttgagacggagtctcactctgtcatccaggctggagtacagtggcacgatctcagctcactgcaacctccgcctactaggttcaagcaattctcctgcccctgcctcccgagtagctgggattacaggagcccaccaccacacccagctaatttttatatttttagtagaggcggggtttcaccatgttggccaggctggtctcgaactcctgacctcaggttatccgcgtaccttggcctcccaaaatgctgggattacaggcacgagccactgcgccctgcctccctggcattttcccactgattggtttattcaccaaagttgtgtggagtaactaccatgggccagaccctgtgcacacagctaaggattagaaggcacagtttccctctcatggatttcatggtgcagccagtgtccaggtttcatttcaacacgtgttattcctgtatcagcagaaagtcataaagacaaatgctaggacaagtataagacaaataactatttaggacgtgggtctaaattttaaaataccctaactttgaagtacagacaataagtcattcctacggtactcagacttcacgactcacaacacgtggcgattgttatgtgtttgttccatctaggaacaataagcttcatgatattaatcaccccaaagagaccattcaagtctcaccgaccccttccccaaatgcatgctccatttatatagacgaccagatgcaaaaaagaatgaacaactacccaacattcaaagaggcaggtgctttacacacatacccttcagaataaatgaatcaggaggagagagagaataggacgactcttgtttttaatcaaactgtgataacaatgaaaaacaacccatgcctcgacctttccatagccctggtcttatgcccgagagcactttcaactatgctcctatttttgtatttattgctgcagttttgaatattctttttttttttaaatattcttgatttcttgattttggggagtaactgcagcttcctacgacagcagatgaggcctcaggtctctatacctctcactcttcctttccaatggactttctatgcaattagatggcaatttgctgatgaaactatagtcagtgttcattatgactttgcactaaggctgatggttccctttctcagtaaagcctggctgtttttcctgggatggacaattgtttctttccgccccgccacctttgcttagttttctgtttatctaccttaaacttgtccccatgctgtattagacttggctgaggcctatcagtgttatttttcaaatgtacaaaactctcagctaatctcctgttccgtttttcccttgacttcctctaaggactctccaccatcttgctcagtgtggcttgactgtcacgattgccctagcatggccctcctggtggcctgtggcagcgctcttgtcagccaggtaggtccacgtcttcctatttctccaaaatggagatcacattccaaaaatgatctaagaactaatgcgtgagaggtaaatctgagtccccgtgtgtctgaaattatctttaccttgacgtttgctattttgctgagtagagcagagtagattgaaactattttccttagaatttttaagacatcacttggtcaggcgtgatggctcatgcttgtaatcccagaactttgggaggctgaagtgggaggatcaccacttgagcccaggagtttgcgaccaacctggacaacatatcgagactcccatcgctacaaaaaataaaaacaattagccaagggtggtggcttgtggctgtggtcccagctacttgggaggctgaggtgagaggatcacttgagcccaggagtttgaggctgcagttagttgtgactgcaccacttcactccaatttgggtgacagagtgaggatatgtctcaaaaaaaaaaaaaaaaaaaaaaaaaaaaaaaaagagctattactccactgtctttagcatctgggtctgctgaagtcagctgccatttcttcctatgtgacttttttttaaagcttatttctggaagccttctctttattcctgtgttctgaaattgcaccatggtctgtcccagcattttttttgtttgtttttcatttattttaccggacactcagtgggacccctagccatgtggaaaattatgtccttcaggtacaaatatcattcctgttttatttcttgtctcttcattctttctggaactctgatgaagattttatatatcctggatttattctctaatcttttttgattttccactttcagtagttttgttctataacgctaacagatatcctcaactttatgttccaattctattttttgaatttgatatatcttaatttctaagagcatgttcatgtttcttgattgctctttttgttttggtttggtttttgagatggagtttcactccgttgcccaggatggagtgcagtggtgtgatcctggctcactacaacctcggcctcccaggctcaagtgatcctcgtgccccaacctcccaagtagctgcggggggtggatcacaggcatgcgccaccacgcctggctaattttttgtatttttggtagagacagggttttgccatgttgcccagactggtctaaaactcctgagctcaagcaatctgcccgccctggcctcccaaagtgctgggattacaggtgtgagccaccacgcccagccttttgattgcttctttttaaaagtactctcctgttcttgttttatagatgcagtatcttctcctgtctgaattttttggtgtgttttattctagttcccgtatcatctcctgattacctttcactgtttgatatccctgtctttcatgttagagactctcctcaaacgtgtggtgatccctgatggccagtttgtattgaggcgtgcagcccgtcactgccggctggaagctgtgggtgtgtgcacagggtagtggctgacttgctggcttcattccaagccaatggccactctacagtcatcaggggccactgggcttctgctgagaagtttctaatttcctgtcattgggtgggggacaatcatcggatggtcagctttcgcagtcaggaagggggccgggactggacagtttggagctgattttcaggaactcctctgttttcagctcagagttctgcctcctccacccttggctgctgtttccaagtctagagcacctcagattatcctgaggttaaatctctgctctgccagagggagctgctggtggtggtggctggggtagggaagggaagccaggagctccgccaccctgtgcaccagactccgattcctgcccccaccttctgcggcccagtcctcagcctctggggcccctggggtgaatggctcagtttccatcagactcctttccccaggttcttcaggctctctgaggtcactgagcactctctgtccatttcctatcaccccagatttctttaggtctcttgtcaatggatgttttccaggtctttttgcactgtggatttattgggtattgtttttaattcctttgccatcattttaatgggttctcaaaaggaagaaaataaaatacacaaggtgcctctcccatgcctgcctggaagcccgctcacctggtatcactagacgcagtcaggtgcttggcacctacgcgcaaccagtggccaggaagccccagagccagccaactcccccacgatcctctctacaagatggcaaagcctcattacgtagccacagctgctctttttctttgctttgctttttttcttttcttccctccatcccttcttccctcctttcttccttcttctctttctgagacagggttttgatctgtcacacaggctggcgtgcagtggcatgatcaccacacactgtagccccaaactcttgggctcaagtgatcctcctgcttcagcttcccgagtagctgggaggtgtgtgccaccatgcccaggtaattaaattttttttttttttttaagagacagggtcttgctatgttgtccaggctggtctgtccacagctgttatttctgtcatctcttctcaattcttttgttttggagcttctttgaaatagtttaagactcataagagttgtaaaaataatacacagagttcccaggtatgcttcctgcaatggtatcttctataaccatagtatattatcaaacccaggaaactgtcactgctacagttctattaactcaactacagaccttatttggattttcccactttttgtatcactcatttttgggggaaggtttcatcatttcttttttctttgtttgagacagagtcttgctctgttgcccaggttggagtgcagtggtacgatctcagctcactgcaacctctgcctccccggttcaagcaattctcctgcctcagcctcttgagtagatgggattataggcgcgcaccaccacacctggctttttttttttttttttgtgagacggagtctcgctctgtcgcccaggctagagtgcagtgacgcaatctcggctcactgcaagctctgcctctggggttcacgtcattctcctgcctcagcctcccgagtagctgggactacaggcacccaccaccacgcccggctaattttttgtatttttagtagagacgggtttcactgttagccaggatggtctcgatttcctgaccttgtgatccactgcggccagcccaatttttgcatttttaatagagatggggtttcgccatgttggtcaggctggtcttgaactcccgacctcagatggtccacctgcctcggcctcccaaagtgctgggattacaggcgtgagccaccacgcttggccgggtttcatcatttctatgaaattttatcatacatgtaggttgccacgaccatcaccgcaagtaaaatacggaactgttccactaacacacacgcctcttttgtgctgccacttaataatcatgccctcctcctcaccaatcctcacctctggcaattcctgagctcaatctatgattctgtcattgtgagaatgttatataaaaggaatcatggccgggtgcagtggctcatgcctgtaatcccagcattttgggaggccaagttgggcagatcacctgaggtcaggagttcaagaccagcctggccaacatggtgaaaccctgtctctactaaaaaatacaaaaattagcgggcgtggtggcgtttgcctgtaatcccagctgctcaggaggctgaggccggagaattgcttgaatctgggaggcagaggttgcagtgagctgagaccgtgccattgcactccagcctgggtgacagagtgagactccatctcaaaaacaaaacaaaacaaaacaaaagaatcatgggaggccgaggcgggtggatcacaaggtcagaagatcgacaccattctggccaacatggtgaaaccccgcctctactaaaaatacatgaattagctgggtgtggtggtgcgtgcttgtaatcccagctacttggggggctgaggcaggagaatcatttgaacctaggaggcggaggttgcattgagtcgagatcgcaccactgcactctagcctggtgacagagcaagactctgtctcaaaaaaataacaaaaaaggaatcgtatcgtatgtggcattttaagatttgcccttttcacccagcacaatgccttaagatgtatccaagttgttggatgtagtttatcactttttattttttttttttggctagtagcattccatggtatggatatattgcagtttgtttatccacatacttgttgaagacctggcttgtttccaggttttgacaattccaagcaaagctgctatgagcgatcgcatacaggtttttatgtgagcttacgttttcgtatctctaggataacctgggggttcaatggctgcgtcacatggtaggcacgtgtttaactttttaagaaactgccaaactttttttttttttttttcagaacagctgcaccattttactttcccattagcactcggagatttcactcattttcaaaatctgataatttcattagcacacagctactttctaattaaaagacaaaactattttaaagttactgaaaattattacaggccatgcgtggtgactcatgcctgtaatcccaagcactttgggaggccgagggaggtgggctgtttgagcccaggaattcgagactagcctgggcaacgtggtgaaaccccatctctaccaaaaatacaaaaatttgctgggcacggcggtgggtgcctgtagtcccagctactcaggaggctgaggtaggtgaatcgcttgaactcaagagacggaggtagcagtgagatcgtgccgctgcactccagcctgggcgataaagcgagaccctgtcttgaaaaataaaaaattcatatgatattcttatgaggctgggtgtaggtaaaaatataagaaaactgacagagagccgaccctgcccaataacatatgagcaccacagaaagcagcccagatctgttctttcctgcggatattccttctccaaatacaataggaggaaagtctcatttgatttcctaattttttttttttttttttttttttttgagctagagctttgctctgtcgcccaggctggagtgcaatggtgccatctcggctcactgcaacctccacctcctgggttcacgcaactcttgtgcctccgcctcccaagtaactgggattacagatgcctgctaccacacccagctaatttttgtttttttagtagagatggtgtttcaccgtgttgcccaggctggttttgaactcctgaccgcaagtgattcatccgcctcagcctcccaaagtgctgggattacaggcatgagccatcatacccaaccaatttcctgatataattcttaaaatgttcacatataaccctaacatcttaaaatacgaagaacaacaaatgaatgagaacttccacagttaacaccatacacaaatccctatccaaatgattctaccagagggggaaaaaaaaaagttcaactaagacttgagactaggctgggcgcagtggctcacaaggtcaagagatcgagaccatcctggctaatgtggcgaaaccccatctctactaaaaacacaaaaattagccaggcatggtggcgggtgcttgtagtcctagctattcaggaggctgagacaagagaattccttgaacccgggacgcggggttgcagtgagctgagattgcgccactgcactccagcctggcaacagagtaaggctccgtctcaaaaaaaaaaaaaaaaaaagatttgcaactacagtttgtagtcaatactgagtttttaagcttgaaaagttcaacatatatacttctttattactgtacgtaggttcagctacagaaatgttccctcccagaaattttggctttttttttgagacagagtctcgcactgtcgcccagggagtgcagtggcgcgatctcggctcactgcaagctccgcctcctgggttcacgccattctcctgcctcagccccctgagtagctgggactacaggcgcccgccaccatgcccagctaattttttgtatttttagtagagacggggtttcaccatgttagccaggatggtctcgatctcctgacctcatgatccgtccgcctcggcctcccaaagtgctgggattacaggtgtgagccaccgcgcctggccaattttggtctttctaacagtggaaaatccattcctatattggctcttcacctagttattttagctgaagtacatgttatttttaaacccagggacaaaaaaagcaatgctgcctttgtattccagaatctataaagttttatagtagttgtggacacacttgtgaatagaaagggtcccacattttgggggagagctgtagttgaggcaaaggtcggtgctactgcaaggcttgtgaagacctgaattgttaaacagcctacaatgttaagagtcatcaggagtaatgaacaaatccattttaatttaagtttggcactaagaattaaagggcttaggataccaagtgaatcttaacaaagtgaacagaaaaattataaatgggccaagcagcactgttactaagaaaaaaaaatagcaatagcttagtctatatctctatcgattactgcctggcaaggatactctgccaaactggttttaaccagaatgagtttcatttccatccagggaagggcatgcatagttatggttgcacaatacattctaggctaatggtaatatcactcttctacttgtgctgagtcgcataaaaagaagcttggttctaccgcaaaaccttagcggtactggaaaattagtgattagctattctaaataaaatgttggagaacagttccgctggaaccagcacacactattcaccagatttctagctgccctgtttacctcggcatttctactgcctctgtaaagttacagatcataattatgaattaagaataattatgagaaatgaatgatgcaatcttatgacggttttaacttccttagcatatggactttttataactcattttcaaagaattaccagtatggaactatacataaattaactgtgtacatttataataaagtatacattaattcaattatgactagccagataagctgagtggactttaaacttttaaaaattagtttctcttttagtttctttttttttttttctgagacggagtctcgctctgtcacccaggctgtagtgcagtggcgcaatctcggctcactgcaagctccgcctcccgggttcacaccgttctcctgcctcagcctcccgagtagctgagactacagatgcccgccactgcacctggctagttttttgtatttttagagagacggggtttcaccagtgttagccaggatggtctcgatctcctgatctcgtgatccacctgcctccgcctcccaaagtgctgggattacaggcgtgagccatcgcgcccggccctcttttagtttcttttagtagttctgtataggccgggtgtgttggctcacgtctgtaagcccagcactttgggaggcaaggcggtcggatcacctgaggtcaggagttcgagaccaacctgggcaacatagtgaaaccccctccctactaaaaatacaaaaattagctgggcatggggacgggcgcctgtagtcccagctactcagcaggctgaggcaggagaattgcttgaatccaggaggtggaggttgcagtgagctgagatggcgtcactgctctgcagcctgggtgacagaacgaaactcagtctcaaaaaaacaaaacaaaacaaaaattctctatatgaacaaggacaaattatttgatattttagtgctttgtttttctcagctaaaagtgtaacatttatgataaataagcattaaaagtggtttaagaatctctaagtaaatatgcagttctgtggcttgtaacgtatgtatccttgaaattttatatattattttattctatactatctcatacaaattaaccgagtgacatcacaaatgttcaaaccaatcaaggtacatgctaatgtcatgtagcaaaaatagctgtaatgagggttaactgaggatatgtcaagatcgattttggtttttttttttttttttttttttgagacacagtctcgctctgtctcccaggctggaatgtagtggccagtggcctgatctcggctcactgcaacctctgcctcctgagttcaagcggttttcgtgcctaaggagtaggtgggattacaggcacccaccaccacgcccagctaatttttgtattcttggtagagatggggtttcgccatgttggccaggctggtctcgagctcctgacctcaggtgatctggccgccttggcctcccaaagtgctgggactacaggtgcgagccagcacgcccggtcaagatcaattttatttgtaggaaatcttgcttccttcttccttaagtgttgctggaagctgctgttcctggactaacatcaccaatacttgatcacctgctcttcctttagggaaagtattagtaagcaaatctggcaaggagacagctgcctgtgggctaacagatggtcacaagagtcatgctgttcatacccatcatgaatttggagcacaagccaagtacagaaaaattagacaactgagatgtttcctttgaggtattgagttagatcagaaatactcattgaaatatataaacccacaaaaatgctttttgttggtcaaatatgagtaatgttttggttacctattggtctatattagctattatattagctatcttgcattatgtattagtttgcattatctgtaacttataagatgccatctcaatagcaatgggcctggaaggtgtggggaacttggcagaaagaaaatttggccttgaattcttgggcaaatcacatcaccacctctgtgagcctctagaaagcctgagtctcttcctgtctacaatgggaatcatgatactttctagctcatgaggggcatgaggattcagtgaggcagcttaacattatggagtgcttatcatgtactctgcaagcacttgatactcagtacacactgaaccaactgtagtaattaatattctaagagaaaagctctaaaatatgagtcaagtctccaaacagaggaacactcctatttacacaggtatctccaggaacctccacttcctgttaactggtatcagctcttccaccctggtgtcatcatcaggacgagggagatcatgaacacagaacctctggagaagggtacgggacaaaggacattgaaggtgttatgatcttctgctttattcagttgagaacatttatttattttgagatagggtcttgctgtgttgcccaggctggagtatagaggcaagaacatggtttactgcagccttgacctcctgagatcaagcactcctcccacctcagcctccgagtaggtgggactacagacgcaaaccatatccgactaatttttggattttttgtagagatggggtcttgctatgttgcccaggctggccttgaactcctggactcaagcaatcctcctacctcagcctcccaaagtgctgggattacaggtgtgagccaccacatctggccctagaacatttatgtcattaattttttccatttgaggcacattttaacatttacagagggctactatgaatccggctctatgtctaacattttacatggattgtctcaactgatcctaacatcgtggctgttattaatcccacttgatagacaagataccaaagctttgaaatgttgcattttaaaaccctgctgaaggtcctaccagcagcgagaggtggggtggagtcagctccaggcagtttccctactgtcctttgccttaggcctcaatagttccttcaaatgaatggtgaaaaaaagtgagatgaaaatgcattttatgagatcagagcactgacatattttagtatgagtgattgtaggtgtctctatagtacttttttttttctttttagaagctttcttataatcttactcctgatttttggtgaatataattaatctaatagcataatgtcgagcaattctgcctgggcaaatacgtctgaccctctctctcttctttcccataaaaaaaataaaataaaatggaagaaagaaaaaggtgaatctggccaggcatcgtggctaatgcctgtaattccagcactttgggaggccaaggtgggaggatcgcttgaggtcaggggttcaagaccagcctaagcaacatagcaaaaccctgtctctaccaaaaattcaaaaaattagctgggcgtagcagtgtgtacctgtggtcctggctacttgggaggctgagggaggagaagtgcttgaccccaggaggcggaggtttcaatgagccgagattgtgccattgcactccagcttgggtgacacagtgagaccctgtctcaaaaaaaacaaaaaacaaaaacaaaaaggccaggcgtggtggctcaccccataatcccagcactttgggaggctgaggcaggtggatcacgaggtcaggagtccaagaccagcctggccaacatagtgaaaccccatctctactaaaaataacaaaacttagttgggcctggtggtgagagcctgtaatcccagctactcgggaggctgaagcaggaaaatcacttgaacctgggaggcggaggttgcagtgagccgacatccggccactgcactccagcccaggcgacagtacaacactccatcttaaaaaaaaaaaaaaaatttgtgagagtgtagaatccacaaccacctgtagtccccacaagaattactaacagttggccaggcgcagtggctcatgcctataatcccagcactttgggaggccgaggctggcagatcacctgaggtaaggagttcgagaccagcctgaccaatatggagaaaccccatctctactaaaaatataaaattagccaggcatggtggcaggcacctataatctcagctactcgggaggccgaggcaggagaatcgcttgaatctgggaggcggaggttgcggtgatcacacccccgcactccagcctgggcgacaaaagcgaaagtccatctcaaaaaaaaaaaaaaaaaaaagaaaagaaaaaaaattactaacagttaacagtcacactggttccctttgctgaaaaagcactaaagcactagagataaaaggacaggatgccttagtcaccccatccaagtctcataccctttcttttctcccctgggggagccactaattcagactgctgttaaatatctagccgatattttatattttcacacacacgtatatatttagtcaagattaacataaaattttgctttgtgtgttaaaaaatacttacataaatccttaaatggtatcacataatacatttcactcttacatcttatttctttattcagtgttatacttctgagatctgctcaccttggtctgtactgaccaaggttcttcctatttaacttctacacggtatccctttatgatggtttaagtgtccacgtagcaaagctacagtattcagtcaattaaacactaatctaggctaggcacgggagctcatacctgtaatcccagcactttggggggctgaggcaggaggactgcttgagtccaggagttgagaacagcctgggcaacatagtgagaccccgtctctaccaaaaacaacaaaaaaaattagccaggtggggtggcatggcgtgtgcttgtggtcccagctacttagaggctgagatgggagaattgcttgagccagagaggtcgaggtcacagcgagccacgatcacacaaccatactccaacctgagcaaggcagagggagaccttgtctcaaaaaacaaaacaaaaccaacccattggctgggagcggtggctcaagcctgtaatcccagcactttgggaggccgaggcaggcagaacacctgaggtcaggagttcgagaccagcctgaccaacatggagaaaccccatctttacaaaaaaaaaaaaaaaaaacacacaaaaagctgggtgtggtggcgcatgcctgtaatctcagctactcggggggctgaggcaggagaatcacttgaacccgggaggtgcaggttgcggtgagctgagattatgccatcgcactccagcctaggcaacaagaacaaaactccatctcaaacaacaacaaaccaacccactaatctaacacggtgttgtctaaacacagcgttgctatgaaggtattttgtagatatggtcaacatctacactacaacttttatttaaagttgactttaaataaaagagattatcttcaataatcagggtgggtgtaatctaatcagtcaaaagcctgaggacaaattgaggtttccctaaggaagaagatattctgcttaagggctacagagtcagctcccaggctgccctacagatcttggactagtcagccccacaatcatggaagccaatttcttgaaataaatcttttcacttatatatagatatacatatacatacatatcccatcatgtaaagagactgcattttacccatctatttcttgactgacaggcatttacatggcttacgagcttctgctaatgacgacgacgtggtagggaatgatacatgtctccttgtacatacaggtaagaatttacccagaaacagaactgcagagacacagggtatgtgacatatttctccattttgttagatactcccaaatttgaagacagcaactgtagccatttccatgcctgaaaccaccgtgtcaaagtgctgttttgccatgttctccccaacacttggtactgtcatactttttgcctgtttgataggcaaacaatagtatcttttaaaaagtaccatacactaggccaggcccggtggctcacgcctgtaatcccagcactttgggagaccaaggcgggtggatcaccagaggtcaggagttcgagatcagcctggctaacatggtgaaaccccatttctattaaatatacaaaattagctgggtgtggtggcacgcgcctgtaatcccagctactcaggaggctgaggcaggagaatcacttaaacttcaggaggcagaggctgcagtgagccagtatctcaccactgactctccagcctgggcgacagagtgagactcaatctcaaaaaaaaaaaaaaaaaaaaaaaaaaggccaggtgtggtggctcacacctgtaattccagcactttgggaggccgagacgggcggatcacctgaggtcaggagttcgagaccagcctggccaacacatagtgaaaccccatctctactaaaaaaaaaaaatacaaaaattagctgggcatagtggcgcatgcctgtagttccagctacaggctgagaactgtgggaagctgagacaggagaatcgcttgaacctaggaggcggcagttgcagtgagctgggattgtgccattgcactccagcctgggtgacagagtaagactctgtctctcaaaaaacaaaaataaaaacaaaaacgaacaaaaaaaaaagtaccatacactatttctcatcagcattaaaaaataacacgactggaaatagctaagcatggggagagaaatgatgaaaggtagtttcctggtgtgttttagcctcagttctcgtgtccatcataagtgaatgtcatcagtgacttctgtccttttaacacagggtgggaagaggcattgaaagccgggacattccctgcagctgcatgctccacctgggtttgggctgaggcacactggcctccgggctgttctccaaacaggtcacatccattcccacaaactctcagagacaccttccttgacctcttccacaaatggtggcaaccccagcctctctctagctctgttcctggcttctctttctttaaagtacttatcatactgtataagatattccctgtttactctctgtctccttggtagaaactacatgtaatcaaggctagggatgtttttttttttagactaagtcttgctctgtcgcgcagcctggagtacagtggcatgacctcggctcactgcaacctctgcctcccaggttcaagcagttctcgtgcctcagcctctccagcagctgggactataggcacacgccaccatgtccatggctcagcactttgggaggccaaggcagaaggctcactctttttttttttgagatggagtctcgctctgttgctcaggctggtgtacagtggcgtgatctcggctcactgcaacctccgcctcccggttcaagcaattctgctgcctcagcttcccgagtagctgggactacaggcgtctgccaccgcgcctggctaattttttgtatttttagtagagactgggtttcaccgtgttagccaggatggtctcaatctcctgacctcgtgatctgacctcgtggttggccaggctggtctcgaattcctgacctcaggcgatccgcccgcttcagcctcccaaagtgctgggattacaggcatgagccaccgagcctggccaaagctaggaatcttaatgtaaccaccaccgcatttccagcaccaagaacactgcctggatcatctgattaatgcctcacagtgttctcagcagcagcaggttctgacacctgtatttcataagagatgcctgcacccacggacgaaccagctgcaggctgtaccctcagctccaccagctcatctgaacacatcgctacagacacaaaggccccgtgggtcaatcagcctcgaaaattgagcattaggtaatggtgccactgcttgccacttccctagctcaaggcgataactccaaccaaggttcacaaaagctgccaggctcggccttctacctaccaagtcctaacaggcttacaaatctgcaaataccagggctgtctgtgaattttgcttcccaatcctatgtttttctaagctgtcatttaaattccctgtgaaatacaaggcattaatgtggcctcttaaaaaaaatcttgtttagagacaacccacatgtccatcaactggtgaatgaacaaaacgtggtatatccatttaatagaatattattcagccatagaaaaggaataaaatattaagacactctacaacatagataaaacccattacgctaagaagccagtcacaaaagaccaaatactgtatgactctatttacaaaaagtacagaaaagacaaatctgtagagacagaaaatctattagtggttgcctggagctggaagcgagaatgagtaatgatagcaaatggggatgaaggatctttttgaggtgacagaagtgttataaatttaaattgtggtgacggctgcacaactttataaatttactaacaaccattaaattgtacgcttaaaatgcgtgaattttataacgtataaattacacctcaaaaatgctttttttttttttttgagatagggactctcactctgtcacccaggctggagtgcagtggtgtgatcagacctcatggtaatctcaaactctcagactcaagcgatccttctgcctcagcctcccatgtagcagggactttaggtacgcaccaacacacccacctaatttttaaattttttctagagatgggctcttgccatgttgcccagtgtatcagtctgttttcatgctgctgataaagacatacccaagactgggaagaaaaagaggtttcactggacttacggttccacatggctggtctcagaatcatggtgggaggcgaaaggcacttctaacatggcggcaggaagagaaaatgataaagcagcaaaagcggaaacccctgataaacccatcagatcttgtgagacttattcactaccataaggacagtatggtggaaaccgcccccatgactcaaattatctcccaccaggttcctcccacaacacatggaaatcataggaatacaattcaaaatgagattcgggtggggacacagagccaaaccatatcacccaggctggtttcagactcttggcctcaagcaatcctcctacctcagcctcctaaaaagtgctgggattacaagcataagccaccatatccggtccgttttttttttttttttaataaaaaaaaaaaggaaccaccaccaccgccactaccaccaccaccatcgccaccacccaaccacccaacccccgccccaccccttcttccattacaggctgctaaggattcagggatctaaatccctaatgttatggaatggccacaaagatgtgtatgcctttgctcattctttggtggtctctaactagcctgcccacagcacagcccagcatactgagacgcacaggtcatcccccgtcctttgggaacatgggtcccagacagctggacacgcaccactggtctgcaaagcatttatgcctatggagccgtccacagccatttccccttctagggtgaaaatcaatttgacccattagtagaaaatgataacccagctgttttgaggcagatctccggctggcgtagcagttgtttttccagctatgattgggtagggagtttggcaaatgtttttccaggcaaaagtccttactgtgtccttctaaaaggcggggtttcctaggaaatcttcagcgcatggagaaaactctccgtgagaatttcattatgacataatcattgttttgccttcattcttcctttcccatcttcacccacaatctaggttttggtttttacagaattattgctacaaagattgtccttccaggtgcaaaggtcatagcagaaaggaagccaagaggcctgcaggcttaccaggccccatccctagcaacgtggcctgagcctccactgggcgtgcaggtacagtctttgggcttagcctgtcatagaagaatattctcagagtcctgggagcacctatgagagcctgagctctctaaggccaaccaagcaattgggaccagtgtgatcactgaaagacatgcaccgctgcttcttctgatatattactagacgcaatcacgttgctgtgacctttcattcagttgcttaaagagacagatttctgtgacaaactcttggcttcctactccctactcacttaggcagcaagaattattctgcagctaaagcataattaagccaaaaaatggccccaatacactgaggtaagaaagaaggatgtcctacaactgttcacatcttctggacaaaagtatcaagcccgttaagaaaattaagtcccagagctacccccacccacattagggtaaaaatctaagggtttttttttttttttgagatggagtctcgctctgtcacccaggttggagtgcagtggcgatatctcggctcactgcaagttccacctcctgagttcacgccattctcctgcctcagcctcctgagtagctgggactacaggcgcctgccaccacgcccggcttttttgtattttcagtagagagggagtttcaccgtgttagtcaggatggtctcgatctcctgacctcgtgatccgcctgcctcagcctcccaaagtgctgggttataggcgtgagcaaccgtgcccagccaaaatctaggttttcaattgttaatttgaaaaaagagtggggagggagaacaatgtacaggaaaactgagctcagcccatctgagaaggtaacttgaaggaaaaaataatggtctttaacctagttcaagattagaaaatttcagccaggtacagtggctcacgcctgtaatcccagcactttgggaagccaaggcaggaggattgcttgaggccaggagtttgaaaccagcctaagcaacacagggagactgtgtctctacaaaaaataaaatttaaaaaaagactagaaaatttcattctattttaattactagacaaaggttttacatttgcctatgaatggaatggttcaaaatcactttcctttgtagtttaagtgtggatgattatactgggtttaaggtccacagataccataactctatatagttatgtttatttcttggcaatgccaggaaagcgttcaggttgaagctttggcaattagcaagctatcaaactttggaacaatgtctcgtccacaccggcctccatcagatgagggattgtggaaccctgccccagaattcaagcaggttttaaattctgaacttcatagggaataagtaatgcctataagactgaagtaaaaatcatttcttcaaattcctactaggataataccagtatccacgtttgctttgttcttagaggtacatgttcttatttgaaagaatgaaacctgaggtcaggagttcgagaccagcctgaccaacatggcgaaaccctgtctctactaaaaatacaaaaaattagccaagcatggtagcacgtgcctgtaatcccagctacttgggagggtgaggcaggagaatcacttgaacccaggaggcggaggctgcaatgagctgagatggcgccaccacactccagcctgggcaagagaccaagactctgtctcaaagtatcaaaaaagaaacaaacaaacaaaaaaaagaaaagaaaagaaagaatggaaacacaatccttcctattctaagctgctataccaagatgactaccatgtaatataactttcaatctttttttttttttttttcagacagaatttccttcttgttgaccaggctggagtgcaatggtgcgatcttggctcaccacaacctctgcttccctggttcaagcgattctcctgcctcagcctcccgagcagctgggattccaggcatgcgccaccacgcttggctaattatttttgtatttttagtagagacggggtttctccatgttggtcaggctggtctcgaactccagacctcaggtgatccacccacctcggcctcccaaagtgctgggattacaggcgtgagccactgcgcccggccataactttcagtcttaaaagtaacatttcaaccagaatctgaaaatgtgcctcttttctgggatctcctctttgtgtaagtttgtgcatgtgtgggagagacagagaagtaacatgtgaatgtgtgtacttacgtttcattccaccaactctgtaaagtctcacatttcaggctttcaaacacataaaaatctacacatttctgcaacatttattattatgcctacgttgagcccaccccatcctggacccaggaaacacaaagatgaatgaagaaagagctccaggccgggtgtggtggctcacgcctgtaatcccagcattttgggaggctgaggcgggcagatcacctgaggtcaggagtttgagaccagcctggccaacaaggtgaaaccctgtctctactaaaaatacaaaaattagctgggcgtggtggcacgtgcctgtaatcccagctactcaggaggctgaggcaggagaatcacgtgaacctgggaggcggagattgcagtgagccgagatcgcaccattgcaatccagcctgggcaacaagagtgaaactccgtctcagaaaaaaaaaaaaaaaagaaagagctccagtccttggaaatgtaccgtcttacacggaaacaggtacaaagaaataccaaggcaattcacagagacgtggtgaaaataagaaatgcaaacacctgaaatattacgttatcatttagaaatataaaactacagataaatggcatgtattaaggaccagtaactgattagttactgattctgaaatagctgttaaaagatacatactttgaagaccacagagtatactaggctgtttgactaagtgctcttgcctgcctagttactgtttttaaaaggtgtgtcctggaataaaaaagcaatcaataaatttacaggaaaggacatcttatgcactgggttacgttgtttagaaagccccagagcactgaacaggtaacaggaactttatcggatcaaagtacactgacttactgcactagttctttccaaatgctacttttatagtagtatctggaatcattctagctaacttccttcaaccagactctgtgagacagatcattctaccttttttttttttttttttttgtgagatggagtctcgctctgttgcccaggctggagcgtaggtggcacgatctcggctcactgcaacctcggcctcccaggttcaagcgattctcctgcctcagcctcccaagtagctgggtttacaggtgcccgccaccacgcctgggtaatgtttgtatttttagtaaagatgggattttgccatgttggccaggctggtgctgaactcccgaactcaggtgatccaaccaccttggccacccaaagtgctgggattacaggcatgagccacggcaatcaacctcattctattgtcttaaaatcgcagctgggtgggtgcagtggttcatgcctataattccagcactctgggaggctgaagtgggcagatcacttgaggccaggaattcaagaccagcctggccaacatggtgaaaccccatctctactaaaaatacaaaaattagccaggcatggtggcagggacctgtaatcccagctactcaggaggcagaggtgggaggattatttgaacccaggaggcggaggctgcagtgagccaagactgtgccaactgcactccagcctgggtgacagagcgagattctgtctcaaataaaataaaattgcggcctttgcgatctgaggaattgttcaaaaactccaaatgatttaaaaacagtttaaattctttacttttatttctcagataccagtaaggggaaatcatttctttttcttttgagacaggttcttgctgtgttgcccaggctggagtgcagtggcgcaatctctgctcactgcagcctcgacctcccggactcaagcgattcagcctccagagtagctgggattacagccacacgcccccatgcccagttaatttttttgtttttttcgtagacatggggtttcactatgttgtccaggctggtctcgaactcctgacctcaagcaagctgcctgcttcagcctcccaaagtgctgggattataggcaggagcccccacacccagccaggaatcaacatttcttttttttgttgttttttttttcacaaatagcactctttatttgccactatttgaagtctgaactttaaacagattcttggactggtggttcatatccatcagctcgttcaactttagcacctgtctcgtccccagtggcttttccagaactactgccttcaccatgaagctccatgagctttcccaattcaaacttgggcttcttcagcatttttacttttctaacgaagacatcatggagaggataaatagactggcaagccttttctatgtcttttccaatgctgtctggaatcaatttattgaccacttctttcaagtcatttgtctgcacctctcgggtcatgatttcgatcatcttcttccggatttggcggacctgttggtgctgagcataagaggtcttccgtatctgattgttgcgttttttagtaaaaccaacacagaacagacgaagcaagtaaccatcggtagtcttgacatcaacgtgagcttcaatcattgtctgccattttttgaccatggaacacattttgtcacgggtaagatccatgccatggaagttaggcagtttttaccctgaacatcttcagtaatcagcctgaattttctaaatgcaacttcatcattctgcaaatcagcaagactcacttcaaacacacgacccttgagaccatcagatgcaattttggttccttgggtcctggtgacgagcgtctttccaatatttcttatactgaacatagcaggtgctttcacatcataccaatctttcttagaaaatggatcaaccactttcttcttggctccctttttgccgcctttcgtaaggcgcttgttcttgccaaccgccatggtgctggtcagagagccaaaagcaggaatcaacatttctacaatgttctttccgagaacttttttttgtctctcatcgacttctctcctatattcaactttccaaaggttttttttttttttttttttttttggtgacagagtctcgctctgtcgccaggctggagtgcagtggtgccacttcagctcactgcaacctctgcctccaggtttcaagtgattctcctgcctcagcctcccgagtagctgggactacaggcgcccgccactgcacccaactaattttttgtatttttagtagagacggggtttcaccgtgttggccaggatggtcttgatctcttgacttcgtgatctgcccgcctcggcctcccaaagtgctgggattacaggcgtgagccaccgtgcctggccttccaaagacttccttaaagactgtacatcgccttaaaactcctctcaaacttaacctacacgcgtattaagcttttccttctttcttcccatattgagacaaaaccaagtccaaatattgaagttgtaaaggccagcccccgctgggacagagggtagggaaggagcaaggatgtttaatttacgacatgggcaggtccaggcggaggagaggggctgcggctactagaacttggggttgctgtcctgtcacagctataaactctggatgggcacagaccttctttgtcttttctccagcgtggtttctggtggtaaccatggtgcttggcacagctgtggtgctcaagaaaacagctgcgggaagaactcatgttggtggtaaaagctcagcccgtacctaacaggtgctcacaacatggcagttgttattactgacacgatctcagtgccaccaaagagttggtgatgatttcagtcacccctgtgtgatcagcacaggtcttcagcatttaaaacacaaaattcttgagttcttactatgcgccaccacgataagggattaaataaaccttcaagggctggatgcagtggctcatgcctttaatcccagcactttgggaggctgaggtgggaggactgcttgagcccaggagttcgagaccagcctggccaacaaagtgaggcaggccctgtctctacaagaaaaaaaaaaaaaattagctgggcgtggtggtgcacgcctgtagtcccagccactcagaaggctggggcaggagaatttgcttgagcctaggagttggaggctgcaataagctatgattgtgccatttcactccagcctgggcgacagagttaagaccctgtctcaaaacaaaacaaaacaacaacaacagaaaccaacaaccaaaaaaaccttcaaggaccatatagctccttcagggagataaaaatgtgtgccaatattttcaacactattctcttatcaggtatttactcagctccacctatttcagtcatttgtaaataaggaggcaggtaataaacagatgaaaatcaatgctcttggtgggggtggggagtgacagtctagtaaacacacgctatgcctactaacagttagccctaattgaatacctacgatgcgccagatgctattctaagagctttcatgtatgactgcgtttaatcttcacagcaaccctaggagctattatcatccttatttacagactaaagcacatcaaatgaaagaatagggcattatcaagtacatacaaccatcggggatgacacaaaggatgcactggttagctgaagaagccttctcagagggcataagagtaagactgagtctctaagcagatgcctgtaatcccggctactcgggaggccaaggcaggagaatcgcttcaacccgggaagtggaggttgcagtgagccgagatcgcaccactgcactccagcctgagtgacagggcgagactccctctcaaaaacaaaacaaaacaaacccatgttttgcatgtttaaactttttggtttacaggcatattgttcctgcatttattgttcagtcacatattgtactgtcagacataactgatgtcctgtatcttaagctgctcaaagtgtaacataagcccatgctatgatgagacataccatttagtccattaaataatcacaactgggccagatgcagtggctcacatctgtaatcccagcactttgggagaccgatgcaggcagacggcttgagcccaggagttcaagaccagcctgggcagcatagtgaaaccctgtctctatgaaaaacataaaaattagtcagacttggcggcacgtgcctgtagtcccagctacttgggaggctgaggcaggaggaacgctttagcctgggacgttgaggctgcagtgagccatgatcacaccactgcactccagcctggacaacagagaccctaagaaattaaaaaaaaaaaacaaaaaacaaaccattcaagttttatccaaaaaatcctggcccctaagtatgaggaattatcattgtgactttcctgatttgtcacctgaggtttttgtggccagaaacagattggtctattaactaagactcaggcaattgtgtcagacaggcatgtgaaggtgacagggggccctgtcttctgtactcctctcccctcccccaacaggcaggggcttccctcctcctaactcagcatggggctgctggattagggtagctggtggttggatctgtcatctgggacctattccaacccctaccccaatcttttctgcacatttgttcgaggccttattttttattttttttgagacagagtctcactctgtcacccaggctggagtgcagtggcaccatctgagctcactgcaacctccgcctcccaggttcaagcaattctcctgcttcagcctcccaagtagctggaattacaggtacccaccaccatgcccggctgatttttttgtatttttagtagagacggggtttcaccatgttggccaagctggtttcaaactcctgacctcaggtgatccgcccgtgtcagcctccgaaactgctgggattacgggcatgaggaggccttatattttaatcatctgagatttcccccatacttttgacaggttattaccacgcttgtacctcttcttgtccctgttgtcacctgcttttgtgcctttcaaagatacagccatgcttttaactgcttgcaacataagaaatgactttttgctctacacattcagagaaacttctgaacaaactatagaaatgacccctgaaagtaaagtcttgacttttaaaaggcagttttaagaactggaatttgagtattttcaattttgttcagctagttgcctgttgcacgtgtagtcttgggttagtaaatttttttttttttttgagaggtagtctcgcactgtcgcccaggctggagtgcagtggcgggatcttggctcactgcaagctccgcctcccgggttcacaccattctcctgcttcagcctcccgagtagctgggactacaggcacccgccaccgcacccggctaattttgtgtatttttagtagaaatggggtttcaccatgttagccaggatggtctctatctcctgacctcgtgatctgcccacctcggcctcccaaagtgctgggattacaggcatgagccactgcgcccggtctcgggttagtaaatgttaaacatgtattcccatacgtaaaaatcaagacagaaatcataagatttaaaattaggtttatctttaaatgggtaatttgcaaacagaggtaggagatggcgaattttagcttagttttaaaaacattatgtccattaaaacggaatatatatatttatctgctttacattaaatattataaaagtaagcaatttacattaaaaaatataaatatggccgggtgcagtggctcacgcctgtaatcccagcactttgggaggccgaggcgggcggatcacaaggtcaggagatcgagaccatcttggctaacacggtgaaaccccgtctctattaaaaatacaaaaacaaaattagccaggcatggtggtgggtgcctgcagtcccagctactcaggaggctgaggcaggagaatggcgtgaacctgggaggcagagcttgcagtgagccaagattgcgccactgcactacagcctgggtgacagagcaagactctgtctcaaaaaaaaacaaaaaacaaaaccaaaaactcctgccctagagttaactagtgcttaattgatattgtttagggactttttagcctccaaagtaccatatgaataaacacaagtttttttgttttgagacagtctctcgctctgttgccaggctagagtgcggtggcgtgatttcagctcactgctacctttgcctccccggttcaagcgatcctgcctcagcctctggagtagctgggactacaggcgcactccaccacacccagctaatttttttttttttttgtatttttagtagaaatggggtttcaccatgttggccaggatggtctcgatctcttgacctcatgatctgcccgcctcggcctcccaaagtgctgggattacaggcgtgagccactgtgcccggcccataaacacagtttaagcaggaaatctgggggcatcttcacccacctgctgttctctcaaaagcacaagcactctaggaggtgaaatactggttagatctctgacttgggctcatctattctgctccctggtttgggaactcattctggtaatattttttcttctattttttaaagaaagagaaaccggcaacattttatctcatttatatgcatctcacttttatccacaaagacttcaggcagctgttacaccaggaactaaaaccattaaaatctaaaacttggccaggcacagtggctcacgcctgtaatcccaacacttttgggaggatgaggcaggcggatcacaaggtcaggagacagagaccgtcctggctaacagagggaaaccctgactctactaaaaatacaaaaaaaaattagccgggcatggtggcgggcacctgtagtcccagttactcgggaggctgaggcaggagaatggcatgaacttgggaggtggacgttgtgagccgagatcgtgccactgcactccagcctgggcgacagagtgagactccgtctcaaaaaaaaaaaaaaaaaaaatctaaaactcaagtcactaaaatcatgataaaccagaaggactcaaggttaggaagacaaacagaagtataaaatcaaggctgaggaaaataaaaacagaaatctaacgtctgaaaggtcacagagctgtaattactctgcacatatctacaagttctaagtttatggggaaaagtatgcctagttattaataggcatgaaatcgtaggtgttctggccaatgtccatattctatatggtacacatgcttaaatactgaaaacacacacacatcccttctatgtgttattaaaaaggaagtggttttaaaagatctacttaattgagctgggaacgacggtgcacgactgtagtccctgttacttgggaggctgaggtaggatcactggagcccaggagttctaggtcagcctgggcaatgtagcaagaccccctcgctaaaaaaaaaaaaaaaaaaaagtctaccttagctgggtgtggtggcgggtgcctgtaatcccagctactaagggaggctgaggcaggagaatcgcttgaacctgggaggcggaggttgcagtaagctgagatcgcgccatttcactccagcctgggcgaacaagagtgaacctccgtttcaaaaaagaagtctacctaactggctagagttcagggaaaggcgcactctcacaccatgcagacaacagcatcatttggtgcatgctttctggagggcattttgcaatgtggagcaaacaggctttaaaatgtacctgccctttgacccagagctcccttctgggaatgtggcttaaggaaaacatcatggatctgcttacagatctgtgcaaagctttgactgcaaccatgcccatggctgagctgtaatagcaaagtactggcaatgatctatgtccaaccacaggggctgatcaataaattatgatgaaaaatggagtcctgtgcagtcatcaaaatgatagagcacagaaaactgacatggggatatgtacggaaaagtatcagaaaaagcgacagcaatagttagtgttatctctggtttgcaggattctgggcacacttatttacacttcttgttctttttgagacagattcttgctgccacccaggctggagtacagtggtgcagtctcagctcactgcaacctccgcctcccaggttcaggcaattctcctgcctcagcatcccgagtagctggaattacaggcacccgccaccacgcccagctgatttttatttatatatatagatatatatatgtaatttttgtaatttttgtgtatatatatacatacacacatatatatacatatatacgtgtacatatatgtacacatatatgtatacacacacatatatacatatatacgtgtacatatatgtacacatatatgtatatatacacacatatgtgtacatatatatgtacacatatatgtatatatatacatatatgtgtgtgtttatatatatatgtaatttttgtatttttggtagagatggggtttcgccatgttggctaggctggtctcaaactcctgacctcaggtgatccatcctcctcggcctcccacagtgctgggattacaggtgtgagccactgcacccggccatgaaagggttttattacataagggatgttgaaagcacagatgaaccctatttaaactggagctcggagtggggtgcaaagttatggttaactgcattttcttgttaattaaatattaatgaaaataccttccttttctttttatgtaacttttctatttatttatttttttttgagacggagtctccctctgtcgcccaggctggagtgcagtggcatgatctcagctcactgcaagctccgcctcctgggttcacgccattctcccgcctcagcctcccgagtagctgggactacagcctcccgccaccgcgcctggataattttttgtatttttagtagagacggggtttcactgtggtcttgatctcctgacttcgcaatccgcccgcctcggcctcccaaagtgctgggattacagacgtgagccaccgcgcctggtttatgtaacttttcttgaaaatgtacctactttggaccaggcgcagtgaggggctcatgcctgtaatcccagcactttgggaggccgaggcgggcggatcacctgaagtcgggagttcgagaccagcctgaacaacatggtgaaaccccatctctactaaaaatataaaaattaggccaggcgcggtggctcacgcctgtaatcccagcactttgggaggccaaggtaggcaggcagatcatgaggtcaggagatggagaccatcctggctaacacggtgaaaacccatctctactaaaaatacaaaaaattagccgggcgtggtggcaggcgcctgtagtcccagctactcgggaggctgagacaggagaatggcatgaacccaggaggcggagcttgcagtgagcagagatctcgccactgcactccagcctgggcgacagggagactccgtctcaaaaacaaacaaacaaacaaaaaaacccacacataaaacaaacaaaaaatccctttcatgcatgcagttatgatagttttagagtctaatgaacttcagtttatgtcttcctctagtgactaccacaactgtatggcctctcagaccagaatttcctaggtcttggtttgtcttctgacatgaaggatttcccacagggctccctgccaaggttacatacaccctacagagaaacggcagatcatcagcaggcctggaacaaacgattttgtttgtgtttactttaaaatttttttgcacatacccacaggaatggcaaaaattaaaaggatgggaaatagcagcagctggcaaggatgaagagcaactggaactctcatactctgctggtggaatggcaactggtgcgtcactgtggaaaatcaatcagcagtttctcctaaagcaaaatatttgaatgtctaatactcagccagtctgctcctgtgtctctatccaagagaaatgagggcctatggccatcagacgtgagccagaacattcataaagcacgactcataatatcttggaatagtctgaacataatcccagctgggcacagtggctcacgcctgcaatcccagcactttgggaagccgaggcaggcggatcacctgaggtcgggagttcgagaccagcctggccaacatggtgaaaccctgtctccactaaaaatacaaaaattagccagcgtggtggcaggtacctgtaaccccagctactcgggaggctgagacaggagaatcgcttgaacccgggaggcaagggttgtaatgagccgagatcacaccactgcacttgagcctgggtgacagagcaagactccgtctcaaaaaaacaaaacaaaacaaaaccaaagaaagaaagaaaataatcccagccaggtgtggtggctcatgcctgtaagcccagaactttgggaggccgaggtgggtggatcacgaggtcaggagttcgagaccagcctgaccaacatggtgaaacccgatctctactaaaaaatacaaaaattagctgggcatggtggcataagcctgtaatcccaactactcaggagtctgagggaggagaatcgcttgaacctgggaggtggaggttgcagtgagccaagactgagccactgcaccccagcctgggcgacagagcaagactgtctcaaaaaaaaaaaaaaaaagttaggagaggggctacccttggaggggtgcagcgactgggaggtggcacgagggggacttcagggagtggccatggtttgctccttgatctgggtggtggttacacaggtgtgttcagtttgtgacaatttagtgagctatgtatacttaagcacaactttatgtatattgctattcaataaaaagttttaaaaacaaattttaaaatatatttgcatgtgtcagcagataagttaaactaaattttatgcagcttttataacttatttttaagctggaatattgagttggaattattacagctttgaatacaggcctgtaatcccagcactttgggaagccgaggcaggcagattacttgagctcaggagtgcgtgaccagcctgggcaacacagtgagacaccatctctaccaaaaataaaaaattagccgggcatggcggtgcatgtggtcccagctacatgcctgtagcttttgatttacatttgtgacactatttcagttttgggtattaattcttgtcttgcacagacctccaagggaaacctaatgtgcatggaattaaaacaaattggatttttattttcttcaacattccacacagtttttagtcaaaaaataatcattttttcttgagatggggtctcactctgttgcccaggccagagtacagtggcaccatttcagtactgcaacctctgcctcctggcctcaagtgatcctcccacctcagcctactgaggagctgggaccccaggcacgtaccaccacacccggctaatttttgtatctttgtagaggtagggtctcactacattacccaggctggcctcgaactcctgggctcaagcaatccacctatcttgaccccccaaagtgctgggattacaggcatgagccaccgctcctagcctcattttattaagagagtttgttcaaaacatgccaatgatgatgaattaacagaatgacagaaaattccagtgacaccttagatcgccacattatgaaaatgtattcggtttgtgcatctttggtcactggaaactaaattaccatacaaacaaaggcatggtaagtgggatgtggcagccggtcactaagagactctaggactcagtttctcaacctggttaacaactatcctggccaacatggtgaaaccctgcttctatcaaaaaatgcaaaaatttgccaggcgtggcggctgtagtcccagctactcgggaggctgaggtgggagaattgctcgaaagtgggaggtggaggttgcagagagctgcgattgcaccactgcactccagcctgagcaacaaagcaagaccctgtctcaaaaataaataaataaaaatagttaagccaacacaatccacattcacctggatggctgatgtttacttagaattaagcactctatgaaaagtatcatcggagggcgccaggagcctagcaaaggacaggtgcttcacacattaaatggataaatgtccattcattcaacaaatatgcatgcctactatgtgccaggaactgttttaagtgcttggaatacaaaaacaaaaacaaagctcattgccttgtagagctcacattctagttggggtgggaagagagggaaagaaacataaataaatacatcacatagcctattctaaggtagtgttatgggggaaggtaatgtagtctaaggtggggctgggagatggatggaggcgtctgcaatctgagagtctgagcatacttccttgaggtgacactgaaaggcttctgtgatatctcccctttgactctgttagcaagattcctgtaggtaggacatccctcgatgctgccacacccgttcttcctccacttcttaagcccttttttttttttttttttttttttgagatggagtctcgctctgtcgcccaggctggagtgcagtggcgccatcttggctcactgcaacctctaactccctggttcaagcgattatcctgcctcagcctcccgagtagctgggactacaggcacgcgccaccacacccagctaatttttgtattttcagtagagacagggtttcaccatgttggccaggacggtctcgatctcctgacctcatgatctgcctgcccaccttggcctcccaaagtgctgggattacaggcgtgagccaccgcgccgggccctacttcctaagtctttaacagttctaggaaggctgtggctgctcttaattaagggtttttttgaactacttcttctaccatgagagcatatactcatcagaaaaccatgcaaaatcacagcaagcttttgagggcaaattatgggcatgctataaagtgtggagtggggagggatttttggctgaactctaattagtaacagcaacattactggacattttggggcttataacatcgtttatgaagtagtaaaatacacacatcctcctgggagttagcatggatctcccataatcatttgcctacgtatacattttagacatttcagcaaatgtgtacacagcatatatttaaggatatttgatattggctacagaggatcattctactttataattcctccttttctctaaagtattcctttatttcataattggagaaacctgagtatttaaaaacaaaaaactaaaacccatactagcaagtcattaaaaaatcatttgcaggtggcttttgtaaacacacctggttgtgttgcatttctattagtaaaatatggtagatggttaggtaatatagaggacatctcttcttaaaagcactagattcatcaacactgccagatttttgccatattaagcttaaactgttttcagcttgaacatcatggggcagggctggatagggggaagaacccaatacaggggcgggaaaaggtttttcagactcctgaattaaaatttcactttgcactgccaaagccaaagcatgggctagcagccttcactatttcatagattacataaacttgtagtctgatgctgtaaatatcctaccacctggacattaaaaaaaaaaaaggtcccaaaacactaacaaggaaatagtaattaaaacgaacaaacatttagtgagctttccagtttgctttcagacacctggcaatggaaaactatcaggtactggtctttgatctccatttacagtgccttacgtctacaaatacgtataaccaaaatgatgaaatccacactttttccctgccgtttccgttctttgggtaataagacatgcccaagtggttggcatttgtgacgctgcaattcgccttggtacggtccctctaaggagttattactaaaagtctacgtcaggaagaagcgggagaaaaaaagcagggtttaactcagaacacctgactgctggtctcaagttgcaatcgcagctcagactgggaagatacacagggctgttcttggaagaagggcggaaggcagtggtgttctgtatttttgcaccccagtggacatcagactctgcctcaaatttgcaatggcctgccttcctcaattacacagtttttccttcactgacagtcaacagagcagccactacttactttccaggtctgagtctggcagaaagaacgttttatttacacacttggtcagtaccccacacctcatgcagcaacgtcttccgggtcatttaaatagtagcaatctcaatacaaatgtaggaatttctcaaatttcgaatttctcaaatttctaaagatcgccctctatgaaggcaacacacgaatagaagagtttttggtcacagtgactgagcatcaaaaacgctgtgtcaactgtgtctactctccctacctgtaaggcataatttatatgtgacagtatacactttgtgtgttaagataaacggaacggatctcttggatttcaatacataacaaaaatgttcatgttcttctcttactttcattcaacaaaagttaatagactcctctgattttaggaattcagaccttgaaaacccagaaactaaaattttaggtttaaaaaagtctatcaaaatgactaaacttcctgattcaagcaccagggacagaaaaaagataaaacacaccaaccaaccaaccgaccaaccatttatttataaccttaaacatgcctatacatgaacttagagaacgttaaagtttcaagggttcgaagcgcctaggctgaattaaaacaaaagttgttttgtgttctattaatagcagatgattaacagatatcttatttcacctggaattcatttgtaagtatgtaaactaaacaggccactaatcctaagtctctgtctgtgtctggaaaaattctctcctaatacatgcaagttaagagaccggctatcaacgcattccttaaggttaggtcaatttcattaaaacctcggttgttctttgacttcaagaacctcaccaaataacccatatataaaagccaagttcaactgaaaggtgggagaggaagggtctaaggaggagggcgtttcccgggagaacgcccagagctcggctcacctggcgatcctaattacaggggagtttcacccccacattcttgggcgctttcttttcttagaggaaactcgagcttgtgtctttggtcccggagggcttaagcccggcagccaggacagcacgggtcactgattccaagaagttgggaggaggacgtgggccccaccgacgcacaacagacccctccccaacttaagtgcactagttgtaaaatgtgtagctggtcaggggatggggggtggtctccagagctctgagggtcagggaagaggagaagggacggggaggagaagggacaggggaggcggagaagggccaggagaggagggggagacacacggggaaggaggaagaaccaagaggagggggagggggagggggagggagggggatagactggggagaagaagggacaggggaggagggggagacacacgggggagaaggaagaaccaggaggaggggagggacagtgtcgaggggcaggggaggagggagagtgaacggggagcggaggggcagagggagaggtacagcggggcgggaaagagagacagggaagaagcacagggaggaggggagggaaggaggaggaaaagtaggggggaggggatggggagggactgggaggaaggagagggccaggggaggaagaagaggggctgtggagggccaggggaggagtgggagagaccgggagaggtggaaggacgcgggggaggggagctggagggagggaaagtaccttcccgcgtaaagtccccttctgaaccccgaggtggaaagccctgacctccctgagccccgggccctgggcttacccggtaggtgctctccgtgagccggttcacctcctcgggcccccgggacatggctgcggccgccgggcgagcaagcgcgggaggacgcggctgggcctcgtggccgccggactccgggcagcgggagggccggggcgcgactaaggggctctggagggtcggccgccgccgcagccgtcggcccgagagtgcccgcgcgcgtctccgctgcgaaaatgtcaaaacttgcggcagcgccgccctggccttcttcgaggagcagaggagaagcggccggacgccgccagaggaagctgggcgggccgggcggcccc

SEQ ID NO: 2430 - DNA, 225549 bp, Homo sapiens
gctcccgtcccccttccgccgcgtgggtgccatggcaacggagagagacggcaacctgggttccggaagccggagagctggagctttgaagccaccccggtcaaaggatgctgagtccggagcgcctagccctaccggactacgagtatctgggtaggaaccccctttaactttggggagggaaagacgtgcagacgaattaggccagggtctgggaggaggcgggggcggggtctgagtgggatcgggtccgggtggtatggggaggggcggagaggcgggggttccagggcctgagcctgtaaggccgagcaggaaggaaaaaagcacctgggaagtaaagaatgtttgaagtgtaggggctggaactcaggcaatgtggattgtgttcaaatgggtcaggttggcgttgaggatttggggccctgttggggtattattgatatgctggtagtggagtaagaataaccttggaacctcaagtgccaaatcagtcagcgaacatttcgagcttttctttttcattaggcactgtgctaagcatttttcatgcatcattcttcatttgaatttctcaacagccctaggaggaattaccgtgttttcttccagttttgcaggtggagaaactggggctgaagaggtaacttgcgttaagttaggccacacagctagaaaatggtagcgctaggatcagaaccggatttgcccactccaacagaacttgagatattgacttggctcttgagctaagactgtatatgtagtactttgttgagcatctttagtgtataaggcatttaatgaatgaaaaaaggcacacacacgcatagatatgtacacacacacacatatgcacacaatacacattttattttattttatttttgagacggagtctagctctgtcgcccgggctggagtgcagtggcgcgatcttggctcactgcaagctccgcctcccgggtagctgggactacaggcgcccgccacctcgcccggctacttttttgtatacttaatagagacggggtttcaccgtgttaaccaggatggtctcgatctcctgacctcgtgatctgcccgcctcagcctccaaaagtgcttggattacaggcgtgagccaccgcgcccggccacaatacacattttaaataattcatagacttttatttttttaaagacgttttgttttgttttgttttgttttttgagacagagtttctctcctgttgcccaggctggagtacactgcaacctctgcctcccggattcaagcgattctcctgcctcagcctcccgagtagttgagattacaggcatgcgccaccacgccaggttaattttatatttttagtagagacggggtttcaccatgttggtcaggctggtctcaaactcctgacctcaggtgatccgcccacctcggcctcccaaagtgttgggattacaggcgtgagccactgcacatggcgagaagttttaagtttacagaaaattgagcagatagtacggcgagttcccatataccttgggtctccctcactcacagtttccgctattatttacatcttgcattagtgtggtacatttgttacaatggataaacatatatatttataatatataataatatattatatattattattattatatagatatattattatagatacatattattaactaaagtccatagtttacattagggttctttgtgttgttcagttctgtgggttttgataaatgcatgtcatgtattcaccattccattatcatacagaatagtttcactgtcctgaaaaatcccctgtgctccacctattgatccttctccctccccctgcagcccttgccaaccactgatcttatggtctctaaagttttgccttttccagaatatcatgtagttggagtcatacagtgtgtaaatttttcagatgggcttctttaacttagcagtaagcatttaagtttcctccatgtctttctgtggcatgataactcatttctttttatttctgaataatattccattgtatggatgtaccatgcacatcttttttttttttcttcttctttttttttttttttgagacaatgtctggcactgtcactcaggctggagtgcagtggcactatcacggctcactgcagcctcaacctccgggctcaagtgatcctgctacctcagccttccaagtagctgggactacaggcacatgccaccatccctggttaattttttaattttttgtagagaaagagtctcactatgttgtccaggttggtcttgaactccagggctcaagcaagcctcttactgtggccttccaaagtactgagattacaggtgtgagtcactgcacctggcttacatctttttttttttttttttttttttttgagatggagtttcactcttgttgcctaggctggagtgcaatgatgcgatctgggctcaccccaacctccgcctcctgggttcaagtgattctcctgcctcagcctccctagtacctgggattacaggcatgcgccaccacgcctggctaattttgtatttttagtagagatgggtttctccatgttggtcaggctggtctcaaactcctgacctcaggtgatccacccacctcggcctcccaaactgcttggattacaggcgtgagccaccgcgcccagccaacatctttttaaatgaaaaacaattctggtttacattttgtttaacttattttaaaaattaattttaaaatattttttaaggttggtaatatggaaacttgattcaaagtattttttaggcctggcatggtggctcatgcctgtaatcccaatactttgggaggctgacgtaggaggattgcttgaggtcaggagttcaagaccagactggatgatagagtgagaccctgcctctaaaatgcatagatagatagatagatagatagatagatagatagatagataggtagatgtttttagtgaaaagcctacccctttgcctccatctgcccagtttccatccatcctcagcctcccaaaagtaaccactattattgttttcctgtgtatctttccagagtttattatatacataaaggagtatacagtgcatactttttcatttaatacatcttgaagtaatttccgtttcttttgttttttcttttctttctttcttgagacagagtctcactctgtcacccaggctggagtgcagtggcaccatctcggctcactgcaacctccacttcctgggttcaagccattctcctgccccagcctctcaagtagctggaactgcaggcacgagccaccacacctggctaagtttttgtattttgggtagagatagggtttctccatgttgcccaggctgcttttgaacttcctgagctcaagcgatctgcccaccttggcttcccaaagtcctgggattataggcgtgagccactgcgcctggcctcgaagtaatttctcagtcagtagggagcttcttcgttcttcatgaaattcatttttagctatatagtatttaaataatttatttaaccagtcccgcactggtaaacaagttgtttttagccttttgctgttactaagaatgctgcaatgaataacctgcagttttgttcctttgcaagtgtatctgcaagaataagttccacaaagtggaattggtggattaagggcatatgcattgaagtacttatagatattgtcagattgcccttaataggtgttgtaccattttgccaccagcaatgaaagagaatgcctgtttccccattgtgctgacaacaaaatacatcaaacttggatttttttcaatctaagtgacagatagtctgagtagatttaatatgcatttttaaatgaagttgagtgcctttttaccaagtttaagggctgattggtctttgaaagctatatatatacacatatatacatgaacatatatatagacatatatatagagagagagcttaagacagtgaccacatccattaatcagctaaaaggggatatcacagacaattttgtatctaatgaataacagtatcaatgtcaagcaatgcctagacttttttccaaagattttatgtattttattacccagtactcaatgaatatatgaaatatttgaaaaggctagttcattgttcagttccttgggtgtttgctgtttgaattttatgtctcaaaggcttggcagatttggtgtattggtgccttggtgaatagaagttggtggtctcttcataaatggcgttttcaggaaggccaattcagtggcagtgttgagaatgaatctacaaacagaatcagagtctcaggttggttgaaaaagcttcaatgtttgtgaagcccaaccaatcacctaataattgaatcctatacaaatgcttcttcatgctttgttgcatatttaagtgtcttaattccttgtcctaaccactaactagacattcatactgccctcagcatggtcacacccctcactgccttctcctggttcatcaaaccgtatcactctgctgaaatgcgtttgtctttagttgagaactatccctgccttttacaatttgtctctcttagaggcatgctgctttgacctattcaccctcaattttttttttcttttttcttgagacggagtctcgctctgtcacccaggctggagtgcaatgatgtgatcttggctcactccaacctccgcctccagggttcaagtgattctcgtgtctcagcctcccaagtagctgggattacaggcacctgccaccatgcccagctaatttttgtatttttagtagagacagagtttcaccatgtttgccaggctggtctcgaactcctgacctcaggtgatccacccaccttagcctcccaaagtgctgggattacaggtgtgagccaccacgcctggccaacctattcaccctcaatctaatgaccgtttaaaaccactccctacagaatagattaataaaatatttcctgatttaaatttttaaatacctgtgatttttccatttgtttttatttttatacattataaagttacttgtatgtgtaagcctaaagaagactatacttatagagaaaacaaaactgcagactggaaagccctaggcattcagtgaaacccaaaagctaaagttgagttccccttggttagtgtatctggagacctctctttaggattatggtgtaaattacagggatacctatccaaagaatatctagagatatccctttctccctgctagctagggattgtatttacctttctgactattagtgaagaaatcaatcttttatcatgttgggtaaactgatcctttccccactgactttgtagattaggaacctgtaatcatggccttgcatggcttaagatcttaagatcatcactaaagaatagcttagtgatgttcatgtctgcagtcatcagaatgtagtgataaaaattgtgttaatgcctaggcctgaagagagaaaggagagtctggtaaggagatgaaataagtatagaccctctctgtaggacccgcaaaaggtttccagccttatgaaacctacttagtggaagcttctgccagaggctgaaggtgtgtctgtgtatctggttgggtgtggcgagctctctagagccaaagggcagcctgttctggtcccaggtttgccaaacataccacctacgtgctgacctgagtataagcatgagggcgtgaggtttattttttactccacctaatttggtgaggtgcatgctttcactcacgctccaagttgcctcttcttttccatggaacctgcttattctcactacggttgatagtgggttagtataatagataactctagaaatcaaagatggcctttctcctttggggactagacatttagaagaatcacaataaattgggtagttttttttttaagctatagtttttgaactcttcctatatgcctggcactgtggtttatctcatttaattttcacaactaccatatgaagtgggtactcttactggtcccaattagtagttattaatatcatcttctcattttataaataaggaagctgaggcttagaaaggctaattgatttgcacaaggtcacacaggcaatgatgcatagtaaacaggggttcatacccaggtttgtcatattccacagcttgtgttttttcctcttcactaaaaagataaaaacaaaccaaaaaacccctattggttcaaagggcagtaattcttgcttccttattaaggatgaggctcttgcaaataaatttcttgggaacaagaattgtgttttactcatcattgtcaaccttctatcattgtctaccttctatcactgtataccttctatcattgtatactctcctacacttaattcatacgtatatgtgaaatggaatatgaataatctgaccttagggtaccctaaacatgagtagctaacaaaagcaaccgagacttattaagaacttactctgtaccaggtaccattttaaatgctttacatatattgatgtatatgaagatagtttcagttgttatctccattcggcagatgaggaaactacacacaaagataccaaataacaagttgtaagtggtggatccagaattctaacccagcagtctaattgaagtccacatggttaaactctatgctataaatactttgagcaactcccaaagtggggctccaactattgtgtagacctatacgtggatcctggagtaaggtcaagtgattccagtgtcttcatttaacatttctgccatgaggaggcatccgaggaatgaggatggatcagggaatggtaaaatttccaatttcttcttgccactggactcatctctcagaggcaggcagtgaggaagataacttctaccatttgggagaattttattgacaatcatctttgtactttgggtagctgtatgacctagaagaaatcacttaacctctctgtgccttagtttccacatctccaaaatgtgggtggtaatagtacagtcatggtggcttacgcctatattcccagcactgtgggaggccaaggagggaggattgcttgagcccaggagtttgagaccaatgggacatagtgagacttcgtctctactaaaaataaaaaaaaaatagctgggtgcaacagcatgcatctgtagtcccagttactcaggaggcggaggtgggaggatggcttgagcccaggaggtcaaggctgcagtgagctgttttcacaccactgcactccagcctgggtgacaaagtgagaccctttctcaaaaaatttaaaaaaggccaggcatggtggctcatgcctataatcccagcattttgggaggccgaggcgggtggatcacctgaggtcaggagttcgagaccagcctggccaaaatggtgaaaccccatctctactaaaaatgcaaaaattagcagagcgtgggggtgtgttcctatagtcccagctactcaggaggttgagacacgagaattgcttgaacccgggaggaggaggctgcagtgagctgaaatctcaccactgcactccagcctgggtgacagagtgagactgcttctcaaaaaaaaaaaaaaaaaaattgtgcttgcctcatacatgtaagcatttatcctgttagagcacctgtgtaggtgctcaataaatattagctgctagtgttattaccatatttttgtgcaaatacgtaaacatctggtggcaaccaggaatgtgtgcctctcagatctcctacactggggaggggagggtaattgactcctgaccccagctctgaatctaacaccttgttcacactgaggtcacactttccacagactgctcctagtcaatgactgggcaggacagacccacttccatgagatgttttactcctctagtgggtgactttggcttaaagactctcactgcacactgctaagtccctcattctcccttctccctcctaaaggagggataataattagggtccctcctaaaggagggataataaattagggtcacacctgcatttgatctcttagctctcccagactcctccggcttccttcccattttctatcatgggcgtttcccccagtacatctctcgcatgtctgatcctgttttggtgtctgtttctcacagtatctgagctaagacaacatctaacagttactgatatagtctcttccagccatgaggttaatacaacttctttaggacttggcaaaggttctgacataggaccccttctatgtggaagataagtgttactaatcttaattttttttgtatttgctgataccacagcatatgatagttacttgtctgacttccagacacattctattttttgattttgaatgaatcctgataaacttatttttatttgaatataactagtgagccttccaaacccaattctattctaggaaatattgctgtttacagtaagttagcagaaattctcttagggccttaaagtgtttggttgctgcagaaaggaaatgaaataaaataggtgttaaactgacttcctaaatctttggaaactaggtttataatacataaaactggtcactttgaaatgattatgggccaggtgcggtggctcatgcctgtaatcccagcattttggaaggctgaggcgggcagatcacttgaggtcaggagttcgagaccagcttggccaacatggtgaaaccctgtctctactaaaaatatgaaaaatagctgggcatggtggtgcgcacctggagtcccagctacttgggaggctgaggcatgagaatcgcttgaacccgggaggcagaggttgcagtccactgagatcacgccagtgcactccagcctgggcgacagagcaagactctgtctcaaaataataataataaataaataaaataattatgaacatgttcacaaagtcacctctttctttccttttcctccccctacccttctccttccttttcttcctccctgaataccttctctatataaagccaggcatgaatatatgaatataaagcatccctccccacaggaaacttacacagtagatgggagatgggacatattcataaatgaccataacataaaaagacagtataataagtaaagagtatgtgacctatatggttctagagccagcagctatcttggccttttctcagtttggtcagcagcttctcagtcatggaagggacagcagttcccttggtagcctagttctggaatgggccttttgggagttgttcctggaaggtcgatctagatttttttccttttccaaagattctgtaacctatttaatacatgtaataaataaatatctttttgttggggggaaaaaagagccagtaagttctaagccatgttgttcccaacccttgcctacctccatttctccaaagtaaattgcagagtgatgtcagtgttattctggggttttaagatagctttaaaatttttgactttgtttatcatttatatattcaagtaatgttaaaatctttattccaaatgctattcagaagttggggatcacttttatttgcacaaatgcaatatgtgctaaatgaataattctaggaggccgagtagataaattgaagttttaaaaataatagtagagcaggccgggagcagtggctcaacgcctgtaatcccagcactttgggaggccaaggcgggtggatcacgaggtcaggagatcgagaccatcctggctaacacggtgaaaccctgtctctactaaaaatacaaaaaattagccgggcgtggtggcaggcgcctgtagtcccagctactcgcgaggctgaggcaggagaatggtgtgaacccgggaggcggagcttgcagtgagccgagattgcaccacggcactccagcctgggcgacagagcgagactccatctcaaaaataagtaaataaataaaaataatagtagagcagaagagacatgatccattatcctatttctggttcatcatcctatttatgtccttcatagcacttatcagagttatcttgtgtacctacttgtatacttggttattgtctgtttcttattagaatgtgagccatgagggcaggccttttctctctaaaatctagcacaatgcttggcccaaatgaagtgctcagttgttgaatgaatggtctactttaagtaacagaataaattttaaaataaatgggagaaaggaatccagttcaacaaatagttactgaattcctaacatgtgagagaaactatgtttttccccccttccatgaatgaaaaaggatgattaaatctgctctggatcttttcggttttaactctgatttatacctaaagttaatttcttggttgataccatagtttctgtgtttgggttacataacattaaaatttaatccattttgtaaaaccaatattttaaaaaggaaggagattttctacaattttggagcatctcaatgagatcctgtcctttagttggacagagtgatatgctttgattaagactggaattacccttgtaaactaatctctgggtcctctttctgtgttgggatcacccttacactacttccctaggggccttaggaaatagctcattctatgattggaatttcaagtcaaaacacatttatctgagcagaattttaatgatttatcaaagagaggagggattttcccaaacacaactgaacttacaaattactgatcccactagctatgttttttcttaagcacctttctttaaacaaagcaattactgctgaaatcatcaaatgtatttttttcatggaaagcttttgactaagttttgtttgattagcaggaacctactaaaagtaaatattgtttgagacagcactttcagagcctgttctttttcttcattcaattagcttttaaagcactattctttggagaaagtaagagccttttttccagctgtcctattgtgtaactcaaggtctcgttaatactattatctagccccgagattacaggtaattgtgataaaacacaagcttcagtttctgtaatctcagacagaaatctgcttgtgccccaggacttcagatcaggtgttttttaaattcagacttctctcacctgggacagtcccattggcccaaagtaaacagaggcatctggcggggatagagctgcattagggcccattgccactttttttttttccctttaaattaatgtggcagaactcctcctgtggccaacttacaaagacctgttctaaatgggaaaattctgtattttaaaataggcatgcttgaaacaataacacttttgaatgtaagatatatgaaaggccacacgtcttcggctttgcttgtcaaatggagaggctgccagaaccggtcggctccatggttctcatgccccaaagtcctgcaaattgacacgtaagtaggcaacacacaaagaagttcagcccatgagaaagtgagtttgggcgcttgggctggcctcctttctctctgtgtggagttctttccaactttgcctcttctgtcccatcttagtttttcagaaaggagagattaaatgtgtctggtatatcagcatgttaactgcttgggcaacatgaggctagcactcaggacactgttcagcctgtcatatggaaggaattgcctttcagaggagattataattgtgtatatagccacacaaatgcacattctgcctggaggaaattgcacagaagaggatgccttatgctgccactcaggtctctttgtggaaggctgcgtaagaagtgcttacatggcatagtcacctcttttggacttaatgagtcatctttttgtgtgatggctacataaaaaaaaaggaaagaagaaatgtactcttccccaagtgagctgcttttattggccctgctgctttgtctaagagttttatacactcctcatgacatcatttacaatgctggtgcacagacagtaaacaaaaaataatttagcccttgggcacctagacgaaacttaagtagtccaatttagagaaatgataacaataaacttcataaacagtgaacacatgagcttaaacagcaagcatgactccagtcctttttggaatgcgatgcattgaaagatggctatagagaaaactagaagctccacacgtcagttatgtgcagttaagccttgagtccatggtctagtgttaatctcaagagtacattctagttagtggataaaatacaggctaccatgtgagtaagtcattaagctccttgagccacagcatttcacctataaaagtgggaaaggtaatattgccacctacctcacaggaatgaaagatgattgagaagataaacttgtggagttccttatagggaaggtattttgtaaatagaaaacactgttattattctccttgatcaaatttccccaacaaatggagttgataaaagctacctcacagagggttgagaggctgaattaattaatatacgtctagtatcttaagagtaaactatttaatgaaacctaaaattgattgtctttcttgatagtctatgaactaccagacctgctgtttagaaacatgattgtcttctaaagtctcacatatgcagtctttgccttctcttcaagggttggcacgataaagaatagtgaatgtacaggcaaaagataggctaaatcttcagggagaacagccttgccttttttcttttcaagggtatatttacaaatagcctttggagtcttgctaatctttgttaccatgcctgaacatagggactgttttgacctttgttcttccaataaatatttatttttgatatcatatttctaaatgagaaacaaacttagaaggaaaagaagtggttgaatttgtctcacattataaattttttcttatctttcctaggatggtaagagaaaataacttttttttttttttttgagacagagtttcgctccatcacccaggctggagtgcaatggcacaatctcagctcactgcaacctctgcctcctgggttcatgcaatcaattctcatgcctcagcctcccgagtagctggaattataggtgcatgccaccatgcctggctaatttttgtatttttagtagagatgggggtttcgccatgttggccaggctggtctcaaactcctgatctcaagtgatcctcccgcctcggcctccccaaatgctgggattacaagcatgagccaccgtgcccggcctgaaaataactattattgaaggaccagacatcaggctctccaactggaaagttctcaaacttagccaagtgattaaaaacagctttggctgttcagaatttaatcttttgttttcaattacagttagtagtatttgggtaacttcatttcccagatttcatttgctgttaggtgacacaaaaaggggaaagactttttcttttctttttttttttttttgagatggagtctcgctctgtcgcccaggctggagtgcagtggcgtgatcttggctcactgcaagctccgcctcccaggttcacgccattctcctgcctcagcctcccgagtagctaggactacaggcgcccgccacctcgcccagctaattttttgtatttttagtagagacggagtttcaccgtgttagccaggatggtctcgatctcctgaccttgtgatccgcctgcctcggcctcccaaagtgctgggattacaggcatgagccaccgcgcccggcctaaagactttcttttaaattctaatcccttaggcagggatcatgtctcatatatatattttttaatacagagataatatttcaacttttaagtagtacagctgcctaaatactgtcttaagtagaaactgttttcttttttccttttttctttttttgaggtggagtctcactttgttgcccaggctggagtgcaatggcccgatctcggctcactgcaacctccacctcccgggttcaagcaattctcctgcctcagcctcccgagtagctgggattataggcgcctgctatcacgcctggctaatttttgtatttttagtagagacagggtttcaccatattggccaggctggtctgttggtcagggtggtcttgaactcctgacctcatgagccacccgcctcagcctcccaaaatgctgggattacagccatgagccaccaggcctggcctggaaactgttttcaaataggtgttcttcatatgccatctagagtaattctcatatgcaggaggactgaaggagacagcagtctcgttcagtcctcacagcaggtagacaccagctgatcccacttttctttgaggaaactgggatttaagttatataacttgtccaaggtcactgagctagtatgtctggagctgaagtttgaatgaagtttatctgactctaaagccagtagtattgttagccactttctttcaggttttgtaatttctaagagccttctttcccattcagttcaataaaaatttaagtgtcagaacttaaattcagtagaaaattctacagaatatatgatatattccttagactctttttttttttttttttttgagacaaggtctcactctgtcatccaggctgaagtgcagtggcatgatcatggctcagtgtagcctcgacctcctgagctcaggtgatcctcccacctcagcctcccaggtagctgggactataggagtgtgctaccatgcctagctaatttttaaattctttgtttgttatgttgcccaggctggtctcgaactcctgggctcaggtgatccacccgccttggcctcccacagtgctgagattacagacgtgagccaccataccctgccagattgttttaatatatagaagataatttaacattttcttggtgaggtagtgtcattattttagacctaatttattatattgtgctataaatgtgttataacagttacccatgaagatggatgttattttttttatgcatgagaagaaatggtggctcaaataacttaagtaaattttccatttatatagatagcagttagtgaagctgttatttgattctaattcttctaatttgaaattaagtggtttaggtgccactcagtgttaaattctaatttatagctattaattaataagaagacatctccctgctcccacaccagtacttaccattcccttctctccagactaatgtttcctactgagtcagtaagctgttgaggtctactgaggtttgtttggcgcttcaggtggtttggtgctcctaatctctcagggtattagggtgagggctgagctggtgttataaaaacaaaacaaaacaaaaaacctccaccacttaactccccctccctcccagtgcaatggctcatacaagaagcactttctttctttcttacttaatccaaatccaggatgtgaaaggcagggtctgctttaggaagtcatcattggatttcagctagcagagcagtcattctgtctgaaacacatggtttccaaagctgcctcaattgtagccattttcagccagtaaaaggggaaacagtgaatccagggcaaggaccttttaggcaagtgaagccgaagatgcaaacatcacttgtgctcacatttcataggtgagaacttaataaggtccctgctaactgccaacgaggcagggaattttagtctaatggacagtcgtgtgcaagaagaatggcagtgtatttttggtggtacacaaacaaaaatctgtcatacctagtatatgcggtggagacatctaccctactcaaggcaagttgtattgttggtagctgcttgcccttattcacaggtgaagcatagatgtgctggtcagtatttggtttttgtcctctacctcttgaagtacaaagttattttatccttggtccctgtctctgagttcagttgctccctttttacaatggttattattttctttcttaactttatgttgcctgtcatttctctgtgtcacttcctgtcctttgtaaacatttccaataatcagaatagttcctctctatactctagtgagtcgttcaccttagtgagaacatgtaattttagaatttttagttctttataattggtttgttgctgggcgttggaggtaactttgctgctaaataattttatttttctattgagagttagagacccattgtagaaaccaaaatcttgtttccagagagctagttttacaataaagaaagatatttatcttcctagactggagagtgatttgtaagagatttaggaggagagtgagaaaaaggcagtgccacagacactggggacgtgggggtggagagtttcaagatggaggaagtgttcaatgataccagatgcctcagagaggtcaaagaagatacgggctgcaaggcaggttgttagtggcattaagggaggttttcatggagtagtgtggcaagatgcctgattttgctggattgaagagtaaatcggagggtgaaggcgttgagaataggctagattcgtttcaagaagtttgaccaattagggaaaggaggagagggggtgatagcaagaggaggaagagagagtttattgtttttagtttttagatgggagaaacttgagtatgtttttaggctgaagggaaaggaaccattgtacagggagagagggaagatccaagggaaggaaaggatgatgaatacttgatggaacatttttagaagtacgaggaaatttaggatcaaaggcagaggtgcaaggctattttgaagttgggagtcaggaccatatttatccagaaggcactgtttgtgtggtgcctaaccaacaaactgttatgggatctttgaaaatatttgagacctaaaaaaaaatttatcaaccctaaagtatggatatatgttttattatatatgtataaaacaatataatgtcaactttcattattacatgtaatattgacagacattttgccatatttgaaagcaattcataagtaagaattttctcaattaggaagaattcccaagtgagaaatcaggtcttaaggtgatcttaaaaccgcttcacatggcgtaattaaatttgaacaacagaggtgggaagtaagggtgatgaaggacatggttaaacttagaaatggagctagaaattggtgttctttacctgatgacctcttctttgtctgaagtaagaatcaagattatcttcttagagttagggaagcagaagtaaaaggcttgaggagagcaaagaaagtttgtattagctactgggggaaagaagaaagatagctcgactagggccaagtacaagtattctgagctacattaaagcatgtgaagtaaggctgcataaatcattttaaaaaaagaagtaactaagaatgctaacaggagcaaagttgactatgggaattggtaaaagaaaaaatacaaaagcattacaaaataataattagaagaaacagttgaaaaactcttttaggaaaacatgatgtcacaaataatgcataagaagagggaggattcggctggatgcagtagcttatgcctataatcctagcacgttgggaggctgaggctggtggatcacttgaggtcaggagttcgagaccagcctggccaatgtggtgaaaccccatttctactaaaaatacaaaatttggttgggtatggtggcaggtgcctataattccggctaccctggaggctgaggcaggagaatcgcttgaaccctggaggcagaggtggcagtgagccgagatcgtaccactgcacttcagcctgggcgacacagtgagactctgttttgaaaaaataaataaataaataaaaaataaaataaaaaagaagagggagaatccagagagcgcaaaattccacttcttccattgaagaaagttcaaagaattgctggatttaaagtttttgatgtttatgtttcttaactacagaattttaaaaatcaaatgggtctataagagttataacaaaaaaaagcagtaccctacaccataaccttctcaccccgaagtctcactcctcagaggaggccattttctttcttttttttttttttgagtaccagtaagtctttatttattcattgtattttcccagggaaaggagaagggaagggaagagtcagcatgtgttaaaaaatgatgagaaaatgggaaaggaagtacccagtacagcaaaatcaaccgtcaaataaacacaccccagtgatggggtcaccaaagcccaaaggggctcagtctcctgcagttcaggaatgagggaaaaggatcaggaaaaaaacagacaggtacaggctttcctaccctccctccccataaattcaagattttacacaaagctttggtttctagcagtaaacatggagttacattcattcatctcctattaaacaatcttgtggccactttgacataagtttctaccacctgcataaaagttcctgagtgacttggatatacattcatattccctttcttggcctcctgaccccactttctacatggaaggcccccaattgcatctctttactttaggattagaaattaaaagtaagtaggtttgatccatccaaaatacagtagtgtggttttttttttgttgtttttttgttttttttttttcgagacagggtcttgctctgtaaccaggctggagtgcagtggtgcgatctcagctcactgcaacctccgccttccaggttaaagcgattcccccgcctcagcctcctgaatagccgggaccacaggtatgcgccaccacacctggctaatttttttgtatttcagcagagacggggtttcaccgtgttggccaggatggttttgaactcctgaccttgtgattcgcccgcctcagccttccaaagtgctgggactacaggtgtgagccactgcgcccaggctacagcagtgtcttaagtgtttggcatgaatacatgaagaaatggtcggcctagcgtggtggctcatgcctgcaatcctagtaccctgggaagccaaggtgggcagatcacctgaggtcaggagttccagaccagcctggacaacacggtgaaaccccgtctctactaaaaataaaaaaattagctgggcgcggcgggtgcctgaaatcccagctactcaggaggctgaggcaggagaatcgcccgaacccaagaggcagaggctgcagtgagccgatcatgccactgcactccagcctgggcgacagagcgagactccatccacccccccccccccaccaaaaaaagaaagaaatggtaatggtcttgacttaggaggttgggaacaagggatggagggttttcctagcttcaggatttttgcatacatcatttaagagttgtggagacactccaagcattaaatgtgtatgtgtgtgggtgtgtaagttttcttttgggggtgaacagaaaagagggcagggtagaagacaagtttttaggacagaagatctggtctaataggtaataggggaaggggaatacaaaagaaaggatggttcaagatccccactttaagaagcgggccccccaaactaatgtttcagatctttttgcctggtgcagaaacttctgtcaaagatgctttggctatttttctctcaatacaaaaagaactttgtaaacaaaacccccaaagaacacggaggaagaccaatacattatatttacacaaactaggccacctagcaatcaacttagtgaagtcctacaaagcccagacaaatacagtaacttggggggcagcatttaggggagacaagaacccaggatcagacacacaccacccaatgcgttctattgtatttgtcccgtttcaacacagtgaggtaggtttgcggtgatctcacagcatgtaaacgaaaccccctttttcgaggaggccattttcaaatttttcagcattaaaaacaatttttttttgctgtgtactttaaaataacatgcttaaattgctcttcttgatttttcagttttagatattatttaatgactttatattatagaagatgaggatttaggtctcttatactactcaatttcccttcttcctagtcttccaacaaaattattataatttttggttaaatcaatattcagtgtttattatgactgtgaaaattatacatatgtatgcacgtatacatagtatatatgtatatatatatacacacagtatacaacatatatatgtaaaatatatataatatagtatactatgattacatttctcctttttgaacattttttttcattttcctgcaattaataattgcctttccttttgtgcatggttttcgatgaacttgtgccccagactttatagcctaaggtcagttcaaacacatcaggcatcctctcagtttcaatttcttttcttcaaggtaacttttctgaagtacttcttcatctaactggtccccctgcttcagtctggcctggttgctctctaaatccttcatctttatcatgggtattacttcattcttcatccttacatggatattacttgtcttgcttaagtaagttttagtgcatatttcctaaagcctatgtcttcctttttccttacatgttccttctttttattagattgcatcctctagtagctttctgagaaagggtgcatgcaaagtaatattttagggaatcttctgtttatgaaaatgactttatactacccttacccttgattgatagtttagatacatataaaattctgtgttggagataattttcccttagaatttttaaagcatttctcccctatcttttagctttctgtattgctattgagtgatctaatgccattctgatttgtgatatttcatgtagttttacattggtgtggatcttctttcattgtcttgagatcctttcagtgtagaaattcatgtatatcagttctgagaagttttcttgaattatgtgtttaatattgtctcatctctgttctatctctggaactgttgttacttagacattggacttatggatttatgctctaatttttcttgttttctcttttctgtcttttttgatttttgtatgttatatgaatatccttaacctttccaatccttttgttgaatatcaaaaatatctattgtattagccagagttccccagaaaaactgaactaataggatatgtaaagacctagatacatagctatatagatatacagctgacccttgaacaacatggatttgaattgtgtgatccacttatacacagattttctttgccacctctgagacagtaagatcaaccccctccatttctacctcctcagcctattcagtgtgaaaacaacgatgaagacctttataatgaatgatctacttccacttaatgaatagtaaatatattttctccttgtgattttcttttttttaaattttaaattattattattgtagagatgggatcttgctttgttgtccaggctggtcttgaactcctggcttcaagtgattctcctgccttggcctcccacagtgttgggattacaggcatgagccaccacgcctggccccataattttcttaacattttcttttccctagcttactttattgtaagaatacagtatataatacatatacaaaatatgtgctaattgactgtttatgttattggtaacgctgtcagtcaaatattggctattaatagttatgttttgggggagtccaaagttatatgtggatattttttcttttctttttatagagatagagtctcgctatattgtccaggctggtcttgaactcctgggttcaagcattcctccctccttgaagtcccaatgtgctggggttacaagtgtgagccactatacccaggccccactttgttaaagggtcagctgtatagatttattatgggaattggctgacatgactatggaggctgagaagtcccaccatttgtgcctgcaaggtagagaaccaggaaagccagtggtgtagttccgtctgagttcataggcttgagaaggtagggtgaggaggagcagtgtgctggtataagttccagagtctgaaagcctgagaaccagaagccttggtgtcccagggcaagatgagagggagaatttgcctttcccctctgccttttgttctgcgtgggccctcattgggttagatggtgcccacccacattggtgaaggtgaatcttctttattcaatctactcattcaaatgctagtctctgccagaaagtctatcacaaacacaaccagaaatgatgttttaccagctatctgggcatcccttagcccaatcaagttgacataaaaaaattcaattatggtagatttgatgatttaaatttctactccatttaaaaaagtttgttgaattcctaaatataagatttaatcttgcctttctgagaatattaattgtagagtttcttttttgttgttgttttattggtttttttttttgcatgtgaatgtcgtctacattttctttttctcctgagttctttttttctagtttttaaatgtgtttttcatatacagacttttctcaagtttttgaagctacttgtttaggaaagggtcttacagatcaatatatagagttttatgtaatattcctgtttttagtagggcacctctgtcttcaaactattcttggtgttcccaagttcaacatccttctgattcaacttctcaatagagaataaacctttaattttaaacctgggtggaggaggagtagtaactttactatgtaaggttgggaagaggatctagaaatataactgcttcttatgtagacttttaacccaattttccatttttacctttacttactcccacggctttagaggtgcctgatacctactgttcctaagcctttctgatgttgtataagagggtgtgcttgttttttgttctcttttctcagtatagccacttaagttttagctttttttctgttcatacaataagttgtgtgtctaatttccattttccaaaatttttaacatttcttatctgctgccatcttaacttcaactctatttttataaatctatgtcttcttttatttagatatgcttagcacaccaattcagtggggtttaaataatttttttttttttttttttgagatggagtctttctctgtaacccaggctggaatgcaatggtgcgatttcggctcactgcaacctccacctcccaggttcaagcaattcttctgccttagcttcccgagtagctgggattacaggcacatgccaccatacctggctaatttttgtatttttagtagagacagcgtttcaccatgctggccaggctggtctcgaacacccaacttcaggcaatctgcctaacttggctttccaaagtgctgggattataggcgtgagccactgcactgggcctaaataattttttgaaagacacagagtctcaatatattgcccaggctgatcttgaactcctgggctcaagtgattctcttgcctcagtttcctgtgtaggtgagattttttagtatactatgcatgacgccacaatgcctggcattttttagtgtactcacaaggttatgtaactaccaccatgatataattgcagaacatttttatcaacccataaagaaacttcataccaattagcagccactcccattttactttccccgcaacccctggcaaccactaatctaatttttgtctctatgaatttgcttattctagatattgcatacaaatgataattattatacaatatggggtttattgtgtctggcttctttcacttagcataatgtttttaagattcatcgatgtttgctgggcgcggtggctaacccagcactttgggaggccgaggtgggtaaatgacctgaggtcaggagttcgagaccagcctggccaacatggtgaaaccccgtctctactaaaaatacaaaaaattagccaggcatggtggcgggtgcctgtaatctcagcaactcaggagtctgaggcaggagaactgcttgaatccagtaggcagaggttgcagtgagccaagatcgtgccactgcactccagcctgggcaacaagagcgaaactctgtctcaaaaaaaagaaaaaaaaaaagattcatcaattgttgtagggtatttcagcacttcattcctgttgtggctaaataatgtttgattgtatgggtacatcacattttgtttattcattcatcacttgatggacctttggattattttcactacttggattttatgaaaatactgctgtgaacatctgtatacaagtttttgttcgaacaccttttttcatttcttttaagcatatacctaggcgtggaatttctaggtcatttggtaactctatgtttaactttttaaaggattgccaaactttttcaaagcagctgctccattttacccaccagcagtatatgagggttctaatttctccatatcctttccaacacttgttgttgttgccttttttattatagccatcctagtgcatgtgaagtagtatctcattgtgggtttgttttgcatttccctaatgattaatgatgttgagtgtcttttcatgtgtttttggccaagggtttgtcttcttggagaaatgtctactcaaatcttttgcctctttttaattgggttgaggttaagatggcagtttagatctggactgttgaattgtaacagtctttacatattctggatactagacccttatagatatatgatttgcaaatattttctcccatcttgtgggttgtctttttactttcttggtagtgtcctttggagtacagtttttaattttgatgaagtccaatttattttttctttggatatttatgctttaggtgttatatctaagaaatggttacctaaaccaagttcacaaaactttgtacctattttttattctaagagttttatagtattagcttttacatttaggtttttgatccattttaaaatggcttgaggtaggagtcaaaaatcatttttttacatatgagtatccagttgtcccagcaccatttaaaaaaaagactgttctttccccattgagtgtttttggcactgtattagtccattctcacactgctaataaagacatacccaagactggataatttataaaggaaaaaggtttaattgattcacagttcagcatggctggggaggcctcaggaagtttacaatcatggcagaagaggaagcaaacacgtccttcacatgataggagcaaggagaagtgctgagcaaaagggggaaaagtcccttataaaaccatcagatcttgtgagaagtctctcactatcacaagaacagcatggaggtaatcacccccatgattcagttaccccactgggtcccttccatgacacgtggggattatgggaactacagttcaagatgagatttgggtggggacacagccaagccatatcaggcacttacgtcaaaaatcaatttgctataaaatataagggtttatttatagactctcaattatatttcattggtttctatgtctgccttatgccagtaccacacagtcttggttactgtagctttgaataagttttgaaattgggaatgtgaatcctacaaatttgttcttctttttcgagattgttttggttattctgggtcttttgcatttccttatgaattttaggatcagcttgtcagtttctctccaaaaagccagctgggattttgatagggattgtattgatattgtaggtcagtttgtggagtgtgccatttaacaatattaagtctaacaacctacgaacatggagtgtctttcctattatttaggcctttaatttctttcaacaatgttctatagttttcattgtataagtcttatacttctttgttaaatgtgttcttaagtatttcatttttatattatcatagttagcactgttttctctatttcacctttgaattgttcattgctcatatatagaaatatagtgccagcctgggcaacatggcgaaaccccatctctactaaaaatacaaaaaattacctgggcttgatggtgctcacctgtagtcccagctattcaggaagctaaggtgggagaatcacctgaacctaggaagctgaggctgcagggagccgtgttcacattactgcactccagcctgggcaacgggagtgagaccctgtccaaaaaggaaaaatgatcttgtatctttcaacattgctgaactagtatattagctctaatagtttcttagatttcttaggattttttataccagataatgtcatctccaagtagagatcattttacgtcatcctttccaatctggatgcttttattttttttttcttgcctaattgtgctggttagaacctgcagtagaatattgagtagaattggcaaaagtggacatctttgtgttgttactgataggaggaaagcacattttgtcttttgccatcaagtacaatgttaactgggggagttttgtagatattctttatcaggttgaggaagttcccttttattcctagtttgtttagttttagttttagctttttttttttttttcatgaaaggatgttagactttgtcaagtagtttttccacatctattgagatgatcaagtagtagggtttaagtctttttaaaatcccttcagtgatattttagcagaggttttggagggaaaaaaagaaaacacatttaagctgatacatttaactgcaagatacaaagagattttaaaaaagatattaggggccgggcgcgagaaggcctggatgggcagaccatatgaggccaggagttcgagaccagcctggccaacatggtgaaacccgtctatactaaaaatacaaaaaaaattagctgggtgtggtgcacacacctgtaatcccagctactccggaggctgaggcatgagaatcgtttgaaccctggagataaaggttgcagtgagctgagatcacgccattgcactccatcctgggcaacagagtgagactctgtatcaaaaaaaaaaaaaaaagatattagaaactaatgtagtttgtttgaagttggtcatagctagaccaactagctatgaccaattactagaccatagctagaccatagtttaagaaatttggaaatttagaaaagataactgcttgatcatgctaaaacacctaattcattatttttaaatgtataattaaaataataaataacaacctattatccctcaaagaaaaaggaaaagtataggtttttattcgatgactcagcagttttctatctggtctcgttaccttcaattctttctctttatttctatcagagctatctttctaaaacctaaactggatctggttaaaatctttcactaactccccatgttagcatggcatacaaaccttgtgatatggcagcttttttccctccgtctagcacaattcttccatcaaactgttttctctagctatgctgaacaatgtacagttccagaattcacagtgtcttctctctctctctcttttttttttttttgaaatggagtctcgctctgtcacccaggctggagtgcagtgacgcgatttcggctcactggaagctccgcctcccgggttcacgccattctcctgccttagcctcccgagtagctgggactataggcgcccgcctccacgcctgactaatattttgtatttttagtagagacggggtttcactgtgttagccaggatggtcttgatctcctgacctcgtgatccgcccgcctcggccccccagagtgctgggattacaggcgtgagccaccgcgcctggcccacagtgctttctcttatctctgggccttaatacggactgttttgtttacttagaactgtaattctcaaactttttggtttcaggatctctttacacttttaaaaataattgaggatttcattgagctttaggtaggatatatctatcaaattgttactgaaactctaggggtttggtataggtcccattgcttgcccctcagaaagctgatcactgagactacgagtattgccagggaacaaggctttaatcgggtgctgaagctgaggacatgggagatcagtcccaaattcatctcccgggactgactaaaattgggggtttctatagcagggaagaaacgtaaccatgtgtgggaaaacaggaattagggagggctaaggaaaaggaattggttagtaggaagcagatggttggacaggtaatcatgacaggtgagtgcacaaattttaagactgggggggtcgatttctatgtttattcaaagaaaccataaacatcagttctatgggacaagtggactactttcaaaatactttcaaaatgttactatatttgaatttaaaacagaaaatttaaacattaattcatttaaaataacaataatcagcctatagcatattaacacaaacagcttttttttttttatttttttttggagacagagtctggctctgtcgctcgggctggaatgcagtggtgcaatctcgggtaactctacctcctcctcccgggttcaagcgattcttcttcctcagcctcctgagtagctgggattacaggcatgcaccaccacgcccagctaatttttgtatttttagtagagatggggttttgccatgttggtcaggctggtcttgaactcctgacctaaagtgatctgcccgcctgggcctcccaaagtgttaggattacaggcatgagccaccgtgcctggcctaaagagcatttttattaaaaatattttctaaaaaccaaaataattagtgacaatagtagcattgttttacacttttgcatatctttttaatctctagcttagtaatagaagacagatgaattctcatatttgcttttgcattcagactgttacaaaatgttgctttagttgaagaatatgaaggaagtctatccttacacagatacgtagttcaaaaaacaggaatattttaaattgccttttcaggtatttatttcaccaaaactagagaaatagtagtttcttacaggttagttgcattgtgaaatctaaaactacatcagtgaacttttcagagtcttttatattaaagttcacaggtctatgtgcactacgaaaggacattttaccctcgtatgatttatgcagaaaatggtgcttcacttaagtatagcaggtcttccaaatgtgtatttcatgatacagtatcaaaagatcacgttcattaatatcaccacagatcttatcagaaaagtcttttttttgtttgtttgtttgagatggaatcttgctgtgtcaccaggctggagttcagtggcgtgatcttggctcactgcaacctctacctcccgggttcaagtgattctcctgcctcagcctcccaagtagctgggactacagacgtgcgccaccatgcccagctaatttttgtatttttagtagagacggggtttcaccatgttggccaggatggtctcgatctcttgacctcgtgatctgcctgcctcggcctcccaaagtgttgggattacaggcgtgagccaccgcgcctggcccagaaaagtctttaagaatcgagaagctctcaggctcatggatgaagtatgttttcctcctttttttcccatactgcacagatgtagagttttccaaaattttaatttttcatgtgaaagcttgactttttatcactgataacaaatactatcacttgttttccttgaagtaacaggctcattttgttcatttttgagaaaatttctgccaaatacccaagtctgaacaaccaggatttgtgcattagttctttcaagtaaaaatggtgttttataaaaaaaaaacagctagttgagcttgcatgtcaaataatcttccagtgcttttctttaagacaactttcatgcttttgcagaaattttttatgcatactttctagtttgtacatagaatattaaaaaggcatgtacttatggggcaaggggtaagatttaatgaaattaatatttactgtatcttcaagaatatttgtaagtgaaactggctgtattagtcagcttgggctgtcataacaaaatatgcaaactggggtggcttaaacaactgttttctcgcagttctggaggctcagaagtccaagatcaaggtgctggccaatttggctcctggtgagggctcccttcccttccagatttttgccttctcggggtgaccttatatggctgggagagacagactctatggtgtcttttgaagagcaaacatttaaaattttgataaagtgtaacatcaaattttttctttaatagctcatatattttatgtcatatttaggaaatttttacctaacccagggtcactaagattatctcctatattttcttctggaagttttatagttttagctcttacatttaggtctatggcccattctgagttaatgagttaatttttctaatggtgtgaggaaaggttcatttttttgtatatgagttgtatatgaatatcgaagtattccagcaccatttattaaaaagattatattttctccaatgaattgccttgccaccttgttgaaaatgaattggccatgtatgtgcatatttctagattcttatattccatcattgtatatatgtatctttatgctaatatcacactgtcttaatgactgtagctttaccataaatcttaaaatcaggtagagtaagtcctccaacttagtttttctttttcaaagttgttttcgctatttcatgtttcttcatagctatgtgatcttgggcaggttacttgtcttctctgtgcttagtttccagatttgtaaaatgaagaataatattagactcttaggaggattaaatgaataaaactcttacaactgtgcccggcacataggaagaactccataaatattagctaatcttagtaattttgggtatatttaatgaggtaaatattggatttatccttaatcctggcaaaaaataatcttaaaataggaaactatattattatttataactatattattatatattattattaactatattattatcgagacaacatttcaacaaatttagttcaaatatcaaattaacttttattaatgattcatgaacagggcagtatctcctctaaaaatttagaaaaggggctccggtgagctgagtggaggagattggctttataggtagggaagggcggaagaaagcagaaacaagaaactgaagcagattggttgttttgaagttactttccttgtagggtcagaacagaggagacttcttttcatgctggctgaaactggcccatttggagatttggctgttatctctcttgacttctcagaaggtcagataactgacttagttttagtttggtgacctggagctttagcctgagtgactccattttggtttagtctactggggcctagcgcaggaactcagttgaaatcaaaggccttctataaattttatttaacactattttaagatacaagcaaaaatgtaaacatccctcaatacaattctagcaaatggcataaatatatatatatttaattaatatatataatatataattatatataatatttaatatatttaaataatatatttaatatattattaaaataaatatatatacatatatatgtttatcccagaaatagaccagtcttatctataatattatttataagaaaatgataactggaattacccataggagcacattagtagacattcaaagccttttgataaaattatctaattttttttagtatctaatcttgatcacccccccgaacaattaaaaatagagtgtttctgctgggcgcagtggctcacagctgtaatcccagcactttgggcggctgaggcaggtggatcacgaggtcaggagttcgagaccagcctgaccaacatggtgacaccccgtctctactaaaaatacaaaaattagccgggtgtgatggtgtgtgcctgtaatcccagctactcaggaggctgaggcaggagaatcgcttgaacccggggggcggaggttgcagtgagccgagatcgtgccactgcattccagcctgggcaacagagtgagattctgtctcaataataataataaaaaaaagagtgtttctaacttttgttaatgtcttcatttacaaccaagagaagcattagggttatatttcttgaaaaataagaaaaagaaacactgttcttaggcctctagaatcctctagaaccactgttcgtttttatactattggatattcttgtcttacagaaagaccagatctgaacattttttttaaaaagatgaatataggtccccatgactcccacggcaacactgagtggccttgttctacctggctcactttgctaatacagtggggttttttttctttctcttctgtccttatgtgtaaggcagaatacaagggcctgaagcccccgcccctcctgcatttgacaacagggttggacattgtgtattgagtttttttgtttacattgttctgattaaagtatgcaaaataaaaagatgcagttttatataacagaagatggatatagaaacattataaatggtaaaagcttttataattgtttgctgatgagaatatgaaatgatatattttggaaaattgtttggcagtatataaagctgaacctatgtataccctgtgacccagttattcacttctaggcacagaaacaagggaagtgtggacatatgtttaccaaaaaactcatactagaatgctcgtagtggcactattcataataggtccagattatgggaaactggaactaaagaaaacaaatgccgtcaacagtggaactgataaataaattgtggtatattcaacaatggactgttattctgtaatgagattgaacaatgggatattatgctgcaatgagaattaatgaacagttacccacagctatatggataaaccccacaaacataatgtttttttttgagacagggtctcactctgtcacccaggctagagtgcagtggcatgatctcagctgactgcaacctccgcctcctgggttcaagcgattctcatgcctcagcctcccaagtagcagggattacaggtgcacttcaccacacccgactaatttttttgtatttttagtacagacatggtttcgccatgttggccaggatgcacaaacataatgttgagtgaaagaagccagaggcaaaagactgcatactataatagactatatagatagtttatatatgtatacacacatacatatataaaacaggcacaatttaccattgaggggttagggactagacagtggctgtaggatgttttctagggtgctgattataagtataaatttacatttttctgtatattattatatttaaatagaaagttgtaaaaaatgtttggtagtaaatttctaacttaaaactaagcaaatgatacacaattgagatcccggaaatagatgccaaagaacaaatctatttaatctgtgacaaactaagtgtaacaaagtaagcatggcacatgtatacatatgtaactaacctgcacattgtgcacatgtaccctaaaactttataataataataaataaataaataaataaataaataaaattcattaattgagataactagatttcaatatggcaaaaataaatttaggttcatgcctcataccatatggtacattgaattgtagtttgaattaaaatattaataaaatattaatgtattttttataactaaagtataattatggctgagataattttacatataaaaattgatatagatctgtaagggcagattgatgcataaatagatgttggtttttaaaatttgtgtacaacaaataacacagataaaaggaaaatgacagaataaggacgattatgatgaatatgatgaataaagcttaatatgatatgtacagaaaataaatgacacaaatttatgttacagtcctgtcaagcagtcaaaggaaatgatttaagagtttgttcatgtgcaacattcttcataaaggtgaaaaattagaatcaatccacatgcccatcaataagggaacaattaataaattatggtatttctatgatagatactacgatgtagccattacaaagaattagatttgttaatatggaaagatgtacatgaagtattaagtgaaaaaatgagttgtagaataaagtacatatgtatagtgtcattacacttttctacaaaacaagttaatgcaacatttgtcaacaagtatatggtcacatgtagtgtaagttatggaaggtatagatcaaactgttagcagtgaatactctggggaattggcataagagggcgcttatcctgtttttacttcacaccctcctgtattgttctgtttcattgatgtgtgcttttacaattaaaaattttaaactatatataaaggagaaaggtaagttaactaaatattcacatttaccaataaataaaccactggaaataagatacttttgagttagttaaaacacagaactttatattgggacatctgcaaggaaattggtctcttccgtttcttggatgtaatataatctggtgtaatctttctggaaagtaatctgacaatacataacaggagccataaaaatgagcatatcttttgatcctagagccttacttctgggaatataccctaaggaagtaactcaaaagagaaaagaaatttgcttgtgcaaatatatttatagccacattattttaagcagaaaactgaaaataatccaaaaagaattctgtatttaagcaatattttaaaatgcagtaatacattgatcttctaattttttttttttaagtattgctgggtgcagtggctcacgccagtaatctcaaccctttgggaggccaaggcaggaggatcgcttgagcctaggagtttgagaccaccctgggcaacacagtgagaccctgtctctgcaaaaactttttaaaaattaggcaggtgtggtggtgtggcacttgtggtcctagctacttgggaggctgagataggagaatagtgagagcctgggaggttgaggctgcagtgagccgtgattgtgccactgcacttcagcaagcaacacagcgagaccttgtctcaaaaagaaaaaagctaggtgacctaataagattgccatcagcttcatccttttataatgtcaaaaaaatgaaattaaaagtaaagtttcttttatcttttccctatagtaccattcaaattcttctgctcagtttaacatttttcttcaacttggtccctctaacaagactttttactgggtcattttgttttggaaagacaaagtatgaatttagagaagtagaagagagtatagtaattttttctccttatctatttatagtaaacattatagaagcaaaatatttacttacacttaatcaggtttccaaattgtcctggagagtagaatatcctcctccatgatctagtgaggaggttaagttggaggttaaataccttgcataataccccaaagagataggacagggattagagaccaggtcttatataatgagacccccttgctagggttgttgagcattggtgcctgtctgtgggatggcagtgcagggctgggatcaattctctgtttaagagcaagtctgaaggtcagttctttcctttttgagctgggctatttgagcggtacagtgtacactttctgaagagatttctggaagcaattgcagaagtttcttatacagggtagaatctgacctaagctgtccaaagagaaatggcccttagagagaagttgtgcttcccctttgctacctcatattttatgtgctgcctctcatttgttccttttcctctctagttcaaaatgcaggatctgagaaggagacggagctgtcatcagttctaaacctgaacagaatgtttcctcagttagtaaatggaaaaattattttaaaaaatcttcatgtatgtttgtgaaataccaagacattgatttgtggtctagtttgcaatcatgataattatattaattagtaccaatcatgatcattttaaactttctgaatttctctatcctaattctgtgattcagtggaaaatatttatactcaagagattaaggttcaattttctgccctaccacttaacaactgtgtgaccttgggcagtttcttcactggtaatatggagataataatcccagccttatctgactcctaggtttgttgtaaggttcaatgagataatgtatgtgaaagtattcggtaaactttcaagagcaatacaaatgtttttgttgaagttatgaaagtcattaccctgtttaaaacacagtaagcactgaagatgtcagtacgtctcttaagattctaaaatagtgtcaagaaatgttctatcctatcctagcatgcgctaacctaggtctgtgaataggccaaggagccctctccttggttgattggttgcttgccagatatattagtttgatctcttcatttatactttctggaaaatatatggatgctttatgttaggtttgtctgcatacaacagagaaacctaaaataccgtggtttaaacaagatagaagattatttctctttcatggaaaacaagtctgaaaataggcagtccacagctggtagagtatactccagggtttcatcaggactcaagcatatatttttctgtgccaacatcctcaccatagaatccattctttacctcatgacccatgaggactgaaggaactcctttttatccattgggataaataaaggatatctcaactgaatcagtcccatttaagtactttctagaaaatccacacagtattttgcttacattttataactgagtcacatgactaaagactagctacaagagaagctgagaaatataatctttatgccagtgaccatgaacccaggtatgtatactggagggtgtatgtgtgtgtgtgtgtgtgtctgtgtgtgtctgtgtgtctgtgtgtgttgaagagggtaatttataaccaaaaacattcatatttttatataatgctgtggcagagacttcaagttgcaaacttcaatggcttcttcttccttagaaacgtacttgcagttttggccagtcatggtggctcacacctgtaatcccagtgctttgggaaactgaggtgggaagattgcttgaggctggaagtttgagactaccctgggcaacatagcaagaccctgtctctaccaaaaaacaaaaacaaaaaattaaactgggtttggtggtgcacacctgtagtcccagctactccagggggctgaggcaggaggattccttgagcccagctgtggaggttgcgatgagctatgattgcaccacactgcactccactgtgggcaacagagcaagaccttgtctcaaaaatgaaacaggcctggcgcagtggctcacgcctgtaatcccagcactttggaaggccgaggcgggcagatcgcttgaggtcaagagttcgagaccagcctgtccaagatggtgcaaccccgtctctactaaaaatacaaaaattatccaggcgtggtgccaggcgcctgtaatcccagctacttgggaggctgaggcaggagaatcacttgaatctgggagcagaggttgcagtgagcagagaccttgccattgcactccagcctgggcaaaagagcgagactctgtctcaaaaaaaaaaaaaaaagaaagaaaaagaaacaggccaggcatggtgactaacacctgtaatcccagcactttgggaggccgaggtgggtggttcacttgagatcaggagtttgagaccagcctggccaacatggtgaaaccccatctataccaaaaaacaaaacaaaacaaaacaaaaattagctgggtgtggtggtgtgcacctgtagtcccagctacttgggaggctgaggtgggaggctcgcttgaacctgggaggtagaggttgcagtgagctgagatcatgccactgcattccagtctgggtgacagagtgagactctatctcaaaacacacacacacacacacacacacacacacacacacacacacacacaatactccaatttttacctggagattcgagaaattagggaagaaaccaaagaaaatatatttccttataaaataaatattaaaataaagaaaaaaaagtctgggtgcagtggctcacacctgtaatcccagcactttggggaggctgaggcaggaggattgcttgagcccaggagtttgacaccagccatagtgagaccctgtctctacaaaaaaatttaaaagttagccaggcatggtggtgcacacttgtaatcccagctgctcaggaggctgagataggaggattgcttgaacctgggaggtcaaggctgcagtgagccatgatcacaccactgcactccagcctgggcgacagagcatgaccctctctcaaaaaaattttaaaagttagaaaatatatttctatagtgcaataacaaagtgatttgtgcagggaaaactaaaaattctggagacattttttaagctcagcagtatttgcataaagaaatatttataatgtgaaaacaaagtacttcatttaattttgaaagatgtattaagcaaaaaaggaaagaaaaatgagaggaaaaatgctagaaatacagggggtacattggtttaatttgaaccctcttatgtatatgtatctttagctccttttactttagcttttctcgtctctttggaaatgaaaatattcagttgttgccatgattttgcttgctttgtacaaatgaaatgttggctttatggttatagacagaaatatggaaaactttagagctactttgagcaagcccaagaactttgaatcattgaatcaagaggagaaaaaatgaagaaaatatttcaagttctttatctgtaaaatgatggagataaacaatatgatctgaaagtctttcaacttcttaagtttttataattcaggagcagtggtaagaatagtaatgaagtttctaactactacttccaagttaagtacaatccagagaggccagtgggacagaatctgtgggacgatgtgggaggacttaagtgattttaagtcctggtgaagaggaatagtgtgttcaatggaaattgaggaagacaaggacttttcaggtcagggggcttaatgggtcatcattgtgtttgttacagagttttaggagagtggtggagaaaaagatggagaaaaagaaaatggactatgtgctcctaggaagagagatgtgattgttttctaacatgtaggcaatgaaccctcagaggaactatagatgagcattagggtgttcttgaatgctctaaaattatatgcaacatattatattcgtttttctgtgagaaagcatttgtagctttaatcagattcttattgtaagctaacaaagccacttgctcttaaaaatgaataataaagactttaaatgattaaaaacagaaaaagtgacacttcagtggtcctgcagtgggtgaatatagtcattgtgatattttcagagtaagctaggtttcagtcacacacacacacacacacacacacacacagtacacacacacacacaatgagagaaatgtatagaatcgtggggaatttgctgtacagttttgggttttggcttgctattattagctgcaccttgggcatgttacagaacctccctaagcttcaatttcctctgctataaaataaggataaaagtaccttaaatggtggttgtgaaaattagagacaatgtaagttgagtacatagtacagtgcttggcacagaataggtatttggtaaccctttccccacatgagttttttaagtttctgtatttactttaaggcccttattgtatgcagtcatccatgagtatatgcagggggttagttccagggctctctgagtataccaaaatctgtgcatactcaagtcctgcagttggccctgtggaacccgaatctacgagaagttgaccctccctatacgtgtgttttgcttcctgagaatactgaagtttcgacctacatttggttggaaaaaaccctcacttttaagtggacccaagctattgaaatccgtattgttcaagggtcaatcgtatttcactttgaaggactggtcctcagcaagttcatcttctgaactactcagtgatgctcacactcaagaagaccatatcttattaagtggttagtttagaagctctttcccatgcagatttgcaagcggagtgtgtaaaaatcacacattgcacttgttgcctggcagcacgtgtccctgagtggtagtacatggcttgcattgtaatgttatcagtgctggggccagctggctagacatgtactgctacatgggctagggactccattcctcaacaaaacagcagccagcactagggttaacagaaaatgacaaaccaggaatggatgagggaggcgccagcacagcagcgggatgtcttttgatttgcttctgttatttgcatgtctctcttgtgatgtctgtgaaatgtttagaatgacaaagtttttaaaagacctgctgactccgcctgaaaaatgtgaaaaacctcccatttagagacctattatgtccagctagcctgcattttctatatctttttctttattttttattaatgcaaacatttgcatgaagacagaacctttgtttcttaaagagttcatctgctcctgctgcttactggccctgccatgcaagagcacaacagaacctttgttaggctttcagcaaagctgtttatgaacggtggcttactgaggactgcttcctgtgctgtgtgcttccattttgtctaaaaagaaaaaaagaaaatagttattaggagtaaaaagaatttggactttcttttattcaagtcctggatgttgaaatgacaagtagcccccaaatttgtgaggaactggtaattgcatcgaatgcattttttcgctttaccttgaacataatgaggctcttagtaacaatagaaggaacaagtgccttctcattggaatagagagaaggaacagtagtaaaaaggcaacagaaagagtagttgagaacaggacaaaagtggcttccagtaagaacactaacattgtaatagaatgtgttttgatatttagcgtttcccacctgggaggcacagtcctaaagtggttgagttgaataaagaacagcatcacagtttataaatagtggatacagtttgtatgttcattaagtaaatatttgaatgtctaccatgtgaaagacactgaatggtcctgagtgttaaaggaaataaaagataaatgagtcatggtgcctatctttaaggatcaggacatccaacaaagaagataacatacgcataacagaaataactgtgtatcaaggtagaaagtgccactggaaatatttaaaatagatgtttagggagtttgggaaaagggaagatcacttctggctgggacagaatcagggaaaggttcacaaagaaggtggcatttgagttgggcctggcagaaaaggtaggactgaacattgcaacattcctaaaagtgatgagtcaaaaattatgttgttctagtaaaacagatccaaagtatgtttttatagggtactttggtggtgtttttataccattaatttagatgatatgttaagtgttatgagttttctgtgtagactaaactggggcctctctgtctagtctatgttgttccaaccatttgccccatacggtttttgtgcactttggcctaggcctttttgtatctataaatatctacaatagcatcctttactttcataacaaaaatagaaactcaaagggattattgagcactattacagctatatcccataaacagtatgtggagatagttcttagtggggatttcacatgtgagactcttatttgaaaaagaatccccaccttcgtgcagagccacatcaaccacaagagagaggacagggaattctaagcccgtgagttttcagttactttaaattagaacttttctgtatctttttgtcattagaaaaaatgagatcctgttactgttagttcagttgtgaatgccaactaatttttatgtaatatttttaatgtaaaatgccaagcaaatgattaagctgttgtattagtatcttattgcattaatatcactattctgtatattcatagttaaattgcatattaccaattaatattaatctgtaaatttaatgataattgataaatacatggtttgcccccaaaggctatactttttcttttttttaaagagacaggagtcctactatgttggtcttgaactcctgggctcaagggatcatcctgcctcagcctcctgagtaactgggaccataggcatgcatcaccatgcccggctgcaagactacaactcgtgctatagcacaattaattttcaccttgtaattttattacttccctgtttgaaaacatgagtggcatatgatttactacatgtttagcaatttacaggattttttttttacccatgatactttctggaaaatagttatgtgaatgtttatggcgttgacttgataactatactgctttattagtaactatttttgcaaagttattgccatgacaaatattacttgggttcttcatatgtcccttagattgtaactgtgggaaacttaagtgctactttagatttctctggtgttcaggaagtacattttgttatggtcagctagctgagtgctttaagtttgaactatgaaaatctccttaaaaaaaaaaaggacgcggtggcttatgcctgtaatcgcagcactttgggaggccaaggcaggcggatcacctgaggtcaagagtttgagaccagcctggccaacatggtgaaaccctgtctctactaaaagtacaaaaattagctgagcatggtggcgggcgcctgtaatcccacctactcaggaggctgaggcaggagaatcgcttgaaccctggaggtggaggttgcagtgagccgcgatcacgccactacactccagcctgggtgacaacagcgagactctgacttaaaataaaaaagattctgtagtttctggcacttgaaattgcaggactccaacctacaaatgctgtattattatgagatttaggctggaaatactgaggcagtaggatttaagcacttacccttaattgacatcccaaaactatatataaaacaaacaaacaaacaaaaaaacaaaaaaacccaccagttttaggaaagagaagggaagaggggaggattaatggttgaccagagactgttttgagtgtcaaggcactcagcttttcacagctattaaccagtacaataccccttttggttgagggaaatagactttagtttttcatcctctacttaacataaagatctttagacacctcttgttttctggttgtcacaggtgatgttagcatatgtgtaatgctttgtttgcctctggcgtgtcttttagtatttgagtttgactagccgtatagcaggactttagtggtttggatgcatagatgcaatgtattgcttttgtctgttttataattaacaattataaaataaaaggtcattccttaatttgcaaatttgttctcagaaagttctgtttgatacatgtcatactgcatggctctttaaaggtggcagtatcatgcagtacagactggaatataggataataggcttatacacttggagtagagaaggcctttttgaataggacacaaagcacaccaaaaaaaagccacagatacattattttgactgtatcaacacttaaaacttctgtaaaatgaaagataccacagacaagttaaaagaagaccatgaagtagatgtatgtatttgtgacatgtatagaattatctacaagtcaagaagaagaaaaaaagacaaccagagaagaaaattggcaaaggataagaaatacaaataaacatgaaaatgtgcttaactttatttgtaatcaagaaaagtaaaattaaaacaacagagaaaagctattttctaactattaaatcggcaaaattaaaaagcattaggccaaggatagtgaaaatagatactcatacagctggtggtgtgtaaattggaataactaatttgtaaaagcaattgtctatctctggtaaacatgaagatatcctgtgcatcctatgaaatgccaattccatcttgaggaatctaccttagaaaaactcttgcacatatatacaaggaaacacgtacaagaatgttcaacacagcccagtttattatagtgaaaacatggaaacaacctaaatgtttatcagtagggaaatatttaccattgggaactatcaaaaaggtaagtaggttccatattgttttataaaagatctccagacattgttgattaaaaaaaaaaaagatgcagaaaggatatatcagacacttaaaaacaacttaaaacatgaaaacagaacaagctcacaaactatatttctgtatttttgaaaatatgtaccccaaactgataatagttgttatctatgggaactggaattagtctttagctttatctgtattgtttgaacctttaaaaattattgtgtgtttaactagaaataaacatttttaaaaatttaaagatcataccagtactttgatttaccaatttaagcttcttaatactataaagtattaacagggaagagccagcaatttctagataatacaacgtaagatggggcactttgtaggtttttggatttttcttgttttgctttcatttttggttttgagaggtagtggggtgaatggaagaatacgggctttggagtcaaatctaagtttgaatccaagctctgccatttatttagactttgggcaggtttcttaacctctctagtttttaaaaaaattgctattacctacttcgttgggttgtataagaattacatgtgctagatttcctcatttccccattccctttggttaagggaaattggtctagtgtggtctaagatcaaagatggtctcgtatggatgacaaaatgtttcacaagaacacactatatccttggaccaggatataccagtaaagatggaggatgtaaataataaattttagaggtctattaactgtttaaaccattaagctatctatttgtacctcacaagatcaaatactagattatgttagtgatttataaatgatattgaacttgaaacttctaagcagtttacatgacaggttgttgattaacaggtttacttttttttttaaatctcagagaacattttaatttagttcagcaaacatttatttgtgccatccagcatctcaatctcaagaggcctcatagaccaaaatatgtctcaaaaggaagaaaggaaaactctatgtatttatcaatttatttatcaaactctggcaaggggggaaaaagtcaggtttaaagttgagtatatgtatatactctgcttttcacttgtactgctattgcctatgtgtgcatctgttaatatcatatatagcaattcatatgaagattttttccagtgagacttagttattctattattgggactctgtattaaataataatttttaaaaaagagtgctctaactaatgttaaggtggaaattctagacccctcaaacaaaaatttccaaataggaccccttatcatttaattgtgaaataaacaactaatgcttttatggtatttatgcttgggaagagaataaaataaatagttttggattttccccatataaattagggcctgctgagtaattagcagttaataagtgaatgcttcctacaagtttaaaggtcatacctgaaatgggtatatgatgatgtatatttttatagttatagattttatatagcccaagaatccttgaagatagtctaaacatcttggtttgatgagcagaactttcaataagggggtaaggggctaatattgtttgagcacttactatgtgccaagcactattctaagatgattacatagattattttatttaatcttcaccacagtcttctgtggtaggtactagtattgcccaattttatagaaaagggcagagagataaggtaacttatatgaagttacacagtcagtaaatgacagagctagaaatcatatccaggttcagttggctcaagaacccatattcttaaccattgcagtaaaaattgttatgctgttttaatctgtagagtcagcatgtagcaataataatataatcattaacatgttacattttgcatatattgaatgctttctaaagaagtagtttattatcagacatattcttagaatcatacccattttatagcaggattgacagtgttataaagagattacgtgatcaacatggggtgagtcaacagaaccaagaagtttctgatccacaattgccttcacttgctaggttcaagtaaggatcatatagtgtttacttacatttgccttagatttttcagtatagcatgatgaaattctaaatgcttatctcagacagtgatgctatctgagcaagacatggacaattgggcattagtgtgaattttaggacactagagcgtaggtacaggttagaaaacttaatcctcatcttgtggaagtcatggcaaagccaaagaggaaaagcctgtcttaaatgcttttccttttccaaggggcagctaaggtgcccagatatctttgccctccagggatgcaggtgtgctgttttttattctttaatcattcacataaattaaagcctattcctttgcattaaaaaaaatgtaaaatgacactctccgtgttttattgccaggcaagagctttgaacttctgtctcattgaagtttgataaactaaggattttcccgtgttgggtggtacccttaaccacagagggagcattagactgataagagctgcaggtgaaggaaaccaccagggcacggcaattagggagagcttcgcacttggctgttggctggtgtaaaactctctgcagggaggaacttttcttcttagcttcttcccttcacccacacgtaaaaagaacaccagggctttctatttctactttgcgaactaggaatggatgggatggttcttttcaagaaactttcaaatttagggacaagttctaacttcacacaaatgctgattggtatgaaggtggggggacaggacagacagacatacacacacataaattcacgtggacccaaatggaccatatctctcaggtgattttactatcaacatacattcctgcctttgtgcactgtgtaaaataaagataatttttacttccataactgattataaagtgttaatggtgaggcaacgtgttaagagaatgggttcttgtatcaggtaaaccttggttcaaatcttggcttctcttcccactagctgtgtaaattaattttgtaagtctcagttctcccacttgtaaaaatagaagtctaagaataactattataggattgtatttggaagaaatagaataaagcatgtgaaacaattagtacagtactatatctgtcacattgttgtttaataaattgtgcaagtactcaaaaatggtagctgttattatttgtaatatgaaactaaatatctgattggtagattaatgttaaacatgcatggtccaatatatttctttctttccttttttatatttttggtataaagtctattttcttgaaaattcctgctttttttttctagaaggacaaaagtactttgatttttactgctctgaaaatatttatcccgtaaaaagctttcacattaactttgagtccctggagctagggaggagaagcagcaggatttgctactaagtagagctctttcatttctaccatcaaaaagaaaaaaaaaaaaaatcctgtgctagccttaggtagagctaagtcataaaaggccatatagcctaaggaaggactctttttataagatcaggataaaccgatagaagaaaggaaggagaacacagaggtgaaaatgcagctgattttaatgtttccctggccattttccctcccaatttaatatacacctaattataattattatattttgaaaacaataccagaaattggcaggtattatctcacagcttcactcttagttttggccgtttcttaaagaaacagttttctagttggatgaactgttgagttgaggcactgattttgttttcacctctttttgggtggggttgggggtgggcagtcagggtttgcagtggtttatagttgttagttttgggaagcactcatttagatagaatgagtcacagaatgtaaacaggtcatccatctggactttaggctgctgggaacgtggtgaaaccttaggtcaccgcgatcattatggtcaaatgaagacttttgggctcaggttggcaggtaaacttacttgttttatgagcttcactagactaccaggacttcagaaatagttttttgaaataccaatatttataaattttaggtaattccatcatattttcctgaggaatgaaactgtgaaagaagtaaatgtctactttggcagcaacttcatagaattgctttttggaaggatattcatcactttggggttttttgttctcactgctccagatgaaagtatttttctgaattttttatggtaaatgtggacactgaattggaagcttctatgtaaagtttgtcaggaaacctctgtcatacctaaggataaaattcagagaaagggaagaagtatttgagtacctgacatctaagaagttctggcctatgttgtttactgagtaaactcccaataatgctttgagacaggcttttaaggaaacatgttatcaatcacgtactatgtaccaaacacatagtggtgttttacctgtattatcttatttatttctcataaccctataatgtaagtaccattattatccccattttaccatgaagaataggcttgaagaataatttgtttatggtcacataactaggaagtggcagagctgagaatggagctctcaactctctgtaatccaaagcccaggttcttaaccagtgattcttaaacttaagagtacataagaagcatcaggagtacttgttaaaaattactgggctgtagtaaaaaatgtaaggtcactaaatctgggacagtgccagactataaatctgcgttttaaacggcatcccaggggattcagatcaagaaattgattgaccatattttgagaaacatagttaaattatattgcttttcacacttgataaagaagaaaacaggtgtagactaagtaactatccaagattaagctaccaagacagagccatgattcaaactcaggtctgtctcactctaatactcatactttttattatacgcccatgattaactcacacatttccaagtcacaacaaatgcagaaaacatgacatctaataaaccaagccagatagatttcatggtcttgttatttaccaaagttaataacttatatatacaccagtacgaaaattttcatggtccttaaacctttccagtgactttttttttttttttctaatttaaattaactgagttttcttttttttctgttctgaaatgaagtctggctctgtcgcccaggctggagtgcaatggcatgatcttggctcactgcaacctccacctcccaggttcaagcaattcccctgccgcagcttcctgagtagctgggattactagctactcaggaagtagccactgcatctggctaatttttgtattattggtagagacaggttttcaccatgttgccaagctggtctcgaactcctgacctcaagtgatccacccgcctcagcctcccaaaatgctgggattacaggcctgagccactgtgcctggccagagttttctttacaatcataccatccatgcttcaagcatggaattactaactccctgggataagtttctgatgcagaaatggaaaagaatagaaggaggtagaaagaaaagaacttccaggtgtatctgctgaatggtgctaaatctcctcttcaacccacccttgtgattgagatgaagaatgaagggttgatgctaatactaacagccagtcaaatggcaattggtcatgttcacatcatctcccaatctatcctttgagactatagctcagttagggtcagcaagtttgctttgcctattccagtccactgatgaagtgtcatcagacagagccaacacctggattgccttacacatgacctcctactaggattgggatcattctttttaaaatctttctctcattttctctttctctcttgctatttgattgcagctcagcgacatgtcctcacctacatggaggatgcagtgtgccagctgctagaaaacagggaagatattagccaatatggaattgccaggttcttcactgaatagtaagtacatgaatgttgtactaatacagtgaacccagaggaggcgcttggaagcaggcaggatacttgaggaacagagcaggacaatgctgattaggtagtggcagtgaatgtttagttttggtaggttggttgtgggccgcccaaacatgttttggagcatgcctttggtgcagctagtttgtccagtgatgtctcatgaatagttttgattacagtagcttaacaactgcttgtttgatctattagatctatttctgtaggtttctcttttaactttctcctttattcaaaatattcactttgatttcctttcgctgatgttcatctagcctgttttttttcatggctggcttttctcatggaatctaggctaatgttcctctgcagttttctttctacaggatgctgtgccaatcacttaatgatttaagtgtatttctaatcagcaaagtgaagagacaacccacagaatgggagaaagtatttgcaaactacccatctgacaagggattaataaccagaatatataaggagctcaaatatctctataggaaaacatccaataatcccatcaaaaaatggacaaaagatgtgcatagacacttctcaaaacaagacatacaaatggcaaacaggcataagcaaaggtgctcaacatcattgatcatcagagaaatgcaaatcaaaactacaatgagataacatctcaccccagttacaatggcttgtatcctaaagacaggcaataacaaatgctggcgaggatgtggagaaagggaacccttctacactgttgatggggatgtaaattagtataaccactgtggagaacagtttggaggttcctcaaaaaactaggaatagggctgccatatgatccagcaattcaactgctgggtatatacccaaaagaaaggaaattagtgtatcgaataaatatcagtactcctatgtttgttacagcactgtttagagtactaagatttggaagcaatctaagtgtccatcaacagatgaatgggtaaagaaaatgtggtacatatacacaatggagtattatttggccctaagaaagaatgagatcctgtcatttgcaacaacatgaatggaactgaagatcattatgttaagtgaaataagccaggcacagaaagacaaacattggatgttctcacttgtttgtgggatgtaaaaatcaaaacaattaaactcatggacaaagagaatagaaggatggttaccagagattgggaagggtagcagggggctgggggaagaggtggggatggttgatggttacaaaaaagaaaaaaaagaatgaaaaagacctgctatttgatagcacaacagggtgactctagtcaatgataacttaattgttcattttaaaataactcaaagggtacatttagattgtttgtaacacaaaggaaaaatgcttgatggggtggataccctattctccatgatatgattagttaacattgcatgtctgtatcaaaacatattatgtgccctaaaaatatatacacctactatgtacccatgaaaattagaacttaaaaaaattttttaaaggaatatttctagagggaggatatctttcatagattatatatttgaaaggtcatacctaggccaggcatggtggctcaaacccgtaatcccagcactttgggaggctgaggtgggcagatcatgaggtcaggagttggagaccagcctgaccaacatgttgaaaccccatctctactaaaaatacaaaaatcagccaggcatggtggcacgcacctgtaatcccagctactagggaggctgaggcaggagaatcgcttgaacccagtaggcagaggtggcagtgagccaagatggtgccactgcactccagcctggccaacagagagagactccgtctcaaaaaaaaaaacaggtcatacttctttataaagtatacttagaatgtgtaaaagtcaaaatgattactaccttttttatttttctgagatagaattttactctgttgttaaggctggagtacagtggcatcatcatggctcattgtagccttgaactcctgggttcaaggaatcctcctgcctcagcctccccagtagctgggactacaggtatgtactatcatgctcagctaaatttaaaatttatcttttgtagagacagggtttcagtatgttgaccaggctggttttgaactgcaggcctcaagtaatcctctcaccttggcctctcaaagtgttgggattgtaggcatgagccaccatgcccaactgattaccactttttgaatatcacagaactgtttttaggctgaatgagataaacactttaaaaacacattaatattctttttcttccaacttttattttagatacagggaatacatgtgcaggtttgttacatgggtacattgcacccaggtagtgagcatagtacccaataggtagtttttgacccattacccctctcccttctcccctctagcagtccacagtgtctgttgctcccatgttcatgtccatgaatgctcaatgtttagctcccacttataagtgagaacatgtggtatttggttttctgtacctacattaattcacttaggattatggcctctagctccatccatgttgctacaaaggacatgatttcattcttttttatggctgcatagtactccatggtatatatgtaccatattttctttatccagttcaccttgatgggcacctaggttgactccatgtctttgctattgtgaatagtgcagcaatgaatgtacgagtgcatggggagaatgatgtattttcctttggcatacccactaatgaatgggactgctgagtcaaattgtagctctgttttaagttctttgagaaatctccaaactcatttccacagtagctgaattaatttacattcccaccaacagtgtataagcatcctcttttctcagcagccttgccagcatctgtgttttttcttttttgactttttaataatagtcattctgactggcatgagatggtatctcactgtggttttgatttgcatttctctgatgatgagtgataatgagcattttttcatatgtttcttggccacttatatatcttcttttgagaaaatgtctgttcatgtcctttgaccatttttaaatggggttatttcgtttttgcttcttaagttccttatagattctggatattagacctttgttggatgcatagtttgtgaatattttttcccattctgtaggttgtctattgatagtttcttttgctgtgcagaagctttttagtttaattaggtcccacttgtcagtttttgtttttgttgcaattgcttttggggacttggccaagaattatttgccaaggctgatgttgagaaggatatttcctaggttttcttctaggatttttatagtttgagatcttacatttaaatctttaatctatcttgaattaatttttgtatatagtgaaaggtaagggtccagtttcattcttctgcatatggctagccagttatcccagcaccatttattaaacagggagtcctttccccagtgcttgtttttgtcagccttgtcaaagataagattgttttaagtgtgtgctttatttttgagttttctgtactttccattggtctatgtttctgtttttgtaccggtaccatgcaaaacgcaatcttcatgaaaggatgtgctagagaaatacatatgccatcacatatttatataatcgtttggattctctttccttttcttctggtttttgggaacattctaagaaaggaagagtaatccttataggcttccatttaagtgaatcttgaactcaagttcatctttcttgaacatagtttttttttttttttttcctttctgttctccagaggctccttggagatcagacagctattcaaatggcctcaccttgggtttctgttaggggaatacttgagattccctagctcttttgctgaactctaaagttcttttcaatgaaatctagattttttatggattggcatttaggttcgttggaaaaagaagctttctgggagtaaagttgttcctttcacccagtcttctaaaggaggatgaagtagagaaaggaattttatttgttctcatgatgtgggctggagcaaatgaggtgggcagggaataaagactgagattgaatagccttgcttgcttttacagaacagacaagtgaactgacaagcctacgggtcaagtttctataccatttaatctgtaccagcactcttgaggctccttgccaagtgaaatatgactcttctgggggtaatgcttcttcctggcttttttcattttactcccctccccatctctgttacaagtcttttccctattacactggttgcttgaaggtaggcatcatttaaatttttttttgaggcagagtctccctctgttgcccaggccggagtgcagtggtgcaatcttggctcactgcaacctccgtctcccgggttcaagagattctcccgcctcagcctcccgagtagctgggattacaggcacccgccaccatacctggctaatttttgtatttttactagagacggggtttcaccgtgttagccaggcttgtcttgaactcctggcctcaagtgatctgcccgccttggcatcccaaagtgttgggattataggtgtgagccatttgtgcccggcctcatttattcttcatctttgcattcctggtacttggcatgatgctttgcatataatagatgttagctaaatatttattgaatcaacagcagtatctatattttaagttattgaatactatctactcttctagattttgttataataaggactactttcttgttttttcctccctttctttttttattttttttatttattattattttttattatactttaagttctagggtatatgtgcacaacatggaggtttgttacatatgtatacatgtgccatgttggtgtgctgcacccattaacttgtcatttacattgggtatatctactaatgctatcccttccccctccccccaccccaagacaggccccagtgtgtgatgtttcccatcctgtgtccaagtgttttcattgttcaatgcccacctatgagtgagaacatgcggtgtttggttttctctccttgtgacagtttgctcagagtgatggtttccagcttcatccatgtccctacaaaggacatgatctcatccttttttatggctgcatagtattccatggtgtatatgtgcccattttcttaacccagtctatcattgatggacatttgggttggttccaagtctttgctatcgtgaatagtgccacaataaacatacatgtgcatgtgtctttatagcagcatgatttataatcctttgggtatatacccagtaatgggatggctgggtcaaatggtatttctagttctagatccttgaggaatcgccacactgtcttccataatggttgaactagtttacagtcccaccaacagtgtaaaaatgttcctatttctccacatcctctccagcacctgttgtttcctgactttttaatgatcaccattctaactggtgtgaaatggtatctcattgtggttttgatttgcgttctctgatggccagtgatgatgagcattttttcatgtgtctgttggctgcataaatgtcttcttttgagaagtatctgttcgtatcctttgcccactttttgatggggttgtttgattttttcttgtaaatttgttgaagttctttgtagattctggatagtagccctttgtcagatgggtagattgcagaaattttctcccattctgtaggttgcctgttcactctgatggtagtttcttttgcagtgcagaagctctttagtttaattataccccatttctcagttttggcttttgttgccattgcttttggtgttttagacgtgaagaagtccttgcccatgcctgtcctgaatggtattgcctaggttttcttttcttttcttttctttttttttttgcctaggttttcttctagggtttttatggttttaggtctgacatttaagtctttaattcatcttgaattaatttttgtataaggtgtaaggaagggatccagtttcagctttctacatatggctagccagttttcccagaaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactgtagccttgtagtatagtttgaagtcagatagcatgatgtctccagctttgttcttttggcttaggattgtcttggaaatgagggctcttttttggttccatatgtactttaaagtagttttttccagttctgtgaagaaagtcattggtagcttgatggggatggcattgaatctataaattaccttgggcagtatggccattttcacgatattgattcttcccatccatgagcatggaatgttcttccttttgtttgtgtcctcttttatttcgttgagcagtggtttgtaattctccttgaagaggtccttcacatcccttgtaagttggattcctgggtattttattctctttgaagtaattgtgaatgggcgttcactcatgattttgctctcagtttgtctgttattggtgtataggaatgcttgtgatttttgcacattgattttgtatcctgagactttgctgaagttgcttatcagcttaaggagattttgggctgagatgatggggttttctaaatatataatcatgtcatctgcaaagagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagcttttgcccattcagtatgatattggctgtgggattgtcataaatagctcattattttgagatacaccccgtcaatacctgatttattgagagtttttagcaggaagggctgttgaattttgtcaaaggccttttctgcatctgttgagataatcatgtggtttttgtctttggttctgtttatatgatggattacatttattgatttgtgtatgttgaaccagtcttgcatcccagggatgaagcccacttgatcatggtggataagctttttgatgtactgctggattcggtttgccagtattttattgaggatttttgcatcgatgttcatcagggatattggtctaaaattctctttttttgttatgtctctgccaggctttggtatcaggatgatgctggcctcataaaatgagttagggaggattccctctttttctattgattggaatagtttcagaaggaatagtaccagctcctctttgtacctctggtagaattcagctgtgaatccatctggtcctggactttttttggttggtaggctattaattattgccttaatttcagagcctgttattggtctactcagggattcaacttcttcctggtttagtcttgggagagtgtatgtgtccaggaatttatccatttcttctagattttctagtttatttgcgtagaggtgtttatagcattctctgatggtagtttgtatttctgtgggatcagtggtaatatcccctttatcattttttattgcgtctatttgattcttctctcttttcttctttattagtcttgctagtggtctatcaattttgttgatcttttcaaaaaaccagctcctggattcattgattttttgaaagtttttttgtgtctctatctccttcagttctgctctgatcttagttatttcttgccttctgctagcttttgaatttgtttgctcttgcttctttagttcttttaattgtgatgttagggtgtcagttttagatctttcctgctttcccttgtgggcatttagtgctatcaatttccctctacacactgctttaaatgtgtcccagagattctggtatgttgtgtctttgttctcattggtttcaaagaacatctttatttctgccttcatttcattatgtacccagtagtcattcaggagcaagttgttcagtttccatgtagttgattggttttgagagagtttcttcatgctgagttctagtttgattgcactgtggtctgagagacagtttgttataatttctggtgttttacatttgctgaggagtgctttactaccaactatgtggtcaattttggaataagtgcgatgtggtgctgagtagaatgtatattctgttgatatggggtggagagttctgtagatgtctactaggtctgcttggtgcagagctgagttcaattcctggatatccttgttaactttctgtctcgttgatctgtcatatgttgacagtggggtgttaaagtctcccattattattgtgtgggagtctaagtctctttgtaggtctctaaggacttgctttatgaatctgggtgctcctgtattgggtgcgtatatatttaggatagttagctcttcttgttgaattgatccctttaccattatgtaatggccttctttgtctcttttgatctttgttggtttaaagtctgtttaatcaaagactaggattgcaacccctgcttttttttgttttccatttgcatggtagatcttcctccatccctttattttgagcctatgtgtgtctctgcatgtgagatgggtctcctgaatatagcacactgatgggtcttgactctttatccaatttgccagtctgtgtcttttaactggagcatttagcccatttacatttaaggttaatattgttttttattttattttatttttttttttgagacggagtttcgctctgtcgcccaggctggagtgcagtggtgcaatctcgactcactgcaagctccgcctcccgggttcacgccattctcctgcctcagcctcccgtctagctgggactacaggcacgcgccaccatgcccggctaatttttgtatttttagtagagacggggtttcaccatgttagccaggatggtctcgatctcctgacctcgtgatccgcccgtctcggtctcccaaagttaaggttaatattgttaatgtgtgaatttgatcctgtcattatgatgttagctgattattttgctctttagttgatgcagtttcttcctagcattgatggtctttacaatttggcatgtttttgcagtggctggtactggtttttcctttccacgtttagtgcttccttcaggggctcgcctggtggtgataaaatctctcagcatttgcttgtctgtaaaggattttatttctccttcacttatgaagcttagtttgactgggtatgaaattctgggttgaaaattcttttctttaagaatgttgaatattggcccccactctcttctggcttgtagagtttctgccaagagatctgctgttagtctgatgggcttccctttgcgggtaacccgacctttccctctggctgtccttaacattttttccttcatttcagctttgatgaatctgacaattttgtgtcttggagttgctcttctcgaggagtatctttgtggtgttctctgtatttcctgaatttgaatgttggctttcctcgctaggttggggaagttctcctggataatatcctgaagagtgttttccaacttggttctgttctccgcattactttcaggtacaccaatcagatgtagatttggtcttttcacatagtcccatatttcttggaggctttgttcgtttctttttactcttttttctctaaacttctcttcttgcttcatttcattcatttgatcttcaatcactcttacccttttttccagttgatcaaatcggctactgaagcttgtgtgtgtgtcacatagttcttgtgccatggttttcagctccatcaggtcatttaaggtcttttctacactggttattctagttagccattcgtctaatcatttttcaaggtttttagcttctttgcgatggattcggacatcctcctttagctcggagaagtttgttattacctatcgtctgaagccttcttctctcaactcgtcaaagtcgttctccgtccagctttcctctgttgctggcgaggatctgcgtttctttggagaaaaggcactctgatttttagaattttcagcttttctgctctggtttctccccatctttgtggttttatctacctttggtctttgatgatggtgacgtacagatggggttttggtgtggatgccctttctgtttgttagttttccttctaacagacaggaccctcagctgcaggtctgttggagtttgttggaggtccactccagaccctgtttgcctgggtatcaccagcggaggctgcagaaccgcaaatattgcagaggagcaaatgtagttgcctgatcgttcctctggaagctttgtctcagaggggcacccagccgtatgaagtgtcagtcggcccctactgggaggtgcttaccagttaggctactcgggggtcagggacccacttgaggaggcagtctttccattctcagatctcaaactccgtgctgggagatccattaccctcttcaaagctccgttggaaatgcggaaatcacccgtcttctgcgtcgctcacgctgggagctgtagactggagctgttcctattcggccatcttggaacctccccttttcctccctttcttgattctttgtggtaaagctctatattgtgccattttagaagctgtatactgtgcgccttgcactccaaaagtgaattccacttgttctgtgtagccaatgctgagctgtagtgaaccaacagtaaggctgactgtaggcagcttttatctaccaacacactgttgaaaaaaaatcgtaagattttctacagtgctgatagaaatgtacttgccaagcaggctgtttcttgtccccagaaagctgaaatttacataatatacgagtgacacatacctgacacttccataagtctatgacaccagattggcttgaggtaaattattctaagaagtgaaaagtaaaccagctccagaaacttttgggttttctttttttttgaagacctgaaaggtgtggatgtatgacagaatgggaaatagtgtaagtataatttggtagacaaggagacctggatgatggaagctcctgagtttactttgtgaatttgatttagttagtgaaaatccttcactttcaggcttcagtttttttgttttgtttttttttgttttttgagatggagtcttgctctgtcgcccaggctggggtgcagtggcgcgatctcggctcaccgcaagctccgcctctcaggttcacgacattctcccgcctcagcctcccgagtatctgggactacaggtgcccgccacatgcccggctaatttttgttttttgtatttttagtagagagggggcttcaccgtgttagccaggatggtctcgatttcctgaccttgtgatccgcctgcctcggccttccaaagtgctgggattacaggtgtgagccaccgcgcctggcctcaggcttcagttttgtattgattaataagagaaacatagtgaagtggaaagagcactaccctagaaggaaaaagagctgcttattcttctaagtcctcactctataaccctgggcaaatttctgaaatatgggcttcagttgcctcatctatgaagtgggtttaataaagccttacatgataataataataatataataattatatattataatatgcagtttttactaaactaataccatgtctcagctactacaattctttgagatgggtactattattattgttatctctgttttatagaggaggaagtggatgctcagaaagattaaaatagcttcttcaagttcacaagctgttaagtgacagactcaggaatcaagcctcatctgcagtattatagagtccactgttctctactgcctccaagccactttactgcttaatgttgctagagggctaaccagatcatatttggaggtttcttctagctataatttctactatttttgaattctcccttatgaactatactttgcaagcttatcacacagccttagctggtgacctcagtttactgccatttaaatgtttaatatggccttttgggggatgcaactagagctgactataaagagcaggaagcatgattttcaaaaatatgttaacggtatccttccatcttacagtttcgagttcacatcttgagactttcatatatttagccgtgggtgatttacctttaaacagtgataaaagtactccttgaaattgtatttggaaggcttctcttctgattttcttctctgggtctgcttgccctctcacctatgctgtctgtcactccttggttgttggtgttttcaaacaagtccatgactgttccagcaaatctggataaactgtaaaacacaagtggctgaacagtactttgtgtatgtctgcaagaccatgagctctgtagatcatattcctctggacactcttgaaagacggatactaaatcccagaggattttcttttatgttgtatgtaacctctacctctgaatgttgtccttcaaccagtggaaggtaaaagaaattaatatttagaggtgctactctaagaataggccaaatgtcagcactgggtcaggacctctgaagaaatacatccaagaaaatgggcgagagtagctctaacttagaaaccacagcagagtgtgaccagattcttgtggtaaagataaaatgagaaatgtggctttttgagacattggaaaataatgatgagagaaaaacaggatgaaatctgagaatttgtatcagaattgggaaccattcttcacaggctaaattgatagttccaacactatggcatcagggagcttgacttccacatactaatatagaaaagaataatattctgtggtcttggttggtgggcccaggagagctcgcttttatgatcaagtgtcttgttttcgttttttaaaggatgattttagttttttggtgaagtttttatgatgactgttttggttgcaagggaaagaagtacacagactacctttggtttattttaaggatacgtgagaatatgcagcattcatttgtgaattattcattcacaaattacttttgggcacctactctgtgcctgtgtgtactatgcaatgggaatagagcagtgagcaagacaaataaggtacctatctttatgaacctagtgttttaatgagggtaataatcaataaacaagcaaactgatggggatgagaatagctaatagttaataagcactgtgtgctaggcactgttctaagcatataatatccattattttatttaatcttcacagttctatataaacagggtattagtattatcctcattttactcataaggaaattcaggctataaaagtaacattctcatggttacatagctggtaactgtaacaagacaaataacaagaaaacagccagagtaaggtaatatatagtatggacagggaagtcctcttggaagagatgacgattgagagctcatcccatcagagagccaataacttagctcagagggtgatgcaccttttctttgtccaccttgattatctaagtaagcttcctgtgtccaaaaatgatcatttgattgattttatttgttgctactgagaatggagtacccttactaggcagtgttcttaggaccccctcatgggtaactggcctccctcatgctctgctcctatttaaccagtgaaagtaaataaaataattcatcatcaaaagtatttgtgttctacactacatagtataaatatggagatggaaatctttgtcagtttttagaaaaggagcattaataatttcattttgatacatgttaatcatcagaattaattttgattcaaataaatccataaaatatgaacttcattaattcatccttggagaaaaaaagagattccaatagtgcatacccgttttttttttcttttttcttttcttttactttaagttctgggatacatgtgtagaacgtgcaggtttgttacataggtaatagtgcatattcctaaataacttaaaacgtaactctaatgaaaacaatccatgattataaaatatgtatcatttcttgttattttttttttcagacaggtgctttaagccctatgaaaagatgacccacttctttcctacataatctataacaatcagggcataaacattcattctaaaggtgacagattttttaaggatcattcaccatctagagtttaaataatgttgtttggggttcttcttgtgtccatggtaacagaggagcaggtgtgaggcaacaagaagcacatcagaacaaaccaagacttcgctgatttccagcttgtagctctgaatgagagatggacttgagacttctttgggccatttctgctcatgttttctctacttatttacgttaaattgagccaaaatgtggtgtggtaaagtaatggtgactaatcctattatagacttcttcaaaaggggtaatgcttccccctttacccaccccctcccctgacttttttccatagttcagttcttagctgttaaacattgtaacagaaaattacccgtttctcattgtcagcatctggtttcccacagactcagataattgtcaggaagagatttgccttcagttaaagcaaccctatccccactgttactaggccaggcacctctgttagaccatcatagaaccaaatctatagaggattctttctggctcttttctgtattactagaggtatgctatagcaaaaagactacagggagccatggtggtgagttaagagtcaaaatctgttttgaaacttaaaaatccagggtcattgaggatgcaagaagttgcctgtttttgtagaatccatctcacttcttcagtccctttgtattatggttacaggaaactatccagcagcacttgacctggtaatggaggaagctatttcacagcccactggtcccttgactcgtttagaagtcagagtcaaaggttacagaagtaataattgggcccagattctccctgtcaggaaagaccttgttccccccaccccaccccctgccttctacaagttaagagaaacttatctgttataaaaccattcaataagaggaaatgaagaaacaccatccttggctgaagtgttctcaagccccaatgatactatttctgttttcatgggagctgcttttgcagctagctagtataaaatttaggtctgattttttacattaaaatatctccccttagataaataacttgatttatttcaatctataaataatatgaaggatctttatttggtccaagccctgatattccttcacaccaccactctgataattccctgaatacttgtctggcaatcaagtacactcacacgagtcttaattaacaagtgttatgccattagcaatgtaaagtcagtcatcaaaagttaagaaactaggccagattataggctcacacctataatcccagcactttgggaagccaaggtgggaaaatcacttgaggccaggagtttgaggccatcctgggcaacacaatgagacccctgtctctacaagaagaataagaagtttaaaaagctttacttcaccagcaacagaacaatttaaaattttcagtgcttttaatttcttccataatttgctcagaactctagcagatcaatctgtggtgccattggcacaggcttggcactggagtaggaaagaatgacacaatttggcacctttaaccagaagatctttaatgagctggcgtgggggtggaggggacagagaggaaggaaggacagttaggattttggcagtaacacaaaggttcttcttccctgagaaaagtgaaatgaaagtcaaatgaagcttcactctgcttttagaatttgctaagatgtttgtctgtctctcagctcccggcccccttgcaggtgcatcattatagtcagtgacttctccaaaaaacaaattgtctctcaggatccttcaggaggggtcatatctaaccaatttcttgtctgaggacataattgtgattcccttcttcaactatcagatgcaatgctaccagcactgcagaaactgtcttatcagaaagtggcacaaatgtgtacatttcttctaggtcacagttctagtattgctgagttctggggctgcaacaatagataatactacaatgagagatgtttgggaaaagcattgtttcctgggtggccgtagaagcagacttgaaatcatccctttgtcattaaataatatcaacaacaaatgtctttgttgatgtcattgtattgtaattttctaggtctagattattgctagggatgataatacctatcttctagggttgttatgcaaatcacatgaaattacacatgcaagatgtctggctatatataattcatcttcattgtgtgttgttctccttaagctccacttttctgggatttttgtatctctgtggatctggatagtcttccttttctctctctttaaatggcatcagagttgaagatcttgaggactttttagtctctcttttgttttttgttgttgttgttgttactggtttgtttttgtttttgtttttttgtttttgttttttttttttgagatagtgtctcactctgtcacccaggctggagttgtagcacaaacatggctcattgcagccttaacctgggctcaagcaatcctcctgcctcagcttcccatgtagccatgaccacaggtgcgtgccaccatacccagctaacttttttttttcttttttatagagacgggtctcattttattgctcaaactggtcttgaactcctgggctcatgttatgctcctgcctcagcctcccaaaatgctagaattacaggtgtgcgccactgtacctggcctctcttactttctataacacttctttcttgccctgtattttgtgtacgtttttggagactaaaacattcaatgattgcctgcatgactcttaaccacttcactcatcatttagttcattcacagaatagcctaagaaagcttttctatctttgttttctttgcatatgccattttctcacttcctgtctttaccccctttcctctagatacagaattttaaaactcaaggtgtagtgggagacttgagtcagtcaactctatccaacttgtgttgttcccactcttagctctagcagtacagtgatgggctcagggtaatgaaaagcagactttctctgctgaggtcattgctcctcatgctggcagcctgctccaggaagctgtttatctatgcttgcagagccaagctccagcctctgaacagttggaatgtattgagaaaccacagagcccaaagagagaacattacacaggcagttccaggcagggagagtatatttacaccagacaaactgcagcttacatgtgtggggataattgttcatctgcacactctcatactttaccttctatgcaatctatataccctctcaagaaggtttaaccaggagaacttgtactgctatgtccaaattaccctgaacatcccctaaaatgtcataaggaaaaagagatactacagaaaattgatgtaaaaactttttaagatagtggtttttttgtttttctgagtcaaattttatgtttagaatcttagaccatgtaagcctgatcactaaagcattcaaaaacactgtttcttgcatggaaatgtttttcttcatccctttacaaaaatattaagtattgttatagagcttcaaatgtgctctatattaataggaatataagatatggtcacttccctgtaagatgtaatctggttaaagaggtaaaactcattgaataacgaacaattacagagcaatacaagaccttatataatggcattaagttatatggcccagtacactgagaattgagagtaaggaaaaataatggctattagttaagtaaaattagttgagtcttatagaggagtttgtcttaattttggaaaggaaggtagagtttggataaacaaaacagaaaggagacatattttgcaacatgaaagcaccataacatagtggttaagaacatggactttggaatcagataggtctatgttagagggcctgccactttctggtatgagatcttgggcagattgcttacctcatctataaaatagggagactcatatataaaatataaaattccatgttacataattgttggaatgattaaatgagttaatgaaagtaaagtgcttggcatttcacttaagatacaataagtgttgaattaattagtagctactgctactactgttgttcactcattcattcaatatatatttattgagtgcctacgtcttagcgttctagatactagggatatagcagtgaaaaaaacagaccagaaatttcaactcttatggagcttccattctgaaattgttttcattttacctttttagaatgtgtgtgaataattttggacttacataaagtttaaaaaaatctatatatggagttcccacatccatttcatacagcttctactaatgttaacatttcctgtatccataatataactgccaaaatcaagaacttaacattaattcaaaactattaactaatctatacgtcttatttacattttcacctcatttttgaagggcagtttttttcctgagataaattctaggttggcagctgttttaccattccattatcttttggtttctactgactttgttgagaagttgctctcagttttattcttgcttctttgaaaataatctttttttaaatctctggatggtttttggatatttctacttggtctttggtttttgatagttttagtgtaatgtgtctagttttgcttttctttatatttaaactattcggtgttcttagtgcttcttgaacctatagcttgatatcatttatcagtcctggaaaactctcaataattagctcttcaaatttacttctgttctactctctctctgtctctgtctcttttttttttttgaggcaggatctctgtctgtcacccaggttggagtgcagtggtgcagtcatggctcactgcagcctctacctcctgggctcaggcaatcctcttgcctcactcagcctcccaagtggctgggaccacagttgcacgccaccacactcagctaatttttttttttttttttttagagatagggtcttgccatcttgcccagactggtctcaaactcctgggctcaagtgatcctcctgcctcgccctcccaaagtgctgggattacagacatgagccaacacgactggcctctaccctctctttactcctattgggattctaattacacaaacattagaccttttcatagtattctctgtctcttatgctcttttttgcattttctatcattttgtgtggttttttttttttttttttttttgagacagagtctcactctgtcacccaggctggagtgcagtagcactatcttggctcactgcaacccaggtttgcctcccaggttcaacccactctgccttcctggttcaagtgattcttctgcctcagcctcctgagtagctgggattacaggcgcccaccaccgtggctggctaatttgtgtttttagtagagatggggtttcaccatgttgggcaggctggtctcaaactcctgacctcaaatgatctgcctgcctcggcctcccaaagtgctggaattacagtcatgagccaccatgcccagcccatcattttgtagtttatgctttattctggatattttcttctgatctattttccaggtcattaattctctcttcatttctgtgtaatttactattaaacccatctactgagttcttaattctaattattgtatttttttagttcaagtatttttattcagtttttgtttgtttccttgctaaatcttgtctttcatttgcttgaacatagtaaataaagcatggttattacaaagtccataatttattgtctggataccctgtgggtctgtttctgttttctgtcctatccattttttttttactccattatcttatcttgtgttatacttttttttttctctagttgagttatgtaaattgtgtatgagttatgtaaattgaaaaactatacagataatgtgaggcccagaatgatgttatctttcttcggaggggatttatatttgcttttggcagatggcctgggcactagcaatcctggattacctcaatcccatgagggtttgaaaggatttgaatatagatttacatctcagggagggctgattttcagtatagctctgaggagtgccaaaagagctttagggtttaccagagtcccagcccccaacgtgggtgggtcctgaactctattttttttttcttttctttttgagactgagtctcactctgtcgcccaggctggagtgcagtggaatgatcttggctcactgcaacctctgcctcccgggttcaagtgattctcctgcctcagcctcccaagtagctgggattacaggcctgcgccaccatgccaggctaattttttgtttttagtagagacggggtttcaccgtgctggccaggctggtctcgaactcctgacctggtgatctgcccgccttggcctctcaaagtgctgggattacaggtgtgagccaccgcgcccagccaactctgattttttatctgcaagccctaacagtcatttgaaaactcaggaacttaacattaattcaaaattattaactgcttagtgtatcagttgaatcttccagaactggcagaggcccctagagctaccagtgatataataataccttatttctgaagtggtgataagtataaatgatattgtgagatatctggtatgacagtaatgttatatgaaaatatctgaggtttctttttttttattttaaagttttttgtaaagatttggtcttgctatattgcccaggctactctcaaactccagtcctcaagtcatcctcctgcctcagcctcctaaagtgctgggattacaggtgtgaaccactgtgcctagccaatatctgagatttctattattgaaagagtcacaggtactgttaattctgctatgcttatattcataatagaaggaaatgccaaattccagttagaggttagtaaaaataaacataaaaatttccctggctcatgcctcccagcactttgggaggctgagcaagcagatcacaaggtcaggagatcgagaccatcctggctaacacggtgaaaccccgtctctactaaaaatacaaaaaaattagctgggcgtagtggcaggctcctgtagtcccagcttctcaggaggctgaggcaggagaatgccaggaacccaggaggtggaacttgcagtgagccaagatcacaccactgcactccagcctgggcaacagagcaagactccatctaaaaaaaaaaaaaaaaatttccctatccaagtgtgtggatctcttgaatttaatccatggacccttctgtttagaaaccctacacattgggaaaagtggcactaaatgctcagctcacctttctcggttttattctctcataacttggccttgtcattcttcatttgccttggtggctctctgatgacttcagacaattgtctttaataatttatccatttttttctcagccagaagagttagtctgaattacctactctacttttattggaggaagaactcttttaaaacttgcattctgatggaacatattaataattagttgaagtagaaaatatcatacactgcaagggatcataaaggaatctaatttgactcatggaggactagtacaaggtaaaaagcaacaaacagaaaatatataatgaggatagggccagtttgtggaaggctcaattatattgaaataagtagaaaggtaaaatggctgagtgtggtggctcatgcctgtaatcccagcactttgggaggccaaggcgggagcatcagctggggtcaggagctcgagaccagtccggccaacatggtgaaaccccatttctactaaaaatagaaaaattaactgggtgtggtggcaggcgcctgtaatcccagccacttgggaggctgaggcagaagaattgcttgaacctgggaggcagaggttgcagggaggttgcagtgacccaagatcgcactactgcactctagcatgggcaacagagtgacagagtaagactctgtctcaaaaagaaaaaaaaaaggaagaggaagaaaggcaaagacagtacctcataaatgctgagaaactcattgtttggtcttctttcaatttttaaaattcagtaactatttattaaatagttatcatatgccaatcactgtgtgtcagatatggtcctcaagaaattcactgtcatgtaaaaattagatagtgacacaaatacaattaaaatagagcattagaagttctggactagtgagtaaactttgacaggaaaagtgattatttatacggtcaggaaagaattcacagaatagtgacattaatttagttttaaagaatgtgtagataattatcagacagagaagagagaatggaactccgggaagcgaagactacttgggaaaggagtggaaataaaaagtagatcccaagtttagtgtgccttggcaaaaagaggaaagtggatgggaatggagatcatgttgagaaatgaaattcctcaaaagagtgggaccagcttttcttcaaagagtctcactttatacaaattccgtagcagtaaatgttcttggccgaagcaacggaatctgtctctggctatcttaagcaaagagactggagtggaaagatgtgtcagttgcagtagctgcttatggatcagactgttgtggtgagacctttgcctagtttcctgatgctcagcctccaaagctcctttgattcctgtctgtttttcaagtctgatggttcagccacctgtggattttgtgagccactaataatacccttccagcagagcccttttttgcttaagatagtgagacttggtttctgttgcttgcaaccaagaaccctattactgttattaatttttttggtacattcttgagtcatttaggaatgtattagttaccagatgaaactgaattctcataaatgttatttggtagtgacttttactttgtagggaaaaagaggtatgattggactgttattcttatttacaggtaatatttagattttgtttgatgttaacactgtccctggtaaatttttttttcttctctcaagcttcagtgtgattccccaggaaaatcttggaaattgccaatagagaagatgtattactaagtatcagaagttttcttggaaggacatctaataagtttcccaagatgtgattctgcctgttcagtagttgcttgagtgctgatgaaattccccccaaacacttcctaatatattattgaaatatttgagataaaggaaagctgaacatattaaaactaatttttaagtggtgagagaagtggaattgaagtctatttgaggaatttgaaacatttatcacccacggtttttccaaaaatatacatttgtgtcagtctgtcaaactttttatcaaaaaaaactgtgaattatccatttaaaatacatttttattacattttcttctgtatctgagaaatatgccagatggtagaaatttcctagaagtctctgacacttacagattgaaagatgaatgacgagaagacaagaatttgggtatccagattaatagatagaactttacaactattgacttcttatttgctcttgttgagttttgaaaaggaattaggcaaggtagatgaaaatagagattcttctcccttcagtacccatgtgatttaacacagccatagaaggctccaagttttggggtgtgggcacaatttcaaagatatatttctattaagcttcttgagagtgatatgaagaagaaacgaagtatagagtctctcagatgcaaaaatcacttagaggtaggccatgtatccatccttatcacacttcactttttccaagaactacgactggcttgtcttttatggctttttaagaatctaacttcattgtgtaatcagcttatttcctctccattattaatgccctaattggcaggttttctgacccattttcttttctgtgatgctcttctagatgtctaaacttttcatatcacaacatggatttaggtagtttttcagtaataaaagttggtgtgaatatgcagtagtatgtggattaattaacatacatttaacaaatgtttattgaaggcctactgcaccctagacatgtaataaataaataaacaaataaattagtaaggtagcttcagatagtgataaattctattaagaaaatcaggagccggacatgatggctcgtgcctataatctcagcgacttgggaggctgaagcgggaggattgattgaggccaggagttcaagaccaacctgggcaacttagcagtacctcgtttaaaaaaaaaaaaaaaattagccaggcttagtggcacacacctatagtcccagctactcagggggctgaggcaagaggattgcttcagcccagtgaactgtgatcatcccactgcactccaacctgggcaacagagtgagactgtgtctccaaaaaaaggaaataaaggagggctttgggatactgaatgactgggagatggaaatctactttcaatagtgtagtcagagaaggcctcactgaggctttctattgccattgctattttagatacttgcttaaagaaagagaggtggtcttttaaaaagtatattcttgattaagataatggagagagaagaggaagaaaaaagggatattacaacctgtagctgtataggggaaaggaagagaaaaaagataggggataggggatagcaaagcaaactttatttgctttgtagatagctgtataggggaaaggaagagaaaaaagaaaaagagaagcttgaactttattatttgctttgtaaataatttgtgaccattgacttccatttcaaggatataataatgataggaattggctggcaggtacgactggattcacgatgggagccctttctttaaattatgccactaggtcttctctgaggtgccttctatataaatcaggattcataatctccctgattttacaggagccaggaactgagtcttcttttctttctatctctcataggaataaaagggggaaatgaacatttttttatactaccgaggtcaggtatccttgggtctaatgttaaacttaaaacagaaatttctgagagagcccttttatcctttgttatttagaaaatacttgaccctcctgtgcccttgctgtattggtgcgagacagaatggttatatatatattttattatataaataataactatatataataatatgttattatataaataataacatatatattttattatataaataacatataatcatatattattatataaataacatatataatcatatagcatatataaccatatgtagttatatataaatggttattatatataacatatataaccatatgtagttatatataaatggttatatatatatatttatttatttattgttgttgttttgttttgttttaagttccagggtacatgtacaggatatgcaggtttgttacatagataaacatgtgtgccatggtgatttgctgcatctctcaacccatcacctaggtattaagcccagcatgcaatagctatttttcctaatattctccctcctgcacccctcctaacagaccccagtgtatgttgttcccatccccatgtccatgttttctcactgttcatctcccacttgtaagtgagaacatgcagtgtttggttttctgtttctgtgttagtttgctgaggataatggcttccagctccatccatgtccctgcaaaggacatgacctcattcctttttatggctgcatagtattctatggtgtatatgtaccacattttctttatgcagtctatcattgatgggcatttgggttgattctatgtctttgctattgtgaatgaacatatgcatgcatgtatctttacaatagaataatttatattcctttgggtgtatacccggtaatgggattgctgagtcaaatggtatttctggttctaggtctttgaggaatcatcacactatcttccacaatggttgaactaatttacattcccaccaacagtgtaaaagtgttcatatttcttcacagccttgccagcatctgttgttttttgactttgtaataatagccaggtgcagtagctcacacccataatcctaacactttgggaggccaaggtgggtggattgtttgagcccaggagtttgagaccagcctgggcaacatgacaaaaccccatctctacaaaaaaatacaacaaaattagccatgcatggcagtgcacacctgtagtcccagctacttggtatggcttgagcccagaaggtcaaggctgcaattagccatgagtatgccattgtactccagcctgagtgacacagtgagacccccatgaaaagaaagagagaaagagaaaaagaaaggaaaaagaaagaaggaaggaaggaagaaaggaaggaaggagagaaagaaagagaaaagaaaggaaggagggaggaagaaagagagaagagaaagaaagagtaaaagagagaaagaaacagaaaagaaagagaaaggaaggaagaaagaaaaaaagaaagaaaaagaaaaaaaaaagagagaaaggaaagaaagaaagcctggcgcggtggctcatgcttgtaatcccagcactttgggagactgaggtgggtggatcaccgatcacctaagttgggaatttgagatcagcctgaccaacgcggaaaaaccccatctctactaaaaatacaaaattagccaggcgtggtggtgcatgactataatcccagctattcgggaggctgaggcaggagaatcacacttggacccgggaggcagaggttgtggtgagcagagatcacaccattgcactccagcctgggcaacgagcgaaactctgtctcaaagaaagagaaagagagagaaagaaagagagagagaaggaaaggaaggaagggagggagggaaggaaggaaggagggagggagggagggaaagagaaagaaattagaaaaagaagagcaatttaaaagttaggggggaaggggatggaaagagtaaagattagagtagaaatcaatgaaatagataccagaaaaacagtagagaaaattagtgaagccaagcaggttctttgagaagataaataaaatcggaaaatcatgagccagactgatcacaacaaaagagagaaaagacacaaattaccaatatcaggaacgagagagatacatcattacagattctataggtattaagagataataaggaaatattatcaattttataccaataaattcaatgacttagaccaaacggacaaagacacaaaggacattcaagaataaatagataacttgaagaaacagaatttgtagttaaaaataatctcacaggctgggcacggtggctcacgcctataatcccagcaatccaaggcagggggatcgcgaggtcaggagactgagaccatcctggccaacatggtgaaaccccgtctctactaaaaaaaaaaaatacaaaaattagccaggcatggtggtgcgcgcctgtaatcccagctactcaggaggctgaggcaggagaatcacttgaactcgggaggaggaggctgcagtgagccaaggtcatgccactgcactccagcctggcaacagagcaagactccgtctcaaaaacaaacaaacaaacaaacaaaaaatatatatatgtatatatgtatatatatcagaaactccaggcccaggtggcttcactggtgaattctaccaagcatattaggaagaaagaacaccagttctacacaaatgcttccagaaaattgaaaagaagtacttctgaactcaatctaggagactagcattattctaatacccaaacaaaacaaagacatttccagaaaagaaaactgcaaaccaatattccttgtcacaaaaattcttaaaattttagtaaattgaatccaacaatatataaaaaccatgtgggatttattccaggaatgcatgtggtggtttcacatttaaaaatcaatgtaaacttaaaaattctggaaaaagaaatgcgtaacccaccatataaaaagaaaaaaaaagatcatttcaataaatagagaaaaagcattttataaaatcgagcattcattcctgattcaaaaaaacaaaaatcaagactgttcatgctgtctctcacctgtaatcccagcactttgggaggctgaagcaggaggattgcttgagccccagaggtggaggttgcagtgagctgagatcatgccactgtactccagcctgggcaatagagccagaccttgcctcaaacaacaacaaagaccacctagcaaagcaggaatagaagggaattttttcaccaagtgaagggcatctacgaaaaacctatcaaacttaatggtgaaagacagaagactttcctgctaaaatcaggaacagggcaacgatttccattctcaccatttttgttcaacattgtcctggaggttctagccagtggataaggcaagaaaacttgaaaaaaaacaagtttgttcacataggacatgattgtctatatagaaaagcctatggaatctacaaaaaacaaaaaacaaaaaacaaaaaaaaaacgctactagaactaataagtgaatttatcaaggctgtatatcaatatataaaaattgtatttttgtattccagcaaagaacaattggaaatttaaattttaaaagcagtgtcatttacaatagcatcaaaaaatacaaaatacttagaaataattctgacaaaaggtttacactgaaaattacaaaacattgctgagaggaattaaagactatagtgactgattaatatatggtaacaaagtatatcagttgtggacaggaggtcacaggcagacaggagggaggaattccaaatagggtcaaaggaaactttgggaggtaatggatatgttcattatcttgattgtggtgatggtttcttgggtatacacatatataaaaacttaccaaattatatgtgtactttttcatttagtactttttttttttttttttttttgagatggagtctcgctctgtcgcccaggctggagtgcagtggcccaatctcggctcactgcaggctccgcctcccaggttcacgccattctcctgcctcagcctcccgagtagctggaactacaggcgcccaccaccacgcctggctaatttttttttttttttgtatttttagtagagatgagttttcaccgtgttagccaggatggtctcgatctcctgatctcatgatctgcccgcctcagcctcttaaagtgctgggattacaggtgtgagccaccatgcccagccactttttcatttaattctatgaatttttttttttttttttttgagatggagtctcactctgttccccaggctggagtgcagtggcgcaatcttggctcactgcaacctccacttcccaggttcaagcggttctcccacctcaatcacccgagtagctgggactacaggtgcatgccaccacgcccagctaatttttgtatttttagtagagatggggtttcaccatattggtcaggctgatcttgaactgctgacctcgtgatcttcccgccttggcctcccaaagtgctgggattacaggcgtgagccacagtgcccgaccagttctatgaatttttaacacatgtatatatacagaacaatttcatcaccacaaaaaactccatactatccctttataatcacaccctcttctgtctcccaacgcaaacccctgacaaccactgatttgttctccatcactatagttttgtcttttcaacaatgtcatatccatggacttatacaatatataaacttttttttttttttttttgagacagagtctcactctgttgcccaggctggggtgcagtggcacgatcttggctcactgaaacctccccttcttgggttcaggcaattctcatgcctcagcctcccaagtagctgggattataagcagacatcaccatgcctggctaatttttgtgttattagtagagatgggatttcaccatgctggccaggctggtctcgaactcctggcctcaagtgatctgcccaccttggcctcccaaagtgttggtattacaggcgtgagccactgtgcccagctttatacagtatataacgttttgagattagcttttttcactctgcataatgctttgagagctttgagattcctccaggttgtggcatgtgtcagtactttgcttctttttattgctgagtagtattgtattgtatatatgtaccacaatttgtttatccattcacccttggaaggatatttgggtttcccccaattggcaattatgaatagagttgctataaatactcatgtactcatttctgtgtgaacatacattttcttttctctgaattgtgtacccaagaataagattgctcactcaatcacatggtatgtttagctttttttttttttttttttttttttgagatggagtcttactctgtcacccaggctggaatgcagtggtgcaatgttggctcactgcaacctctgctgcctgggttcaagtgattctcctgcatcagcctcctgagtacctgggattacaggcacctgccactgcgcctggctaatttttgtagttttagtagttacggggtttcaccatcttggccaggctggtcttgaactcctgacctcgtgatccacctgcctctgcctcccaaagtgctgggattacaggcatgagccactacgcccagccatgtttagctttttaagaaaatgccacagtgttgtccagagtggctgtaccagttagtatttctaccagcaatatatgaatgattgggttgttctatatccttgtcagcacttggcactgtcagtatttttaattttaactattctaataggtatctcattgtggtcttgatttgcatttctcaagtggctaatgatgttgaaaaacttcttatttgccattcacatatcctctttggtgaagtgtctgttcaaacttttgcccatttttaaattgggttgtttgttttcctactattgagttttgagagttgtttatatattctggatacaagtcctttgtaatctgcaaatattttctactagcatttagcttgtattttcattctcttctcagtgttatatacagagcaaaagtttattttttttttttgagacggagttttgctcttgttgcccaagctggaatgcaatggtgcaatctcagctcactacaacctctgcctcccaggttcaagcaattcttgttcctcagcctccctagtagctgggattacaggcgtgagccatcatgcctgcctaatttttttgtatttttagtagagacggggtttcaccatgttggccaggctggtttcaaactcctggcctcatgtaatctgctcgcctcggccttaccaaagtgctaggattatagacatgagccaccgcacctggcctggaatgtcctttaaatttctttcaagaactttttctttgcattcacaacttggctaactgttttgtgtaagaggcctagctttcggcctatcttggcttttgacatgctctcttcactaagcttaataatttctagcttttaatttaaagtaagagactcttcctttcacttgaacacttagaggccattgtagggttattagttgacctaatttcaataccattgtagctcagggaatagagagcaccaaggaaagagagggagaaagaggaatggctggtcggtggaggagtcagaacataacgacatttattgattaagttcaccctcctatatggatgtggtttgtggcaccccaaaataattacaataataacatcaaagatcagtgatcacagaccatgataacagatatacaaataatgaaaaagtttgaaatattgtgagaattaccaaaatgtgaagcagagatatgaagtgagcacatgctgttggcacccatagacttgcttgacacagaattaccaaaatccttcaattttcaaaaaatgcaatatctacaaagtacaataaaatgaagcataataaaacaaggtatgcctgtaaatggtgcactacacatgctattctgtataatgaatttttttctgaatacataggctatatatattttaagattattaaataatatgacatttaaacatagccaatcatataagcaaagttgttcagctgtttctcacacctgaaagtgccccccacaccaaataaaacatttttagattatgtgtcccaatttggacttctgaaagtatggtcaccatatgccaaggcatgaaggcattaactggggaatgagtatggagtttgatgcctttcatctcctttgctcatctgtccctatccacatgatggctgcatttgaaatgaaataaagtctacatactggagaatagtttataaatcaatattttatgaaaacagttatatctaataattttttataaaataatgtatttatttgagtcttaagcttagtgatgtaattaaaagcctatttggttttttcttaggaatccaaatcctctctttaatatttaaaccctttaatttgctaaagataagttttgtgccctgttgaccacctaatggaacaagcaagtgttgaagatctcttgtggttttttttttagttgcaaattctaccaagctaacccatttattgcagtggataggagctggagagctgttcattcggcaataataggcaaagggtggtggagggaagaaaactatctttccaatatttttgcttaggaatttggggattcagaatttagtcataaacaactagattaatgtgtttaaatactttgaatcagttctaaatcattccttgttttgtaacatacaagatcttagagataactaaaacagtggttgaaaaattctgttgtggattgaagatcctccagaagcataattcactaataggcacagtgtttggggtgatgggtaaacaaacatctgtgtcctgtggttgcctctctgcataggaggagatatatagttttcaggcaagagatttctttggagagtccactgtctctgttttgcaagttatttatttatttttaatcccagagataacgaaaccatgtagtggcagtagatggtattattcatcaggagtttaggatgttaccatgttaggccatttaaaataagacagaaaggattactttttgccagctgcatcatttctggcaagagcttactactttgcttattgcggtcattgttgtggttgttgttaacccatcagagaaactaaccactacattggttttagccaaatccttgtcatcattggccttacattcttttggggaccaaagagcacctggtcattctgaaagcttccatccccagtgattgatgctcatctctgcaggctcctgcaggctctctcaagcttgcctcccatttttcctgaagcacctttaagcatttctgcatggctactcactctcttctattatacctcctcctcctgccttactgaatgctgaatttcccagctcacaactctaagaaggagctttatttcagagtagaaaggggcccccatatgtggcctattatatccatatcaacttgcttacccttttcaaacagctattgtcttttaatagggtcctgcctggcagggggagtccttaattcctgccatataagaatgggcagcttgagttacagctagctgcagtttggtgctctgatcaaaaggcctctgttgttttttagggtttttccccctccttctctctctctttctatatcctgtgctaataattcagcacagcaaggtcattacaggctttgaattgggagctgagagtgttaaattactgacctagaataaaagagatctggggggctctcaagaaagataaagtgattccggctagtaaaatgcaagcccagcaacctcacttcttaacaatattattattttttaatcccctctgtctctaaaagtcttttctgggacaaggagagatcccctgccagagaattaggttagaaacccaatgacatcttctgagagttgtggcccaggtgctggcagcttatgggcgcctgtgcagttgtcctttttgtctccctaccttgtcaatatttcactctgttctaccttggtctctcagccacatatatggtttttttttttttttatcacgtaagtcatatatgtttatgacatttcagctgaaaggtaatatcccatgaagggatttcagacatgtggaaagcataccacttagcccccaaaatatcttaaacatgacatcatcttattaaaagccactttcattccatttatgttttgtaaataatattagtctggtcctcccatactttaacaaaaaaaaagtcccattgtaaatgaatttgatgtctccactctattctacattgtatcttctgaagaaagtcatttccatttcttcatactattttctttcatatctttcatatgtccttttttttttttttttttttttttttttggagacagagtcttgccctgtcacccagactggagtacagtggtgtgatctcggttcactgcaacctctgcctcctgggttcaggagattctcctgcctcagcctcccaagtagctgggactacaggcgtgcgccaccacacctggctaatttttggatttttagtagaggcagggtttcaccatgttggccaggctggtctcaaactcctgacctcaggtgatccgcctgccttggcctcccaaagtgctgggattatagatgtgagccactgcacccagccactacagttatctcttaaagccatacactatccatatcctctggaaaatattgattttctaagactaatatttttagaaaagttcctaaaatcaactttcacagattttctgcacagcagagtaataataataagatagtccccgaatgtgccaagcattttacagaatgcattattaacacatttaacctttggcaaccttatgtaataagcattcctgtaatcactagtttacagagaaaaataattgcaatacaaagtcatacagccaggaagatttgtcccagactagtgcttcttgaactttttcatgtttgtgtgaatcacctagggatcttgttaaaatgcagaatcagattttgtaggtctgggttggggcctcagattctgatttttaacaggcttctaagtgatgctagtgctgctgtccttggttcacattttcagtagcaaagccatagtcattttttcttgagaactactcaaaaagtttttggttataacttccagtttttcattccatcaggcaattctatgaatatacatagtggatatttcacacctatatcttactttttaaaaaatatgataaaacatagcacttaacccacaaaatatcttaaatgttagaaaatatttaagatattttgcctcctattggccctgcagaagctggacctcctgaactgtgtgacctacttcagtggtacctcaggttctacatggtgagtatcctggggactggaagagtggagatgatcagggcccataggggacctggttaaaattgactattttaactatttttaagtgtacagttctgtggcattaaatacattcacattgttctgcaaccatcactgtcatccacctccataacttttctatcttcctaaactaaaactctgtactcactaaatactgacttgccaacttcccattccttctgaccccctagctcctggcaatcaccatgctactttctgtatctaggaatttgactactctaggtacctcaagtaagtgaactcatacaatatttgtcttttttgattggtttatttcatttagagtaaggtcttcaaagttcattcatgttgtaccatgtatcagatttccttccttcttaagactgaataatagtccgttgtatgtatgtatcacattttgcttatctgtcattagacactagggtggcttccaccttttgactgttgtgagtaatattgctgtgaacatgggtgtatatatcatatatttgtccaagtccctgctttcatttcttttgactatatacccagaagtggaattactgaattatatggtaattccaccaatatcttactttctaagaaaccagtttatgtttaagttattgtgttccttttttttttttctaagtgagacagggtctcactttgttacccaggctggagtgctggaatgcagtggcatgaacatagctcactggccttgacctcttgggctcaagagatcctcttgcctcagtctcccaagtagctgagaccacaggtgtgtgccatcacacctggcaaatgtttaaagatatttttcatagagacgggacctcaccatgttacccaggctggtctcaaactcctgggctcaagcaatcctcttgccttatagcctcccaaagtgctgggattacaagtgtgagccacttcacccaatcttctctctctctttttttttttttaaacattccttacataaagtaaatctttaaaggtttggcaggaagagtgagttttcagtacagattttcattaaagtctattgtctgtagctactttgtaattttcaatcaatcacaaaagaatattgagaaatgtcctttgatccttagaaggttggtaattggttaaatggcaccaagtagagaattagagagagagtgctcatgttctgaaataaaccaatactaagaaggtttatatcacagagaaagttttatataaatgaatttaagacctcacctgacaaacaggtagtcaaggaacaggtgaaccccttgttaaatttatgctctcctttaaagattttctggaacaactatcccaggatcttcaaaaattttgtggtacctctttctctgtggtctttaataatacattaaattctcgtttgtttataagagtttggtgcaagattctgcctgctacctagaggtctttccttatgtatctttagaaatgaaattctctattggaaataggaaaagaaataaactgatattgaaacctaatgagttaacagaacatttgaagggagttttaaaaaggtatcaggaagaaactgatttttttcctgtggtataatactgaatcattaagatagtaactttaatcatttgtgcctatagtgcccttattttaggagttcctagttactacaatggacttgaacttggaaaggtaaaacaatacaaaatagcttttaactaaagttgggaatatgagtgcttaaaaaatatacatggatttaccagtagctttagaaggtaaatatacatgactactgaaataaactacaattattttctaaaaagtgagaccaactttggagataaaacaaataaaagaatgaacagaaggcgactctggaaataacggtagtaaagttatataggacatgttgagatgataaccatgaagaggagaatcgaatcattatctgcaagtttcatgtggatggctctaaaagaacaaaccctgcatcctaaacccccttcaattttattattttgaattataatcaagtccaaggagacttggcctattattaacaactttgtatgaagtatttttttcaaccaaattcatatcatcttgaataagaacaaaggattatggtttgagaattattatacttgctggactttgaaccaacagagttgatatatttaatacttccacttcttagatgaggtggtactgaggaaggggtttgtaacatctaagggggcccataaaaatagtgtttagttttcagtgaaatctacaggtgatgctaaaatgggaacatttttaaagggatcctagtgagaacaaaaagacaacaaaaaagaacctaaaggctatagctgcaggcagaaaatagaataaaatttaccttaaaatgttgtctagtgcaatgccaagcatagatatacagtggatgagcaaaatcttgtaagaaattagaattgagtttaaaaagttataaaagaaaacagacaagaaattagatgaaactatggtatgtgatctggcagtaaaacagacaaaagctgttttaaggtctggagatagagaggaggggaaggaatggcaggatctgcagatgactgagggaggcctcacctgtgactaaactcagcttcagtagcagaagaaaatagtacagacagggtgaaccagttgacaaaagagatacagaggttggaacatagagctgaagagaaagaaataacagatgacaggtttagaaaccacataaagaatgtgagatgtaatatgtagcagaaggtgagatgtaacagaaatactgtaaagagaaacagtctgtccagaaactcttcctaggggataaggctaggggatatttccccagagaaaccatgaaaacacaattattctggatttcaagtgaaattaggcaagctcctggaagctctgttataaagagctctgcttagaggccttgttgaaagaactgaaggatcttgtaggaacaagacaaattagagatttacggtaattgttgttatttttttttaattgacataacattacacaatatttggaagacaggaagaaatcaataataagccaaaaccctaatccagtgaataaatacaattcatatcttttaaatttttaatcactttccttattcagacctactttaaagtagctaaaattggctgggcacggtggctcatgcctgtaatcccagctctttgggaggccgaggtgggtggatcacttgaggccaggagttcaagaccagcctggccaacctggcgaaaccccatctctactaaaaatacaaaaattagctggccatagtagcatatgcctgtagtcccagctactcgggtggctgaggcatgagaatcacttgaactcaggaggcagaggttgcaataagttgagatcgcagcaccacactccagcctggatgacagaggaagaccctgtctcaaaaaaacaaaacataaataaatgaagtagctaaaattatcatgtacacacaattttgtttccttttttgtttgtttgtttcttcttttattctcagtaccttcctcaggatcctccttaaatataacatatgaatcatgtttttataatttaaatttctaacatgctataaagagtatgtatgtgtgcagtaaccttttcccagtgctcggcgcattgattttccatcctgtatttccctgtttctactggcctggagtaaccagccttataaaaaaagatattccttcatacttaaagctgcaaggggtaagcagatgtgaattaatcatcttatatcagccggtaagaagctgatgtgttagggatggcacctgcgagtttaccatagcatgccaggccttcaggaatgagttttgaagtttgagggcttcaaaggggagtttgaaacattttaaaaccctgacagggttttacctgaattatatgcaaagatccaatggggggaagagtttacttcagagaagcagcaactgaaaaccaggtcctttgcgtagccttcctggaaagaaccgtctttcttccttagcagcagcccccagggtaggaccagtgctctatttcacggctattttaagaaagttctttatggatttgggtaacagaaaagcacttggtgaagtgatcaaggaaagaaactaactctgctactgaggattacttaggcagaaaaaaaatcttgttatgaaacaccaatgtttaagtccttagagtgaactgataagctgatttggggcttttttgctgttgcagaaattataaatcctatccactacaatggcagctcagttctcacagatgggttcacctatccttagacagtaacttaagattgatagtccctgttggatttcttcctaaattgttttttaaagaagccaaagatcttggattctaattctaatggagccactgctgacaagaagaagatgaagaagattgttagtgctcacttgcagtgtggcacatctctattttcttttttttttcttttttttttttttgagacggagtcttgctctgttgcccaggctggagtgcagtggcacgatctcggctcactgcaagctccacctcctgggttcacgccattctcctgcctcagcctcccaagtagctgggactacaggcgcccgccaccatgcctggctaattttttgtatttttagtagagacggggtttcaccatgttagccatgatggtctcgatctcccgaccttgtgatccgcccgcctcggcctcccaaagtgctgggattacaggcgtgagccatcacgcccggccacatctctattttctatagcatttacaattatttctttgtagccaacagaaaagttgcactcaatgaacctatcaattcatgatgcatatccgtggggagaagctcattccgaatacatcatatgttaaatttatccttggattcaggatcatattgttcacttactttttcctgtagtcagcatgttgtaattttgaacaatagaataatagataacaacagcctactagagaattagaaatactgtagttctaagaactgtagtaattagaaatactgtagttctaagaactgtagttcttagaaatactgcattcaacttttgtaaagaaacttttttgtatcactatataagaaagaagctggtgtgtaaggcaacttctgtgcaaatatgttgtctaaactgctttggggttctgtaacatagactagctgacttgcctcactgatttctcttatcaagttagcattgccaaattctatagctgataggcaatgggaagaaaacatttcagggctttaggcttcctctgaatttcacaaggaaacaaagaacaaatccagggattgttaggtcaggagacaaaatcatgccataggaatatatatctttttttttcttctttttttttgagacaaggtctggctgtgtcatccaggctggagtgcagtgatgtaatcttggctcactgtaacctctccctcccgggctcaagccgtcttcccatctcagcctcccaagtagctgggactacaggcgcaggccaccatgcccagctaattttcatattttttttttttggtagagacgggatttcactatgttgcccaagctgatctcaaactcctaggcacaagcaattcatctgcctcgggctcccaaaatgctgggattacaagtgtgagccactgcacccagccacagaaatatatctttagagcctggtgactttgtgcaaaacaaaactgcagttagccaacctgttagtggaaaatatgccccaaaagtcttctcctcccagcttgcccctttccaactcagaatatattttttccttctgtttatagaagcaacacaaggttactttaaatcataattttggccaggcatggtggctcactcctgtaatcccagcactttgggaggctgaggtgggcagatcacctgaggtcaggagtttgagaccagtctagccaacatggtgaaaccccgtctctactaaaaatacaaaaaaattagccgggcatggtggtgggcacctgtagtcccagctacttaagaagctgaggcagcagaatctcttgaacctgagaggtggaagttgcagtgagccaagatacaagattgtgccactgcgctccagcctgggcgacagagtgagactctatctcaaaaaaaaaaaaaaatcataatttcataatttttcccaagatgttttggatctttggtcttatatattctgtggaggccaattcatatgctgtgtttgaatcaccttagtgtggccagtttgtgctgcatagttggatgtgatctgctctcctgttttacttcttggcagatatatttaggattccttgaaaaaaaaaaaggctgggcacagtggctcacacctataatcctagcactttgggaggccaaaacaggaggatcgcttgagcccaggagttcaagaccagcctgggcaacatagtgaggcctcgtctctactggaaaaaaaaaaaaaaagaaagaaaggaagaaagaaagaaaattagccgggcatggtggtgcacacctgtagtcccagctacacaggcggctgaggcaggaggattgcttgaaactaggaatttgaagctgcagtgagctatgatcgtactactgtactccagccttggtaacagaataagaccctgcctcaaaacaaaacaaaacaaaacaaaaaaaacctatcagaagacaagttcaattccaattctaacagaagataatccactctaatgagctggcctggttttagaaagaaaaaaaggagacaggagaatggcctaggaagactcaactgccatcatccagttaaacagtgcaggtcaagattcactggccgttttcagtttgagtgagaacaaggagcacctggaggacatagagtgctgttggagttttgaagttttgcctctttgcacattaagaatgagctggaatattttaatttggtcctcttgcccatgtctttattacttctatatgtggaatgtgaatagctatttatatatagatccagtatggttacagttatttatttatttacttatttatttttaacttttaagttcaggggtacttgtgcaggtttgttacataggtaaacttgtgttgtgggggtttgtggtacagattatttcatcactcaggtattaagcctagtacccattagttgttttccctgatcttttccctcttcccatcctccaccctccaataggccccagtgtgtgttgttcccctctatgcatccgtgtgttctcatcatttagctcccacttataagtgagaacatgcagaatttggctttctcttcctgcattagtttgctaaggataatggcctccagctacatgaatgttcctgcagaggacatgatctcattcttttctatggctgcagactattccatagtgtgtatgtaccacattttcttcatcccgtctatcactgatgggacagtgtgaggaatcctcaaagatctaaagtcagaaataccattcgacccagcaatcccattactgagtatatacccaaaggaatataaatcattctattataaagatgtgtggttacatttatatttaattctttcttggtagtccctgagctattgcccacttcaccagaataatttaaatcaattcttgctttttgctagttaatagccaaaattaagatgtttatgtggaattgacatcatacataaattcttagaatttgtatctagtttttcaggagaaaatagataccacttaatagaattctgtatgactttttctgtgcaaacagcgtttgttactagaagagaacatgaaattgtatcaagaactcccattagcttaacatgtttacaaatgtctgattataaaattattaatttttaacacagctcctgctgtgttttcttaatatattactggagaaaactgccctagagctgggcatggtggctcacgtctgtaatcccaatgctttgagatgctgaggtgggaggattgctttagctcaggagtttgagaccagcctgggcaacataacgagactctgtctttacaaaaaataaaataaacaaaattagccaggcatggtagcgcatgtctgagtcccagctacttgggaggctgaggcagggggatcgcttcagcccaggagtttgaggctacagtgagctatgatcgtgccactgcactccagcctgagcaacagagaaaaaccccatctctttttttttttttttttttaaaagagatctcttaaaaaaaaattgccctgaagttaaatattgtattagggttctctagagggatggaactaatggaatagatttatatatataaaggggagtttactaagtattaactcacacaatcacaaggtcccacaataggccatctgcaagctgaggagcaaggatagccagtaaactgaagaacttggagtccaatgttttagggcaggaagcatccagcatgggagaaagatgtagcctggaagggtaggccagtctctcttttcacatttttctgcctgcattttattctagctggctagactggcagctaattagattgtgctcactcagattaagggtaggtctgcctttcccagcccaccgactcaaagttaatctcctttggcaacaccctcaccgacacacccaggatcaatactttgtatccttcaatcagtttgacactcaatattaacatgacaaatattaagctaataaaataggaaaactatggaatttattttattgtcaaaactaaattaagagagatttgtactcagcccatttcattttttttactttagaattttttaatttccagtgaaaccaaattttactactgttgtgaacacagccttcacatttgatgcaaatgggagggcttaattataatcacttagtgacagtattgtagacaaagccaatagtgtatggcacatagatgattatatcttctggagagagttgactttacaattaatacaaacatatttgactaaagaaaatggaagcatcttcagaccatttcatcttaattatatcttgtaaggttaaaaatatataactcacaaataaattttaatttaaaaaatttttttaactttcatgtcacagccaagtccaaaaaattttaattttgatgtttctggttctcttgtggctagataatccatagagatttcctgaacttcttattcatgatagcttaaaaagaaacattcagatccctgtgaattggacaaaaggatatctattttatgctactttttgtagcataaggaagaagaggaaataaaaacacaatgggcccttgaacaacatgagggttacaggtgccgacctctcctcttcacttagtctaaaatccacatataattttggactcaccaagaacttaactactgatagtctactattgaccttaccaatagcattaaaacagttgattaacacataccttgtatatgtattttatactgtattcctacaacaaagtaagctagagaaaagaaaatgttattaagaaaatcaaaaggaaaatatatttactattcattaagttaaagtggatcatgataaagacctccatctttttcttcttgatgttaagtggctgaggaagagaaagaggaggaggagttggtcttgctgtcttaagcgtggcagggaagaagaggtggagattgtagaaggggaggcaggcacactcggtgtagctttatgaaaacacatggtgatttctgattttttttgccttttcatgtctttaaaaatgtttctatatggtaccaatttttcttccatttgctttagtttcagtgcctgtatcactgaagagttcatgtcataaaagaagtcaaaagcagtcttgaatagttggaactcttctgccagatggtctaatgtcagtttgttttctggccctgcttctgtgtcttcttccccttctattccttcttttctggcactggttcagaagcactcaccttcatcaagttgtcttctgttaattcctctggtgtgatgtctgttagctcttgaatttctccaagatccatatcttgggacccttcccccaccttctttgccatatccacaatctctttcatgatctccttgattggctctgtcgtaaatcctgtgaagtcatgcacaacatctggatgcagttttctccagcaggaatctattgtttggggctcaatggctttttccataacaacagtggcatcttcaatggtgtaatcctcccagactttcttgatgttctatcaggattctcttccatagcgttgacagtcctttccaacagagtactatgtgtaatgggccttaaaggtccttataaccccctgacttaggggctgaattagaaacattgtgtttgggggcaagtattacagaccattttgatacctttggtgttgaactcatgggttctgggtggccagggacattgtccaattcaaaagaactttaaaaggcagtccatgttggtgtgctgcacccattaattcatcatttacgttaggtatatctcctaacatggcacatgtatagatatgtaacaaacctgcacgttgtgcgcatgtaccctagaacttaaagtataataaaaatatatatatataaaaataaaaaaataaaaataaaaggcagtccattaccagcaaggtacatcctgacttcaggaagaatgttgatgaaacccagtccagaaaaaatggttctcattatccagggcttcttgtacaacacccaaaactggcaactggtatttatcttttcccttcaaagctcaggggttaccagctttatagataagggcagtcctaatcataaacctgactgtgtttgcacaaaatagtagagttagcccatcccttcctgccctaaatcctggtgcttgcatctcttccttactaataagtgtcctttgtggcatttttccccttagcatctgcattaaaaaactgctcaggaagatatcctttttcctcaatgatttttaaaagcttctttttttttttttttagagcagggtctcactgtgttgcccaggctggagtccagtggcatgattataattcacaccacctcgaattcctgtgctcgagtgagtttcatgcttcagcctctttagtagctgggactacaggcttgtgccaccacagtcggctaatttttatttttggtagagatggggtttttccatgttgcccaagctggtttcaaactcctgggctcaagcaatcctcccacctcagccttccaaagtgctgggattacaggcatgagccactgcacctggttgcctcaataattttcttaatggcatctggaaacttgtttgctgcctcttggttggcagatgctacttcccctgatatcctgatattttttaagccaaaactttttctaaaattatcaaaccatcctttactggcattaaattctccagctttagacccttcacctttcttctgctttaagttgtcatataatgacttcactttttctcagatcatattagggtcatatgcctttcttatagaaatcctgcactcctataaaagctgtgttttcaagacaagttaaaaaagtatttcaccaaaagtgcaatgtttttatgcctgctgatgtagctgcagcaactgcttcatgaatttcctttgtttataattgtccttaccttagattcatttatcttgaaatgaaggccaaaccacagctgcagatctcaatctatgatgtatgtcaagcaattcaactttatcttgtaacgtcatgaattttctctgtttcttgggagcacttccggcatcactagtgacacttcgtatgggtccgatagtgttatttgaggtttatggttttgtactgaacacgatgaaaaatacatgagaaccatgagagatcactttttactgtgatacacaatttactggagaaatgaactgcccatgcagagatgattagcatcacatggtgttttaagcagatacttgcaacacttgtgctcactgcaatagcaacaggagttggctatgaatgaaattattatagtagtacagtatgagctacagttaattttatacagttatgatttaatactgtatgtttgcttacatttctctccactatgaatggcaccatgtatggtctgtgtgtgtgtcagttttgctaaatgttaactttttataacagatttgtgtatattttaatgtagtaaatgataaaatggactagtgtctacatattttatgcattcaggacatacttttaaaaatttttccaatatgtgtaggatgcacagttggtctgtgagttttttttaaattgctgaaatccctccaaaatttctaatatatttattgaaaaaaaatccatgtataagtagacccacacagttcaaatccatgctgttcaaaggtcaactgtatatacatgtatctgctcatctgagaaaaaaatatgcacacaggaagaataaaccagagatgaatgagattcattatctctaagatgttagtgaaatggagtgaaaagatatatatatatatatatatattatatatatataatatataaattatatatattatattatatattatatattatatataatgtatattataatatacaatataatatataatatattatatataatgcatattataatatataaatatatatttatattatatattatatattatattaatatataatatatataatatattatatttatatattatatattatataatatatatattatatattatatttatatattcaacaagattgggggagactctaaaattgaaaacaaacaagtgaagcaaattgtatttcaaatgaataatataccgtactgcagggggttggagaaactaatctaaggaacataatatttggactatataccctcaggctaaaacaactctaaacaagtattaaactctaattagtaggcttctttttcacagaggaatgggttagctagctcagtacattttaggattaagcaaataagtaaatatgttatagataataggagcctttttctcactttagaaaaaggacatttcagatatggaaagggaagatgatagaatgtaacctgtagtgttgaactggaattgaatcagtgtgagctcatagatttgttttgttttgttttgttttgttttgtttgagacgcagtctcttctctgtcacccaggctggagtgcagtggcacaaccttggctcactgcaacctctgcctcccgggttcaatcaattctcctccctcagcctcccgagtagctgggattacaggcgagtgccaccacgcccagctaattttttttatttttcttagaggggtggagttttgccatgttggccaggctggtctcgaactcctgacctctggtgatccgcccacctcggcctcccaaagtgctgggattacaggagtgagccaccacgcccagcctattctttactaaaaacaactgggcttcttggataaatggctggctccagggtgaagtagggaaagaacaagatgatcctggaacatcttattctatcaaaaaaggaaggaagtgatcagagaattatgtagatgtgtcaaaaggacatagaagtcagcttgaagggcttccatggcaaaatatgggatcatttgaacataaaaatatataatgatagtaaaggattataacctattgaataaagaatccatgagtccacaatgatataaataaataagaagggaaagctcttccttattgtagaaggtcgacttaaaaacgtagatgaaacgacgtagttggaaaaagatcaccatttggcaaaaccttcatattcattgttggttctggcaacaattattattattattattttttttttttaattgatcattcttgggtgtttctcgcagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtgcagaacaaaatgaaaagtctcccacgtctacctctttctacacagacacggcaaccatccgatttctcaatcttttccccacccttcccccctttctattccacaaaaccgccattgtcatcatggccccttctcaatgagctgttgggtacacctcccagatggggtggtggccgggcagaggggctcctcacttcccagtaggggcggccgggcagagggctgaccccccccacctccctcctggacggggcggctggccgggcagaggggctcctcacttcccagtaggggcggccgggcagaggcgcccctcacctcccggatggggcggctggccgggcggggggctgacccccccacctccctcccggatggggcggctggcccgggcggggggcggacccccccacctccctcccagacggggcggctggccgggcagagggactcctcacttcccagtaggggcggccggccagaggcgcccctcacttcccggatggggcggctggccgggcggggggctgacccccccacctccctcccggacggggcggctggccgggcggggggctgaccccccacctccctcctggacggagtggctggccggacagaggggctcctcacttcccagtaggggcggccgggcagaggcgcccctcacctcccggatggggcggctggccgggcggggggctgacccccccacctccctcccggacggggcggccggccaggcagaggggctcctcacttcccagtaggggcggccgggcagaggcgcccctcacctcccggacggggcggctggccgggcggggggctgatccccccacctccctcccggactgggaggctggccgggcgggggtctgacccccccacctctctcccggacggggtggctggccgggcggggggctgacccccccacctccctgccggacgaggtggctcccgggcagagacgctcctcacttcccagacggggtggctgctgggcggaggggctcctcacttctcagatggggcggttgccgggcggaggggctcctcacttctcagacggggcggttgccaggcagagggtctcctcacttctcagacggggcggctgggcagagacgctcctcacatcccggacggggcggcagggcagaggtgctccccacatctcagaggatgggccgccgggcagagacgctcctcacttcccagatgggatggcggccgggaagaggcgctcctcacttcctagatgggatggcggccgggcagagacgctcctcactttccagactgggcagccaggcagagacgctcctcacttcccagacggggtggcggccgggcagaggctgcaatctcggcactttgggaggccaaggcaggctgctgggaggtgaaggttgtagcgagccgaggtcacgccactgcactccagcctgggcaccattgagcacggagtgaatgagactccgtctgcaatcccggcacctcaggatgccgaggctggcggatcactcgcggttaggagctggagaccagcccagccaacacagcgaaaccccgtctccaccaaaaaaatacgaaaaccagtcaggcgtggcggcgcgcgcccaggcagttggcaggctgaggcaggagaatcaggcagcagtaccgtccagcttcagctccgcatcagagggagaccgtggagagagggagagggagaccgtggggagagggagagggagagggagctctggtactttcttatagccacacgaacagataaagactgtacctatctgttggctgggcgcagtggctcacgtctgtaatcccagcacttcgggaggcttagacaagcggatcacgaggtcaggagatcgagaccatcctggctaacatgatgaaaccccgtctctactaaaaatacaaaaaatttagctgggcgcggtggcgggcgcctgtagtcccagctactcaggaggctgaggcacgagaatggcatgaacccgggaggcggagcttgcagtgagccgagatcgtgccactgcagtccgtcctgggcgaaagagcgagactccgtctcaaaaaaacaaacaaacaagaggtccagagtgtgacaacatggccttgcaaccttgtgctcagggaccctggaggcagtccttcataggtctgctggaactcgccaacaattattaatagatactaaaatttgtgaatgaaagtttgaagagtaactatatatttccacagactcaaaatgtcttcccacaggatacttatccattacaaaggctaactttatagtggcaaaacctggcagatgctgctctaactaaagaatcaaagttaacatccccagtaattagactaatcagcaagtgcccccagatgtgatgcactgagaggaactcagcatcacctttgtgataatcctgccaaaggggcataacctgaattgaattatgagggggcatcagacacacccaaattcaagaacattctacaaagtaacctgtacaacaggttttcaaataactttgtttcatttaacatcattttcattgtaactattttgtggtttaagatcattttatgaagagcaagaggcagggagagatggcagggaggacaactagagcacttctacacccaccaggagaatagactccctccctgcttcctgttgtgctggacccctattgacttcagtagggatggcaccatgtttgcgaggctgaaaaagagacatggagccagcaaatgaaacataaggttttttgaggggatttacatacagggcagtccaggggcagcatgctgaacaggagaactgctaccacttataaaaaagcatgcagtttatacagcattttcacttagcccctcgaccccggcaatctccacctggcaaccttcatccaacccaaaacaaagggcctcgaacccctgtatggcctgtgatccatgggatggatcagatggttcagatgttcctcatagataaagaatgaatctctgggttggccattcccaaattccttcactcagaactctgaacacacattcatcttagaccacagggtcattctcagggtatgcttcaattatttatgacaggtgcatctaccatacacctgctccccaagtggctcccttgtactatggcagcggtggtggggagggatttgtgtaaactctgccctggagggtggggaaggtgaaggttggatgtaaaatggcagcagctggggctggcagtggtgctgctgggtgctacagggcttgtagggttccataaagagggctgagaaggtgttgactttgtctgccccctgcacctcatggggaaacagtggcagtttcacagtgcaaaagtctttataagtgttctccgtctggttcagatacttggcctggatcttgtgtcaggcctcacatatctttcaggattttcagggttggggaagagaagctgggtgatgatgatgttgtatgtgtcaatcttgtacttggccagctcctggatcagtcactctgtctcatacagggatagaactcagggatatattcgcagatgatacaggtaatctactcagggcccttgaactgtttgctgacaaagtagatgatggacagtgtctacttcagcatggaggacagcacgtctgtgttcatgtccccaagacctagaacgttgcatgtctgtaagataaaggggctgatctggttcttgatctgctgagtgtcatgtcaaccaccaccactgagaagttcatgcccttcaccagcctcatgacctcagcatagctcatggcctcattgatgccgggaaaggcgctcatggcttcctgcatcaacttcttgctcatgctcagcatgttttccttctcaaagaactcactgggcagctatgctgcaccctggctggggtcaatttccacagtgaagaggttgtcagagcctttgaccttggtaggcacctttgagaacttctggtcaaaaccatctgagatgttgtgggctaggtctgtggagatgatcagaatactttcatgcccttttgatagctggatggccaggctgcaactgcaagtggtctttcccatgccacctttgcgccagcaaggatccacttaacttaaggctgcatttctcaatgatgttgctaaacctaggctccagtggctcttggaggctgactttgggagactgaggtggaaggatcacttgaagccaggagtttgagatcggcctggaagtgagaccccatctctacaaaaaaaaatttttttaaatagacaagcatgattgtgtgtgcttgtagtcccagctactcaggaggctgaggtgggaggatcacttgagctcaggagttcaaggctacagtgagctatgattgcatcactgcattccagcctgggcaacagagcaagtccctgtccaaaaaaataaaaaataaaataaagaaagagaggaaggaaggaaggatggatggatggaagaaagatttcattatttttagggaatatttttaggaattccttatttcctaatttttatttatcttgctcagcactttgacttctgttttttttttttttttgaaatactgtaggagtaaacaagcgtcacgtctataacttactcttaaatagttccaaaaaatgataatatgtatatacatatgtacttatatgtctgtgtgtgtgtgtgagagagagagagagaaaagagagtgagtgagagtaaatgtagcaaaatattcacatttgagtaatccaggtaaaggatattcaggaattctttgtgctattataactttttggtaaatttgaaattacaatatgtcaaaatttttaaaaattaaaatcttcaaggaaaaacttcaacaacttaaagaataaaaaaaattgctcaatgaaatttgaatactcgttttggcaaaatctgtttatggcagacatatggtgtacttctgtatggcctttaagatatttttaggaacttttttgttttactttagaggaaagattaatgtctattaaagaactttgtagtttagtcaaatacaatgaaaaattagtgcaaatatgcatttttaagcttggtaggtcaaatgtttgttttggatttctggtcatgatggcttgcagtgttcatgacttgggcctcttattcatttcatacacatggtaatgatacataaaattttctaagatttttaaggacatagccatgtataaaattaatataaattcatctgactaggaactcactaaaccacaatgcagtaagtgggactgtaaccacatgcctcctgtgctctggattcagaaggcgtaggtaactgaaagctcatttcttgaatggtggagactcaaaatgttatacacacagtgcaggagactggagctagccccttttgcctccaccactttaagaaagactcaaaaaaagttatgactgctacctgagaaatggcttacataaaacctggaggtttagccaggtgcggtggtgcacacctgtagccccagctgtttggaaagctgaggcaggagaatcccttgagccaggagtttgagaccagcctgggcaacatagtgagaccccgtctattaaaaaaacaaaaaccttgaggtgtgggaggaagcagacagccttacagccaggtcttagtggtccaacctccttaggggtacagtgacaatctgtatgatatccctaatatcaggaatggagccataagccatccaatacaagacctggttctggactagggtctgtccacaagagagagtagaaacctcccacttcacatgaacttatacgctgaaattctaaaatacatgaggaacactgatgttgagaaagatagtcaataaacccaataaacataaatttactccagagaaaacaaaaatagttgaacatttaaaactgactttgaggccaggttgaggtggctcacacctgtaatcctggcattttcagaggccaaagtgggtggatcacttgagcccaggagtttgagaccagcctgggcaacatggcgaaaccctgtctctacaatcctgtctctagatataaaaaggcatggtggcatgcgcctgtagattcagctacttgggaggcacttattatctttaaattattcattctctattctgtctggtcagcctgaataatgcaggttctacaatgtatctaccatgtaggtttatttttatttatttatttatttttgagatggagtctcgctctgtcacccaggctggagtgtagtggcgtgatctcggctcactgcaacctctgcctcccaggttcaaccaattctcctgcctcagcctcccaagtagctgggattacaggcatgcaccatcacgcctggctaatttttttgtgtttttagtagagacagggtttcaccatattggccaggctggtcacaaattcctgaccttgtgacccacccgcctcgacctcccaaaatgctgggattacaggtgtgagccaccgctcctggacagtttatttttatttatcttactcagcactttgacttctgttttgttttttgttgttgttgttagttctggaaaattctcagccaatatatatacatgtgtatttcttgagataggatctcacattattgcccaggctggagcgcagtcacgtgaatcttgcagaattgtagaatctgcattacttaggctgaacagacagaatagagaatgaataatttaaaagataataacataaagagataaaaaactatgaagacaggtaagaggcattaaaaagctacaatgtatatctaataggaaacagaagaaaatgatatagggaatggcaaagaagcaatattttaaaaagaattggggggtgcagtgactcacatctataattctagtactttgggaggctgaggcaggaggattgcttgaggaccagcctgagcaacatagcgagctcccatctctacaaaaaaattaagtttagccaggcatggttgtgtgcacctgtagtcccagctactcaggaagctgaggtgggaggatcacttgaacccaggagttcaagcttctagtgagctatggtcatgctactgcactccagcctgggcaacaaagtgagatcctgtctcaaaaaatgtatatgtgggctgagaattttcctgaactgacaaaaaacagaagtcagtttaaagtactgagcaagataaataaaaataaacctacatggtagatacattgtagaatctgcattaatgataaagaaaattgtttatatgaattataagaatgattaactccaaaggaatggcaggagtttgacagcagtttgcttgatatcagtgataggtgcgaggtgacaactgggtggtatctttaaagtgctgagagaagataagtaacaaccagaattctccactgaattaaatttcactccagaaggtaaaataaagatattttgaggtagatgaaaactgagagcatttaccactcacaggcttttgctgaaagaactacaggtttatgtatattaataaatttcacaattcaaaaaaagctttgaaaacctgaagttgtcctttggtaagttttcagcaacctcatttgtggggcaaacttgacctaaactagttcatgggctaattttggtctttgtttatcccacttagtgtgaatacttatatgtttcactgtggagactttaatatgtttgaatccatggggtgctatcccaaccctgctgaaggtgttatatcacatctggtttgtgcaacctttataaaatctcaaaatttgtcacttccaaaccagaaaggtcccaggatttcagataagtgattatggatcttattaaaggattatggatcttatttctttagcaagaaataattgaaccaagagtgaaggagcagaatgtgggaaacagtagtgagcatgaaaattgatttgataaatgtaggtaaacttaattaattattgatttttttaaagtagtcatttttttcttttttctcttttttttctttttgagatggagtctcactctgatgcccaggctggagtgcagtggtgccatctaggctcactgcaacctccgtcccccgggtttaagcaattctcctgcctcagcctcccgagtagctgggattacaggcacctgccaccacacctgggtaatttttgtatttttagtagagacggggtttcaccatgttggccaggctggtcttgtactcctgacttcatgatgcacccgcctcagcctcccaaagtgctgggattacaggcgtgagccaccactcccagcctaaagtggtaatttttacatttaaaaaggtatattgtcctgtaggtatgggggtgaattttttaaaaaaggaaaaaaaaggaaaaggtagatatcaaaagaaataaatgacatccaaattggaaagtaaaaggtaaaactatattcacaggttacatggtcctatgcataaaaagcatcctaaagaatccaccaaaagaaaaaaaaaaaaaaaaaacttctagagcttataaatgaattcagcaaagttgcaggggacaagagcaacacataaaaatcagttgtttctatataccatcaatgaacaatctaaaaaggaaattaagaaaagcaattctgtttaaaagagcatccaaaagatttagtctattaggaataagtctaactgaggaggtgaaagacttgcacactgaaaactataaaacattgctgaatgaaattaaagaagagctaaataaatagaaagacaccctgagtacatggataggatgatgtaacactgttaacatgtcagttctacccaaagcaatctactgattcaacacaattttcttttcttttcttttatcttcttttcttttttttttttttttttttttttgagacagagtctcactctgccacccaggctggagtgcagtggcgtgatctcggctcactgcaacctccacctcccaggttcaagtgattctcctgctcagaatcctgagtagctgggattacaggcatccaccaccatgcccgactaatttttgtatttttagtagagatggggtttcaccatgttggtcaggctggttgattgaacacaatttcttttcttttttttttttttgagatggagtctcactctgtctcccaggctggagtgcagtggctcaatctcagctcactacaacctccacctcccgggttcaagcggttcttctgcctcagcctccagaaaagctgggattacaggtgcccgccaccacacctggctaatttttgtatttttagtagatacagggtttcaccatgttggccaggctggtcttgaactcctgacctcaggtgatctgcccgcgtcaacctcccaaagtgctaggattacagacgtgagccaccgcacctggcgattcaacaaaatttctatcaaaataaataggctttttcactgagagaagaagctaatcctcaaaatcatatggaatagccaggacaatcttgaaaaaagaatataaaattggaaagttcaaacttcccaactataaaactagctatgaagccacagtaattcaagtattatggtcctggcataaggacaaacatatagaccactggaatagattaggaagcccagaaataaatctttacatatatggtcatttgatttcctgcaaaggtgcaattcaatagggaaaggacagtcttttcaaccaatggtgctgggaaaactggatatccacgtgtgaaagaatgaaattggactacaacactcttagaagaaaacaggggacagttttcataacattaaatttagcaattatttcatggatataacaccaaaagcataaggaacaaaaaatatagataaattggacttcatcaaaattaagaacttttgtgcatcaaaggatactatcatgaaagtgaaaggacaacctacacaatagaagaaaatatttgcaaatcatatatccaataaggaattaatatccagaatatgtaaagaactcctgcaactcaacaacaacaaaacaacccaatttaaaaatgggcaaaggacttgaagagacatttctccaaagaagatatccaaatggccaacacatgaaaagatgctcaacatcattagtcattggtaaaatgcaaatcaaaacaacaataagatgccacttcacatcttctaggttggctgttttttaaaaaggaaaatagcatgtgttgctgaggaggtggacaaattggagcccttgtgcattgctagtgagaatgtaaaatagtacagctgctctggaaaacagttcggttgtttctcaaaaggttaaacctataactaccatatgacccagcaattgcacttgtaggtatacatctaaaagaattaaagaaggaactgaaacagatacttgtatacaaatcatagcagcattattcacaatagccaaaaggtggaagtaacccaagggtccatcaacagatcaatggataaacaatagatggtacatacatacaaaggaatattattctgctttaaaaagaaaataaatttatggccctgcagtggcttacacctgtaatcccaacactttgggaaggtacggttgaaggatcatttaaggccaggagttcaaggcttgagaccagcctgggcaacatagggagaccctgtctctattatttaaaaattatgaaggaaggaaagaaggaaggagggaaagaaagaaagaaattttgatacatgctacatgtacggcccttgaagacattattcttagtgaaataggccagaacgacagatattacatgattccacttatatgaggtacttagaataggcaaatatatagagatagaaagtagaatagaggttatgagggtctggggggtgggcagaagggggtgttgttgtttaattgatgtagagtttttgttggggatgatgaaaaagttttgggtattgatagtgttcatggttgcacagcattgtgaatatatttaatgacactgaattgtacagttgcaaatggttaaatgataaatattatgtatagtttaccacattaaaaaagttttccaatttaaaaagagatagattctagtcacattctaaaaaataatatcagaagatgagaagactgcacataagttatagaaagtgtgctttgggctttgtcttgttttatttttatttttgttttgtttgtttatttattttgagacagggtcttgctctgtcacccaggctggagtgcagtggtgcgatcacagctcactgcagccttgacctcctaggctccagcagtcctcccacctcagcctctcaagtagctgggaccaaaggcatgcaccaccatgcccagctaatttttgtaatgtttcataaaatcaaggtttcactatgttgcccaggctggtctcaaactgctgagctcaagcagcccacccacctcagccttccaaagtgctgggattataggcataagccaccatgcctggcccattgtcttgttttggagagttataaagataatgagtattttcagacattttcaaaaatatgtagataggccaggcgcggtggctcatgccagtaatcccaacactttgggaggctgagatgggtggatcacttgaactcaggagtttgagaccagtcagggcaacatggtaagaccccatctctactaaaaatccaaaaaaatagctgagtgtgatgatgcctgcctttggtcccagctaattgggaggctgaggtgggaggatcagtgcttgagcctggagggcagaggttgcagtgagccaagatggggccactgcactccagactgggtgacagtgggagacaatgtctggggaaaaacaatgtagataaatattatgttaatgttttaagatggggtctcaccatattgcccaggctggactcaaactgctgggctcaagcgatcctccatcctcagcctctgagtagaactacaggcatgcaccaccatgcctggctgattatgttaaattttaatactgaaagattatagattttgtctatagcttccaaactaacagggagggtagaaaagaattaaaacaaaactttactaacacaatagaaggtgggaaaagaaggtggggaaagggaaagaagaatggataatgggaaagacaaaataagatatcaggtcagaaattaatcagatacactgaaaagctactcgttaacatatagtgactgtaaggttgggtagagaagcagaatctagccatatgctatttacaagagatatacataaacaaaatgacctagaagggttattaaaggcacagaaacagatacaccaggaaaataccaatcaaaataaagctggtattgcaatattataataaaaatatcagactcaaagcctggaatttagaaaaattagtaagatatagactttcaatatttcctgtgtggctagcttcaaagatacattctacctggcatcacttacctgtctttcttatctttctaaatcaatttccacaaatatttatgagtaactatcagttaggtaatgagtcaggtaatatagtagaggcaaagatgagtacagcctaagtgcttactccatagaactgacagtctaataggagaaagtccagtaactttaaaacaaagtagcaaattgtgagcactgttagagagttttaagtgagatacgatggaaattgggcatgggagataaaatcaggaaaagactttacacaaaattggcatttgagatggtctttaaaagctataccaaagctataatttcactagaccatgacctagacatcagctttttcccccttagaatatgaagcacaatttgggactacttctttgctggacagtttcataaatttaggctacagtattatcatttcagacttcatttgctggaaatgtagcctactgcatttacctataacagctcatttgctgtattttttattttcctttccttaagacaatagcactgcgtggttaggttaacactttcattgcttttgaaagcccctcttctaacctaatcttttgccaggtgatgtccgcatacttcctcagggtgtcttagaagtagatttctatgctagctctccatgaaaggagaagagtatataatttgctttttcatacagtgctgttactattaggaaggaactaactttattctaaatgaaaacacactctatattaaagacaagttagatactttcccatgaagttggtctaggagaagggaaacggaatagatgcctcctgaaattttttcctgttccattcagagtcagatttttccccccctttatatggtcaacaaatgaaaactggcatttggaattaccatcgttccccccattgcttgccatcttcaaatttaatgtctgcctctccacaaagattaacatgtttccactcctgatttacttgtcagggaatttagaagttttctggaacctaaagttcactctggtagggatgattactggataattgcctattcttcggtggaatttccacttttagattacaccaggctctacagcctttatttctttggcaggaaaacccaaaggcaatggagtatatttttttcccttccctggcccagcttaaacaatgactcacttgggccctggggctttgcttcatactctcatttaggggccactttatacccttgtttctattttcctttcttgttctgtttggaccctttatatcctttggcacatgggatttgtctctggggttattgtcagagagatatataaaaccaccccaaactggaacagccactccagttatgtccccatagccatgtcatccttatggcagctggtataggccagggagagtacagaaataatatcttttttcttttttttttttttttttgagactgagtctcactctgttgatcaggctggagtgcagtggcatgatctcggctcactgcaacctccacctcccaggttcaagtgattctcctgcctcagcctcccgagtagctggaatgactggtgcacgccaccatgcccagctaatttttgtatttttagtagagacagggtttcaccatgttggccaggctggtctccaactcctgacctcaagtgatccacccgccttggcctcccaaagtgctgggattacaggcgtgacccactgcgcccagcccagaaataatatctttaaggaaacctaattccaaatgcagtagagggaaaagtattctccaaaaagaaagatatgagtgccagtgtcatccagttagaggctaaaaggctttcctccatatgcgttgctcgaatgactgattcagatgtcctctgtgtgtacctgtggaaggtgggaagcactcagaggaactggcctccaagagttttcggaaaggtatggttatatgaagagacttccccatagaaggactaggtctaatctagagttcagagttttgttggggagaaaaattccccgtttttggcagtggttctctctggtctcaatttttcattctgattccagccttctggattccatctaacaatgacttcttgacttttctctttgcagttttaacagtgtatgccagggaacacacattctctttcgagaattcagcttcgtccaagccaccccccacaatagggtatcatttttacgggccttctggagatgcttccgaactgtgggcaaaaatggcggtaagtcttcccaaattctttttccttccttccttccttccttcctttcttccttccttccttcctctctctctctttctttctctctctcttttcctctctttctctttcaaactttttcttttgttcctataaatattgtttgaatgcatgctattcaaggcatttagaatacctcacttttgaggagttgtctggtttatgtcaaagatattactattaccactaccatcactaatggtacctattaagagccaagtgtagctctttacatgtagtaactcatttatctttacaagggctctctgtggtagataccataatccccattttgtaactaatgaaactgaggatcagagaggttaagtaacttggcaaggttacatagtaaattctgggcccagatttatacccaggcagtctgacttcacagcccttgctcttggcagatattaaaatgccatgcagtaaatacaaggaataatgtgaatatgaagaaagaaactcctgaatgggggtgggatggggatactgttgttagagaagggagagaaaagtggagtagagaaggttctccttagaactgactgtttgatctaagctgggaaggaagagtaggaatcattcacatggataaaggagagaagggcatcctaggtagaacatatgctgaagcacaaaagaacctagaatacttacataacagatcaggatgtctagagtttgtgtggagtttatgaaggaggttaggggagatgagactgtaaaggaataatggagctgctgaaagatcattttttagccataaaaaagaaattgggccaggcacagtggctcagcctgtaatcccagcactttgggatgccaaggcaggtggatcacttgaggtcaggggtttgaaaccagcctgtccaacatggtgaaaccccgtctctactaaaaatacaaaaattagccaggtgtggtggcgcactcctataatcccagctattcaggaggctgaggaacgaaaatcgtttgaaccctgggggacagaggttgccgtgagccgagatcgtgccactgctctccagcctggacgacagagcaagactctgcctcaaaaaaaaaaaaaaagaaaaaagaaaagaaaagaaattggggctggatgtggtggctcacacctgtaatcccagcattttgggagcccaaggtgggaggatcacttgagcccaggagtttgagaccaacctggacaacatactgagacttcgtctctacaaaaaaataaacaaaattagccaggtgtggtggcacatacctgtactcacagctacttgggaggctgaggtgggaggatcacttgagctgagggaggttgaggctacagtgagtcatgattatgccactgactctagcctaggtgacagcgagatcctgcttcaaaaaaacaaacaaacaaacaaaaaagttaaattttattctctgggtattatttgaaggcttttttttttttaaagaccctgttgcagccgggcacggtgactcatgcctgtaatctcagcactttgggaggccgaggcgggcagatcacaaggtcaggagatcgagaccatcctggctaacatggtgaaaccccatctctactaaaaaatacaaaaaaattagccgggtgtggtggcgggtgcctgtagtcccagctacccgggaggctgaggcaggagaatggtgtgaacccaggaggtggagcttgcagtgatccaagatcgcgctactgcactccagcctgggtgacagagcaatactccgtctcaaaaaaaaaaaaaaaaaaaaaaagaccctgttgcccaggctggagtgcagtggcatgatcatatgatcatagttcactataaccttgagcttccaggctcaagtgatcttcctaactcagcctcccaactagctaggactacaggtacatgcctaccatacctagctaattttaaatttttttgtagagacggggttttgctgtgtggcccaggctggtctcaaactcctgggctcaaggcctcagcctcccaaagcactgggattacagatgtgagccaccatgccccatcttatttgaaggcttttagataggagagtggtgtggtgatatctgagctctagaaagatcattcaaaaggcagtgtagaagatggcctagactagagacaaggaacatagaagtctggtagtagttgagtgagagattagacccaacactaaggcagtatggagacagaaggggcactttcagagatagaatccataggatttggtgattggatttggcattaagatgagagagaagaccgtggtaatttccaagtttttggcttgggccactgggtaagaatattttttaaaagccttcaagtaatagccacagaataaatttcaatttttttttttttttttttttttttttttggagacagggttttactctgtcacccaggcaggaatacaatgacacaatctcagctcactgcagcctcgaccttccaagctcaggtgatcctcccacctcaagtagctgggaatatatttgtgcactaccatgtgtggctaatttttctattttttatagagttggggtttcgctatgttatccaggctggtctcaaactcctgggctcaagccactcgtccacctcagcctcccaaagtgctggggttataggcgtgggctaccatgcctggtctcctactttcatattatgtgttttcataaatacctttaagacaatttcttgcttgcttgcttttctttttctttcttctttcttgccttccttccttcgttccttccttccttcccctccctccctcccctcccttccttccttcccctcccctccccactgaggttatagtcagtgaataggtagtctccctgcttttgaatttatgagattccccaccatgctctaatcaatgctactgctacgaaactgtaacttttctaaatagctactaaatatatagctattaaacttttatatgtagttactaaatcttttctaaaacttttccacccaatatcttattagttccactgccctaagaaataggtaaagtgggtattattgtgcccattttgtaaataatgaaattgtgtaacttgcagaaagatttcatggtgaattagtagcaaagctagaaattgaacccagatttactaatatgctgatgtgctatttctactatttttacttcaatcattgcctctttgacatataactctggagatcatgcatctccattacagtattatgaaagaagtacttagtgtactgaggatcgtatcatttcccttacagaataaatgcactaataggcaaaaaccaatgtggactcaattttaagttaagtaattcagaaaaactattccattggtctctatgtaaacaaaactgggaactgtgagtatataggtaaagctcgtgctatgttatcagaggttatctttcccagtccctcactcagtcagcaaatatttgttttagaccacctagtacagtcgtctctcagtctatgcagggattggttccaggacccctgtttataccaaaatccacgcataatcaaggcctacattagtcctgtggaactctcatatgtgaaaagtcaatcttccgtatacagggcttcatatccctagaatagtgtattttcgatccatatttggttgaaaaaaatccacctaaaagtgtggacctgcacagctgaaacctgtgttgttcaagggtcagctgcatgttgaagaatatggctagagctagtttctgtgatagaacatatggagataactatggaaaacagtcttcagatagccttaacttttttcctgatatagaagtggggcctcttcaagaatgtatttactatcacgagggattcatatagcatttggactcttagcagatgtgggtttctttatctttctaatagcagctgccagtgactcatccagctgctaagaataagcagctccaaattcccccagtttctccttgtgccataaacaagacctagattttatgctggctgtttattgttatccttcttaatcagacagcctcagatttcttagactaaatgcaacatctgtgtctaggtgttcctaaaataattggttaagtagctttaatgtattctcagctttttctaggaaactccagaacatctttctaaaccagaatgtgtcaatctccaattttaatccggaattagtgaaaactcttggcggcaaggttctaaaggaaaggatttattaagccccattttatcaattataatgccaggtacctacctactcagtggaactcctactgcattattcttctgcagataacttccttagaatgtcatgtgcatactttagcattatcaagtggaaagtaactcttctgggaggtagcaaaacaagagcataacatatctaaaaatgaagccacctgtagaactctaaggacctggtcccttttgacaaaaaatattttattccagtttttagcaagtacaggatatgatatcttttctgcatgactgagtactgatgctaattatcttgtccaaattttagataatctcatgaagactgtaacaaacctcttggtatctaagcaactttagactcttggaagcaaaagttatattagaattttaaaagcctttaaaattacacttctcactttgctaattttttctgtataggaatattaatctgaattttctaagtctggcaaagattgatattctcttaatgtaaatctttacttctgtttagggatatcggctcaaaagtgccttctccaagtttattttcaattagaatttaattttcaatatatacatatatacacatacatacatatatatatttcatttgataaaataatgataggtacttcctcttctatctgtgaagaagtatctactaagggaattgccctcttgccactaacaatgagaaaatcagcatatctgaaacaacagttttcagacattgggcaataggcagtgggggctgtggattctgagagccagtttccaagcaacagtatagggagagagattgtcaaagagcttagcagtgttattgagttgaggaggcagagactggggtttagggaggctggagcagccagtatttacaggtcagaatccaagagaggaagaagttgttcagtgagctccagaatctttggctacaaattctgcatatgtgtgggctggaaaaagaaccaccagaaaacagtgggccaaacaatttctggagtatacaaggggctaaggataattcaaacttctaccagccatagggaagagacctcaaaacacaccgggcactgggtagagttctcaacagtttaaaagcaaaaaggattaaatcgatccgcaagtaatttaatgctatataagaacaaaattcaataatctttaaaggaatttaacaaaatccagcattcagcaatgcaaaattcacaaagtctgacatccaattcaaaattaccagacaggccaggcatggtggctcatgcctacaatcccaggactttgggaggccaaggcaagtggatcacttgagcccaggagttcatgaccagcttgggcaacagagcaaaaccctgtctctacaaaaaatttaaaaaattagccaggtgtgacacctgtggtcccagctactctaatggctgaggcgggaggattgcttgagcctggaaagttgaggctgcagtgagctgtgatcgcaccactgcactcaagcctgggcaatagagtaagaccctgtctcaaaaacaaaacaaaacaaaataaaattaccagacattaaaagaagcaggaaaatacagcccataaccaggagaaaaattaatcaatagaaacacagatccagaaatgacagagatgatggaattaactaacaaggaccttaaaatagttattttaaatcatataaatatgcttaagtatgtaaagaaaacatgaatatgattaggagattagtggaagatattaaaaagatccaaatggaatttctagacatgaaaaatacaatatagtgaaaatgataataatagcaattaacatttattaagtgcttctatgtagattatctcatttttcttcacaacaaccctatgtgttaggtagatgctattatttcctttgcatagaaaatgaaacagatttagaatgttaaataacttgctgtaggtcacacacccagtcaatgaaaaagccaatgccaggagaagccatgaagtctgactccaggctgtattattgcttcagcgtgttatgcatcaacactgcatgacaggctggaaatacaaatgagtaagtgacaatacttgccctcaaggagctcttattctaggagaagaaacagtagcataggaaccaacccaaatgcccatcaatgatagactggataaagaaaatatggaacatatacaccacagaatactatgcagccataaaaaggaacgagatcgtgtcctttgcagggacatggatgaagctggaagccatcatcctcagcaaactaacacaggaacagaaaaccaaacactgcatgttctcactcataagtgggagttgaacaatgagaacacgatggacacagggaggagaacatcacacaccaggtcctgttggggggctggggggtgaaggaagggaagttagagggcaggtcaatagttgcagcaaaccaccatggtacacgtatacctatgtaacaagcctgcacattctgtacatctatcccgttttttttagaagaaataaaataaactagattcttaattcaaccccaccccctctctgccaaaaaaaacctgagtggtgtagaaatagtctccatagagtacaggtgatttttagagccacacataagattccataatagcacaagggagaaaatagtcaattctatagaagcgggtgaaggctataaaggtgcaaagacagttgggatggatcttggagcagtagaaagctgttaagcaaataaggaatacgttctaaaaacagggaacacgatttctgaaagtatgataacatgaaacaacatggttcctttggaaagtggtaagaagtcattgtggccagtatttaacacataataaggaaacactaccacagtcaataggagataatgcggaatgcttttatgtgccatacactgagcaaaatgtttacatgtattcattcatttaatccacacaataaacatatgagttgatatgattactatcctgttttatatgttaagacacagagtccgctgggcgcggtgactcatgcctgtaatcccagcactttgagagcccgaggcaggtggatccttgaggtcagaagtttgcgaccagcctggccaacatggtgaaatcccttctttactaaaaatacaaaaattagctgggtgtggtggtgcatgcctgtagtcccagctactcaggaggctaaagcaggagaattgcttgagtctgggaggtggaggttgcagtgagccaagatcatgccactgcactccagcctaggcaacagagcgagactctgtctcgaaaaaaaaaaaaaagaaaagaaaaagaatcgaaactgagagtcagaggattaagtaactcacacaaggccacagcgcttataagtagcacagctcatattccaacctacgtcttcacaaagttcacattttcacattctttctcttttcttttcttttttttttttttttttttgtttgagactgagtctcactctgttgcccactcactgcaacctctgcctcccgggcccaagcaatcctcccacctcagcctccctagtagctgggaatacaagcacataccaccacacccagctaatttttgtattttttgtagagatggggtttcaccatgttgcctaggctggtctcaaactcctgggctcaagcagtccacccgcctcagcctcccaaagtgctgattacaggtgtgagccaccactctcaagcccacaaagtccacattcttaacaactctgctgtgcctgctaccccaggttatgaagggctttgtgtgcactaaaaagcataagaatgatacaatggactttggggacccggggaaaggatgggttgggggtgagggataaaggactacaaattgggttcattgttactgcttgggtaatgggtgcaacaaaatctcacaaatcgccactaaagaacctactcatgtaaaccagataccactggttcccccaaaaccctatgaaaataaaaaatttctcctgaagttagtagaatcttctccatttgtgtggtattttcacatgtaacacagacaaaagcatggaaaatgtaaggcaggtaaaagtgaaagcatagacccgttaggagactactacaatataacagaaatgaccatgaaaatgaagagctatttaagaagttggtttgacaggatttgctgattcattgtgtgagggatgtggcagagaaagagtcaagaatgaatgccagaatgtaaagtatggccagttttatccctctcttgcttttttcctttccttttttttctttcatcttttatgtttcactctgaattcacagtggttttgtgttcatatttattcattcgacaaacatttatgtatcagttcttggtgataaagcagtgactgggacagacagaaatttttattcttgtcaactttgctgtatgatcagaaaattgacaaaaatccctgcttttatagagcttacattctaggaatcagggaattgcagtgggtctatctgagtatgtgataaaaatctgttagtttttctaaaatatctattgtttatggtggacaaagtgatgtcaagggaaaatgcagacactttaggctgaaatgaagatgttggtctgacttctttttgtaattgccttgaacttcacttgattttgcttgtcactaatccttatcttcaccagtaaaaatcattcagtgaggattaatagcgctttactacaggagtgggtggctgtctttgaattattaaagagcaattgttgcttctgtaatgttttaaacaaacaagaactgttccatgtggtctcttcagtgatgtgggccccaccagccaattatcttcacctgctccagccagtgcatctcctcttctcattttctcccagaaaccagatgtagacaatcaacaagaatttcagtgcctgtttcctagctcccgttttgtttatttctcctgagttcctaattttccctttgtttttcatgtttatttccttcttcaaaatcttttctccagggagaaaattgacaattgatggcccctcaaatcattcacctctgtacctccaataactttaatctttccccctatttaatgttctcttttttttcaatgttggttatttggggctcttacgcaagcattcctggaatgcttttgtcactatcttctctcccacctgaagctcctcaaccctccatacataatacctgtaggttttagttttaaaggtcaggtccttaaagaagccttctctgtgactcccttccttatctgaattgggtccttccattataatttttcagattatcctctgatttttatcatatcatttattacagtttctgactcagtatttacttgaatgacttttaatgtccatctcccttattaaaattataaactttatgagtacaggaaccttgtttgttttgccagtaattatatccctagcacctaatacaggtgaatgatttttttgttatataatatgaaggcttaccttttcccagtaatgatacagaagatagattattgaatggattatattatcattcattttatcagaggataggttagtttttaaaatctgctttacactaacttttctatattgtataggaacttctgatttaaattaataatagctaccccttattgagcaaatgctatatgccaggtactaaagttcatgtttaaagtgttccactaaaaaccagcctaatcaaagctatactatactaaataacacctaattaaaataatattcagtattccaaaataaggatttgaaagatttagatcatgatctgtaatcaaactttaaacactggtgaatagtacatccgttccttcttttgtattctgggtttttgccttcactccatgaaaggtatcacaaactagtagtcggctaactacacatgccttggcctacagatgtgtcttctttgactttcagtgttaaaaatacttagattcaattagatgccaatgtttcacataaaagtctcaatttcagtttcacttgaagaatggaaaatcctcccagcaccatgcccacattcctgcagggagacagttcaccagggcagagatgcagctgctccctttagacagggcatgtggtctcagatttaccaccaacccaagctgccctgcttcacctgctgacattccctgcgcgtctgtaggcattggagtttgctaccattgctagagcttcttggtccatttataatcactaaaaggtaaagtttcactcttaattcagtcaggagctttttcctcaactattaatagattctctttctcttttctccttgatatctccatgatatcacataaaattttagaattagaagggaccttagaaattatttcatcttgaaactaggtcttaaatatatatatatggtttttcttattattgtggtaaaatatataacaaaatttaccatttaccactttttaatttgagaaatcttttttatggcaataaaacctatataacaaaacttaccactttaaccatttttaagtgtacagttccgtggcattaagtacattcacagtgttgtgcaaccattattaccctccatctccaaaactctttatcttgcaaaaccgaaactcagtagccattaaacaatgactcccatttctctcctcctccagtccctagaaaccaccattctactttctgtatctatgtatttgactattctagatacatcagataagtgtgtacaatatctgtccttttgtgtctcacttatgtaacttagcatgatgttttcaaagtgcatccatgttgtaatatgtatctgaatttcattcctttttatggctgaataatattccattgtgtgtatataccacattttgtttattcattcacctgttgatggccacttgggttgtttctacattttcgctgttgtaagtaatgctgctatgaatgtaagtgtacaaatatctttctagtccctgctttccattactttgggcacataactagaagtgggattactgtaccatacagtaattttatgtttaattttttgaggaactgctgtaaagttttctacagcaggtgtatcattttacattctcaccagcaatgcataagggttccagtttctccacatccccaataatgcttgttgctattttctatttttctgataatagccatcctaaagaatgtgaagtggtatctcatggttttgatttgcatttccttaatgacaaatgatgttgagtgtcttttaatatgcttattagccattttatatcttctctagaggagtatctattcaagccctttgccctttttgaatcaggctgttttgtcgttgagttgtaggagttcttcatgtattctggatattcattccttatcaggtatatgatttgcaaattttttttctgttctgtaggtcatcttttcactttttttttatcatatcctctgatgtacaaaagttcttaatttcaatgaagtccaatttatctgtttttcttttgtcctctgtgtttttggtgttatatctaggaaatcatttacaaatccagtgtcatggagatttcccctatgttttcttctaagaaatttctagttttagctcataaatttaggtatttgatcaattttgagttaatttttatgtaaggtattaggtaagggtccaacttcattcttttgcacgtgcatattcagttttcccaacaccatttattgaaaagactgtcctttctccccttgaatggtaccctttgcacccttgtcaaaagtcaaatgaccatatatatgaggatttttgtttctgggatttacattctcttttgttggtttgcctgtccttatgattactgtggctttgtaataagttggggtttttttgttttgtttgtttgtttgtttggtttgtttgttttgagatagagtctcactctgttgcccaggctggagtgcagtggcacgatctcagctcaccgcaacctccacctcctgggttcaagcgattctcctgcttcagcctcctgtgtagctgggattacaggcacatgctaccacacccgctaatttttgtatttttagtagagacggggtttcatcattttggtcaggctagtcttgaactcctgaccttgtgatccacctgcttcggcctcccaaagtgctgggatgataggcttcagccaccacacccagccttgtaataagttttaaaatcaagaaatgtgagtcatccaactttgttcttcttcaaggttgttttgggtattcttggtccttttaaagatattttatgaatggttttttctattaaaaaataccattggaataccattggaattttgataggattgcagtgaatctatagatcactttcggtggtagtatcaccttgacaatattaagtcatttaatctatgaacataggatgtgtttccatttatttaggtcatcttcagtttctttcagcaattttttttttaagagaaagtgtcttgctctgttgccctggctggagtgcagtggcacaatcatagctaattgtagccttgaactcctgggctcaagcaatcctcccacctctgccatcaagcccagctaattttttatttcttttagagatgaggtctcactctgttgcccagactggtctcaaactcctggcctcaagcaatcttcctgcctctgccttccaaagcagaggggttgcaggcatgagctaccacgcccagcctctttcagcgatgttttgtagttttcaagtatacaagtctgtcacctccttggttaaatttattcctaagtattttattcttttcatgctattgtaaatggaattgtttttcttagtttccttttcatatttttcattgttaatttataaaaatataattgattattattattattatttttttgagacaaagtctcactctgtcgcccaggctagagtgtagtggcgtgatctcggttcactgcaacctccgccacccgggttcgagcaattcacctgcttcagcctcccaaatagctgagattacagggacatgccaccaccccagcatgtaattgatttttgtatcttgattttgtatgctgcatctttgctgaattcatttattaggtctaacagttgtgtgtgtgtgtgtgtgtgtgtgtaaaatctttagggctttctgcatataagatcatatcatctgtgaacagaggttattttatttctttctttctaatttggatgccttgtgggttttttttttttttttttttttttgtttgtttgttttttccttaattgctctggctagaacttcctgtactatgatgaatagaagtagtgaaagcaggcatctttgtctttttcctgatcttaggggaaaagtttttcagtacagcaggtcctcaaataacataattgcattataacattgatgaggaaaaaaaaaattgattcccagctggggccactgtgtgaaatttgcacattctccccatgtctgcatggattttctctgggtactccagttttctaccacagatgtatgtgttgggttcattggtgtgactaaatggtcccagtgtgagtgaatgttggtgtgtgtgtgtgctccccgagatggaatgagatgtcctgtacagggctatccaccttgtgtcccaggcttccaggataggctctggccacctgcaaccctaagctagaataagcaggttggaaaatgaatgaatacaaattattattgaatacaaattattatcaaatacaaatttataaagtagatgataatcatacaactgcacaacaataagcgatgaggtatgaaagcgttcagctagcccaccatatttgtgattgttttttaattcatggtcggaggaggtgctccttaaatttttctatttgcaaatatctattcccttatttaatccaccaccactacaactgtcgtcattcagcgattcaccaaaaattgggtaatcttacttgttgttattaacctttcttaaatgtatgtatagcccacatttatttcaatgtttaatattagaggtgtgtagggtctttatttagaagttgggtgattatttgtgaccagaaacatgccataggaacttaactcttgtttatgtcgattagcctatgatgaaattggttttattataccttgtttcacttaaagtcagtttccaagaacctattgatgaggttgaggacttttatttggttttaaggtaaaagtgtgccaaaaaattgagattcatacagataagtagcttcaaatactaatagatttgtttttaacattttgactgatctttttttagctttactaatgttcagaaagggagtaatagtaaatttgtgtttcaaagctgagttgctcacattcctaattaatgagtaatcactctggagaaatcaacaaattttctcagctagtttaaaaattttattgtttggagaaaaataaatgtatattataacatcatatataagttgttcaatggtattattttttgaaaagatcagatgactcaaaggctagtatgactgaactgtgtctgccccccccaaattcccatgttgaagccatacctccaatgtgactatatttgaagaaattcctcctgtaaggaggaaattaaggttaagagaggtgataagggtagggcttcatcagataggaaggattagtatccttgcaagaagagacaccggaactggtgtccctgtaagaggagataccagagagctgcccatgcccctccacgtgaggacacagtgagaaggcagctgtctgcaaaccaaggagagagcctttaccagacaccaactctgctggcaccttgatctcagacttccagtccccagaactgtgagaaaattaatttctgctgtttaagtcactcagtctatggtatttgttacggcagcccggacagactaacacagaggtcttctttttaactcacagtttcagcacagaaagattcattttattttgcatgttgactccaaaacctgttttgatttatcattaacattttatctgaagttgtgagtatggccgtgttgtgaccctgcgttatcaaattgagccatctaatttatttccacattgataaacttatattcaatggattttagtttaaggtagaaataatggtaattactttttttttttaactgtagtcctcatacctgccttatgtcaatcaggaaactttagtataaaagaataaattttgatacaactgcttatatccctgcaaataactcagaaagatctgcagcttaaagactttgtcctaataaaactgacagcctgtatcaatctgtatgttatccaatgtaatattttttaaaatgtaaatgttaattttgaaaactgcatgtgtaattttggccaggcacagtggcttatgcctgtaatcccagtactttgagaggctgaggtgggcagatcatttgaggccaggagttcaagaccaacctggccaacatggtgaaaccctgtctctattaaaaacacaaaaattagtgaagcacggtggcgcgcgcctgtaattgcagctactcaggaggctgaggtgggagaattgtttgaacctaggaggcagaggttgcagtgagccaagatcatgccactgcactccaatatgggtgacagagcaagactccatctcaaaaaaaagaaaagaaaacttcttgtataattttaactgctagtgcttatctacacaatatttttggctgccttctcttttatgtgatcctctactccttgaatttttttctgccattgcctttccagtcaccgtacaaatatgactaccttatactactttgttagtatcttaacacttaaagacttccattttataattatcaagcattttataaaataataaatttactttgcatttgcttctataccagatcatataagtaaaaggagagcttgacaacatctgtcttctcatccagtataaagattttatgtaatctcagctttcatgccaatatagtcctggattaaaaagaaaataaaaagaccagagcagataataatttcctaatcagtggcacatttacagttgcaaatatatatatatatttgtggagtaggagaaattccacaaatgagttaacctatgagcacaggttgatagtgtgtgtatattaaaatttactgtgtaacatatttagtgtacattttgtttttcttatagactttaaataaaagtatgtttttaataagaattgaaattaaacttttatagaaacttctaagtgcctctgcaaatttctaagcttctgtggaacatggtttgaaaactactgatctacttcaacccttccccattgtgtaaatataaaaatcaaagccaaggtctcctagtcacttggtaggacctgtaaaaccaagactaaattcaggtcttctggttgtcagtcaaatgttctagccattatcatgctctgctgctaaatgaacatatacattttgtgtcatttagtctctgagatgaatgtatgattttgtagcccaaaacgtaattgtagtagttaaggcataagaatgcattgcccatgtgattttatttcttctttcattgttttacagatgaaggtaaagtagctacaagttctttaattttaagttccattttacctatcttcaagagaaaaaatagttactccacctggtttaaaatttaaaaataataattcttattagagagggacgtataatacttgtttattggatatttcatgctttgaaggacataataagcagattttggaagttctttgaaaatacaagagttttattgttgttgttgttgctgtttattttattattattattttttttttgagacagagtctcactctgtagcccaggttggagtgcagtggcacgatctcactcactgctacctcctcctcctgggtcctggttccagcaattctcctgcctcagcctcccaaatagctgggattaccggcatgtgccaccatgcccagctaatttttgtgtttttagtagagacgggggtttcaccatgttggccaggctggtcttgaactcctgacctcatgatccacccgccttggcctcccaaagtgctgggattacaggcatgagccaccgcacccggccgttgttgctttttaattttaaagttaggctgaagtgagactgtaacacacaacgttattaaacgcattctctaaagtagatctaccaagccaggcacagtgcacatgccggtaatctcacttgagcccaggagcccaggagttggagaacataagtgcactatgaatgtgcctgtaaatacccactgatctgcagcctgggcaacagagtgagacaccatctcaaacagggtgggtggatggatggagagagggggagagagagagagagagagagctggaagtatgtaaaagcaaatataaataatgttgaaaatttaatattttccagttttattttgcttggcataacctgctcttgattcccactgataccgcctgaccctaatttagaaacctaattagacaccttggggaggttgtcaaaaagacagattccttgatcccacctcaaacgtactcgaccacagccagcaggcaaggggcctgggaattaattttaacaagcatttcaggtgattcttaggatcactcaagtttgggaaacattaagcggtttcaaccctgcttgcatattaggatcagctagggtgcttttaaaaaatactgttgcctaggtccctccccagaccactttaatcagaatctttttggttgggacccaggcattttaaatgctctgcaggtggttctcatacacactgaagcttgagaactcctgcaagacagttggaaatgtaattctctgaagcacagccctggtcttgtcactgctgctgagaacctcaatggttctgtattgcctactaatgaaatatgaatttatgactatcataaggctactcatgacccaacaccagctttccaaccactactctcctacttatagactatactctggccacacagaaacactttccccaaacactccttgtgctttccccctttcacacctctgtttttgctttcccaccatgtagaactttcccccatgtctgtctgtcacagtcctgcccatcctcaaatagacccagctcaagtagattcccatttcctcctgtccttgccctcccctgcctccattcaaaagcgacctcttagggcatttgtcctatcataccttatatttagttattggcagatacatagtctctttcataaaatgccatgtggaattaagaataagtggatttttatctttcctttttccccatctagattgtaaatttgtaatatcaactatctgtttacttctgtgtgaggcactaaagagaaagactttagagtcaaatggccctaggttcaggtgccttttttattggatatggctgtgtgaccatggtcaggttaatttttccaagccttagttttctcatctataaaatggagaatatactacttcagtgttgtgaaaactagatttgataaccgactggagccttcagtaatcccggtatgtaataactgctctgtcaaagtctgttgcttttatcattgtgataatgatcattgttagctcccttgagggcaaagactgcatattttatctttggatccccattctgaaccttgcttattgtaggtgcttgataaatactgggtgaataaaataatgaatgcctgctgggtcgtgcttacttatatagtccactaccaatcagttcagcctgtcttggaaggagcacttcaaatttcaatttaaccatcagataaagatagaaaataggatttccactacaaactttaaaaactgtattaaaaaggccaaaaccccagttaaactgtaagacagctgctctctttctgctgccaggaaatagagaaaaccctccaaggactatttgctgtttgtttgtgcatcatataataaacatgctgtgacttggggagagcacacacttcccctgcaggcaagcttgggtttgggaagttgcatgtagcagcagtgaggaagaaatcccccactctgtgggagaggttccttcacggactccactaagcccatttgcagttttgctgagttatttactaagatgaagggactgggtgtggctggtctgagattcctcctgggaagtcacttcaagaatctccttaatttcctcacccttcatctttgttctctggctttggtgcaagggtgcagtcagtcgcacccagttggctgctgttcccagcacactgaattatttgaagctggctgtggcagccaaggattccctgttctgttcttttccccttgccctgatttgaaaaacggtctggaaattctcatctggcatgaccagaaggaacttagtaggttgcaagctgtttttctagatgcacaggaccaaacagaacctttaaagctgtaaattaccatttctcaaaaactcaatttgatggattttacatggacaaattatataacgtaggctttaccatcaccactatcgtttaaacaagaggccatccaattgagatgaaaccgatataggaaagtaattatcatcagctttgtcacttgaagaaggaatgtgaggatatattagctaattgaaacctcaggaaagatgtataacaaaacatataaggattaatgagtagtccacaaaagtgtttaccagatgaccaatatcttttaaaatatatagatgtattccagctcttttaattagaaaatatatatatatacacacacacatatatggataaaaaatgaacttataattacaatagatgtgatgacaaaataattcatagtctgaaaaatatataatttcagtgatcagagccttatgtattatgctaattgtccaataatttcttgaaagtatgtttctacttttaaagtaaaattaaattcagaaagcaatgatgagcaaatatgtgataatattctaggcagacactgaacatttatatttattgtgagaacagcatgatggtagagtactatttatataaaattatgtatctttatgtctttatatgtttacatgcatacaaaaatatttggaaggaggtttactgaaatgttgtgaatgattttctcttagtgttgagactacttttttcttcacacatttttatattgtctgagtttttataatgagcatataacatttttataatcatagtaaaaataaagctatttttatagctttcatataggaaaattttgcttgagcatctgctatgtgtccaaagtggtactagaaattatgagatataggaaagaaggctgtggcctggctaccaagatgcttacaatctagctgggaagacaactagggagtgggatcctatagaatgtaatccggtgtcgggatgtatggttcaaaaaggtgctacggagcatcaggaagaggagaggaagctctcaatggaaggaagctttcatcgaaaatgaagattaggctgggtgcagtgactcatgcctgtaatccgagcactttggggggccagggtaggagggttgcttgagcccaggagttcaaaaccaacttgagcaacatagtgagaccctgtatttttttgagaaatattttaaaacttagaaagaaagaaaaggaagcttagattggaccttgaaagatggacaaaaattgaataggagggagagaagaaggcattttaggcagcatgagcgctaaagtgataataataatgctttttgaaaagaaaggaggaaaccagcttgtctagaataaaaagtaaatatgatttgtgatggagaagtttgctttattgctaagtttatttcataagatatctttgatatattacaaactatatttttgtatacttgagcaggtcctagaaaaatattttgtaattattctgaatattgactctaaagtgatgtaaaaactatgactactatgaaaaattcattattttagtgtattgagggtagaagatttcagtacatatgctgtgtaacactgtcatctctgtgcacaagcttgttctcaagtcaaacagtggcttttcatatagtcttttaatttgtggttaatatgttcctacacctttcttcttctattaaaaaaatcaaattagccgaacgtggtggtgcacacctgtaatcccagctacttgggaggctcaggcgggagaatctcttgaactcgggaggcagtggttgcagtgagctgagattgcgccactgcactccagcctgggcaacagtctcaacaacaacaacaacaaatcaaaaagcaccagttgccatggctcatgcctatagtcctagcactttgggaggcaaacatgggaggattgcttgagcccaagaatttgagaccagcctgggcaacacaatgagaccaacatctctacaaaaataagaaaaactcaccaggcatagtggctcacgcctctggcccagctacttgggaggctgaggtgggaagattccttgagctcaggaggttgaggctgcagtgagctgtgatcatgccactgcatttcagcctgggcaacagagcaagatcctgtctcagaaaaaaaaaaaaaaaaaaaacagaaaaaaaaaaatcaaaactaaggttggggaaggggggaaattttcttttaaaaaagacattaagatggagacttttcaaacaatggaatcagaattcacttttagcagttacttagttaacaggactatattctgtttgtagtgtataccctaaatgctgtagccatgtaagtgataattacaatgtatacaagtcttcctgagaaccatatatttgaaattttaagtacaaaatgtcagccataaagttttccttattgaatttgtgtattattaagtgctttcaatgttcaaagctctatgccagatgaaagatatacagggagctccctcattcatcgattcgtttattcaacagtatttttttagtgtgtcctctgtgccaggtattattctaggtgctggtactaaaagaataaggagaatatagttctatttttaaagagttcacagtctcgtctgaaagaaaatggacatgtaaatagttatagaccctctagaaagtgtcaggccaaatacatgtgtttatttgctgtctctgtagagcacactaaaattgtaatacgtcaggtgtggtggcttatgcctgtaatcccaggactttggggaggccaaggcaggaagatcacttgaggtcaggagttcgagaccagcttggccaacatggtgaaaccccatatctactaaaactacaaaaattagccaggtgtgatggcagatgtctgtagtcccagctacttgggacttgaggcaggagaatcggttgaacccaggagacagaggctgcagtgagccgagatcgcagcactgcacttcagcttgggcaacagtgcaagaccttgcctcaaaaaataaataaataaaataaaataaaagtataataaagagggagaaaagatgtaaaggcacaagaacaaaacaaaggaagacatgacaggaaataatagatatccaccaaattttagacggtggacagcagaagcataagtaaaaactgatttggtaaagaaaactgatgtataactacttgcaaaaggaaaaaggtatgtttgtgccatagaggcctaaaagggttcaagaattggaggtgggttcaagaattggaggtgtcggccaggcgtggtggcctcacgcctgtaattccagcactttgggaggcagaggcagacagatcacctgaggtcaggagcttgcgaccagcctggccagggtggttaagccccgtctctacaaaaatacaaaaattagctcagcatgatggcaggtgcctgtaatcccagctactcaggaggctgaggcaggtgaatctcttgaacctgagaggtggaggttgctgggttgctgtgagctgatattgcgccactgtactccaggcctgggtgacagagcgagattcattctcaaaaaaaaaaaaaaaaaaaaaaaaaagaattggaggtgtcaagtactctgaaactgggagtgagaggggagctgaaaataagaggatatattgaaaatcattatgaggagcaattagatccccagatccctcccccaacttcaagcatcaaggtcactacccttcattccatagaagactggagatattaaactagaggagctcttgactcaggagcaccagacacagagcgtaggtgagatgccctagtgaaaaaagattgtcaatgtctatctgctaaatgttgacatttattttccagctcccttcccttgcttagctgtcagaatgctggcttccaaatgaatataccccaggtgggattctggaatattttctggagaaactgaaatagcctcagaggaagtccctacaaatctgacatttaggagttgcacaatgaaatgaccaggtttccgcccattcattctacagtgaagctcaatataaacaagctccaattcattcagataaccagttttttagtacctcgcaccaaataggaatgaacatattcaggtattcaaggatcaccagaaatttgggggaagtctctaatatgatagccagaagccaaaacaaaacaaaatagaggccaggcatggtggctcacacctataatcccagcactttgggaggccgaggagggcagatcacctgaggtcaggagttcaagaccagcctggctaacatggcaaaaccccgtctctactaaaaatataaaaatcagctggccatggtgcctgtaatcccagctactcgggagactgaggcacaagaattgcttgaacccagtaggcagatgttgcagtgagccaagatggtgccactgcactgcagcctgggtgatggagcaagactctgtctccaaaaaaaaaaaaggaacaagaaagagttcttagaaagtaaacattgtaatagctgaaagaaaaattcagtagatgggttgaaagatcaagaaattacccagcaaaggcaaagaagtagaaaacaggaggaaaaaaaaaaaaaaagaaaactgaaggcccagtccaggagtataagacctaaaaatttgaagttctagaaagagaaattggaagaactagaatgccatcaggcttctcaacagcaacatgagaagcttaaaaaaaaaaaaagtgcaatgcttttagaattctaagagaaaattattttcaacctagaattctgtaccaaaccgaactatcaatcaactgtgaggataaagttgtttttttttttttttctttttagacagagtcttgctcttgtcgcccaggctggagttcagtggcccaaactcggctcactgcaacctccgcctcctgggttcaagcgattctcctgcctcagcctcccaagcagctgagattagaggcacccgccaccacacccagctaattttttgtatttttagtagagacgggtttcaccttgttggtcgggctggtctcgaactcctgacctcaggtgatctgcccacctcggcctcccaaagtgctaggattacaggtgtgagccactacacccagccgaggataaagatttttagatgggcagggtttcataaactttaacttttatgcagcctttctcatgaaactactgaagagtatgttttatcaaaaagtgagaataagtttaggaagatgaaattatgagatctagcatcaaggggtgcaacacaggagagaaagaaagagaattcttagaatgataatggaaggtagttgcaggacaacagtttgtgcaagacagctagaaagcaattcagattgaagtagcaggacagaaggctctaggaggaatttctgcaggaaaattaaataatagaattgattatctgttgtgtaaaaaaattgtccaaccttcagttggagaattagggtttaatacttcagttgaagaagcactgattaatacttaaaaacccccacaaaccgagaaagaaataatcattctaagaaaaacaaaaggttgtataagaaagaaaatataataatataccttgtgtttttgctgtgcataatatttacatagtcataaatgagtaaatactgaatattggtaagccaaaattagtatcatgaaaagatggacagatgggaagtatatgtgtgtggtgaaaaagataatttgtcatcttcaactgaaagttaaaagatgtctaacatttaaaaatcaagaaatagcagtataaacatattatttaaagaagcaaagcaaaaaacagaggactcagtgagttttgttaagtatgacaggttagaagaattactacagtagtttggttggggtgaaatgagttataacttccaagagaaccattttagttgagtgacggaagcaacgttgaaggagttactgagtgaatgaatgggtagtaagaaagaggaggtaatgagcatagcatactcctctgagaaatctggctttgaaaacaaagggaggagaaagcggtgttagtgagttgagtctatgaaagattttttagattaagacaccacttagacatgtgtgcatagacagcaaggagttaatggagaaggtaaggtcaacgatgcaagcgtaaaggggatagttggtggagcaaggtcccagaaactgagataacatggactcaagagcatagatggaaagattaattgtaggaagagaagggaaagatttctttctctgaaagaaggaaggaagaggtgcagataagtgaaaatgcagagaaatattaaggtataaaggaaggaaattgagggacttaaaaaggtggcttcagtcttctcaagaaaataagaggttctctgctgagagtttggatttggggcataggattagcttggaaatttgagaatggaaaatatctgaaggcatgtgatgccaagttaaaaggagatgactaaaatgattatccagtagccacgagtgtccagttgaggttagatagcagaaatttgtaataaagccaatcaatatggtttctggacttccctcaagaacgttctatctccaaaagttgtattaatcatcatcttggctaggatggcgtttccttggagtgtcttaagagacattccagggttcaaaaactttagaaaatgcttgctcaaggagagtcagtgctcaagaataccagagagaaggttttcttgtgggacacttcaatctaggtcattcggaggtcttgtgggggatcatgagcaacgaaaaagaaatatacttgagagacttaaatgacacaaaacagtttgatatcaaaaagatctgtagctgcatggacatctggacacaaatctgagggtgagagcgtgttggagaacacctggattcagataaaagaagagcagaagagaagtgacatcattgtgggattagaatatagactacctagccagatggaagaaatagataaagcatttctgatgcagatcgcaaaactggcctgagtcaagagagcttggtgatagggatttcaagcatcagcacataagctcaaagtcaagttcagccaaaagctgcatacttgattaattctttttttcctgtttgtttatgtttttctgatcaaagaaaaacttgctcattgtagaaatgtagtagtacaggaaagtgtaatgaagtagaaaaataatcactcataaatccactcaccattaaaatacttgctaattatttctagtatttttatgcattgttgtctttgcatagtagagattatgctgaatatacatttgtctaaactgttttttaacataaaagacttttctcatatatatttcttatatatctcatatattttcatatatatctgaaattctttttatatgttcatctttcagaaggaagaaatacggccgggcgcggtggctcacgcctgtaatcccagcactttgggaggcggaggcgagtggatcacttgaggtcaggagttcgagaccagcctgaccaacacggtgataccccgtctctattaaaaatacaaaaaaatttagccgggcatggttgcacacacctgtaatcccagctacttgggagggtgaggcaggagaatcacgtgaacccggaggcaaaggttgcagtgagccaaggtcatgccattgtactgcagcctgggaaacatgagtaaaactccatctcaaaaacaaacaaacaaaaaaaaggaagaaatatgagataggagtccaagatatatataattataaaaataatttcagggccgggcgcggtggctcacgcctgtaatcccaacacttggggaggccgaggcaggcggatcatgaggtcaggagatcgagaccatcctggctaacatggtgaaaccctgtctctactaaaaatacaaaaaattagccaggggtggtggcacgcgcctatagtcccagctgctcaggaggctgaggtaggagaattgcttgaacccgggagatggaggttgcagtgagccaagatcgtgccactgcactccagcctgggtgacagagtgaaactccgtctcaaaaaataataatttcactatttactctttgctaacattatttccatttttctgaaaataaccagtcaatgctactgtattaggcaggaaaaagaaataagaggcataaaaattttaaaagagaaggaaaaattacatgattgcaggtgatatgattacttagctggaaagcccaaggtaatcaaattgaaatctattataaacattatgcttcagcaaggtagatggacaaaatatactaaaatcaataatttattttaaaaaataataagggccaggtgcagtggctcacacctgcaatcctagcacgttgggaggccgaggcaggcagattgcttgagcctaggagttcgagaccagcctgggaaacatggtgaaactctgtctctacaaaaaatacaaaaattggccaggcatagtggtgtgtgcctgtagtgctagctactgggaaggctgagatgggaggatcacttgagcctgggagtttaaggatgcagtgagccaagatcagaccactgcactccagcctgggcaatagagcaagaccccatctcaaaaaaaaaaaaaaaagattacatacctaggaagaaatgtaacaagaatatgaagagagctttaaaacactactggaaacaaaaaaaagacttggacatatggaaaggcatggtatgttcttaggaagatttaaaatcataaacctgtcagtgctccttaatttaatctataagttaacatgatctccctaaaaaaaaccaataggactttttgcttatttgcttatttttttgagagaaatgattgtaaagctcatacagaaaaaatatgtagactaaaataaccagaaatatcccgagaaagaaaagaaataatgagataccagcctcgttaatatctataatagatattaaaatctgttataaagctataataattccactataattgctaacaataaacactgtgtgccaggcactgttctaagctctttaaatataacaattcatttaattctcataaaagcccgttgagattaacctactcaaactcacactgccaataagtggcagagctcagatttgaactcaggtgctagctccagaacatgtactctctccatcaccacactcttcatcaccagcacatttgttattgacatattaatagacaggcaatcaatggaccagaatcagaagcttagaaattgactcaaatatagaaataaaattaatctacattggggagagcatttaaattaatgagcacaactggtagccatgttaagaatatgatattggattctttcctcacatcttatatgcaaacaaattctagatggatcaaaaatttcaatataggccagctacagtggctcatacctgtaatcccagcactttgggaggccgaggtgggaggattgcttgaacccaggagttcaagactagcctgggcaatgtaaagaaatctgtctctacaaaaaaaccttttttttttttttttttacagcagggtgtggtggcgcacgcttatattaggttggtgcaaaggtaattgcggcttttgccattcgtagcaatagtctcagctactcgaaaggctgaggtgaggggatcacttgagcccaggagttggaggcttcagtgagccatgatcacaccactgcactcccgcctgggagacggagtgagaccctgtctcaaaaaaaaaaaaaaaaaatacaaaaaacaaaaacacaaacatgaagaaaccacagaaagatgttcttacaatctcacagaagggaagatgtttctaagagagctgataaaaaaaaacctggaagccataaaagaaaagattgatatattttgttgcagaaagaggaaaaatatttgcttgccaacaaatactgtaaacaataacaaaagattaacaacaaacagaaagtatttgcaacttatatcacagatgaagggctaatttccttatatacagagttcctaaaaatcaataataaaaataccaaaaactcagtagaagattgaaggatgaaaatgaacagagtttatagtaaaggattgtataagtggttctttaaaaattatttttaataactagattgagatataatttatataccatacaattcacctatttaaagtgtacaattcagtcgtttttagaatattcagttgtaaaaccatcaccaaaatcagttttagaatattttcatcaagccccctctgccaagaaaaataccccgtacacattagcagtaactcccctttttccccacccacaaactcccagtcctaggcaaccactaacctactttctgtctctgtggatatgcctattctggacatttcatatagattatatatagatagaatcatacaatatatgggcttctgtatttggtttctttcactcaatgttttcttttctttgtttttatttaagttcttggggtacatgtgcaggatgtgcaggtttgttacataggtaaatgtgtgccatagtggtttgctgcacagatcaacccatcacttaggtattaagcccagtatgcattagctattttttctaatgttctccctcccccgacctcaccccccaacaggccccagtatgtgttgttcccctccctgtgtccatgtgttctcattgttcagctcccacttataaatgagaacatgcggtgtttgtttttctgttcctgcgttagtttgctgaggataatggcttccagctccatccttgtccctgcaaaggacatgatctcattcctttttatggctgcatcacttacagttttcaagatttatccatgttgtaacatgtatcagtactttattcctttttgtggccaaataatattccattgtatgattataccacattttgtctatccattcatccattgatagacattggattgtttccactttttggctatcatgaataatgctgctgtggatgtttgtatacacacttttttgtgaacatgttttcagttctcttggatatatacctaggagtggaatattgggtcatatggtaattctgtgtttgaaagaacagccaaactgttttccaaaatgcctgcactctgttacattcccagtaacagtttatgagggttacaatttctccacattcttgccagcatttgatgttacgtgtcttttttattatcgccagcctagaggtgtgaaatggtatctcactatccttttgatttgtattttcctgatgactaatgatgtcgaacatctttttacatgcatattagccatttgtgtatcttttctggagaaatgttcatccacattgtggaatgtatcagcacttcattcctttttactgctatgtagtattccgttgtatgaatatagcacactttgctttttgtttgcttgttaatgtacacttgggttatgtacagtttttgcccattatgaataaatcttctaggaacatttgtctccaggtctttttatggatgtatgttttcatttatcttgggtaaatacctaagggttgaattactgactgctttctaaaacagttgtaccatcttacattcccaccagcaatgtatgagaattccagtttttacaattgcttgttaacatttggtattgtcagtcttttgcattttagccattctagtggttgtgaaatgaaatctcattgtggttttagtttgcatttccctgatgactaatgatgttgaatactttttactgcttgttggtcatttgtatatcttcctttgtgaagtgtctcttcaaatattttgcccaatttttagtgggttgtttgtctttttattatccagtggtaggagttctttacacattctggttacaagttagatatgttcattacaaatattttctccctctgtggcctctttatttatttccttagtgatgtcttttattgagcagaagttttaattttttagcattttttttcttttatggttaatgccttctgggtccagtctaaaaaatctttgcctaccctaaggctgtgacagtgttaccctatatttccttctaaaagcaatagaggtttaacttttatgtttaggcctataattcatcctgaattattttttgttggtagtttaagattgagggtcaaggtttttccccgctcccctcatggatagccagttgagacagtatgatttattgaaaagactttccttctcctacttgttgtggttcctttgttaaaaataaataaataaattgaccatgtattaatatgtgcatatctatctctggattctctattctgttccattgatctaaggtagtgtatgcccttcaactttttctttttcaagattgttttattcattcaaggccctttgcatttccatataaaatttagaataaactggttcatttctacaaaaaaagcctgatgagaattggattgaaattattaagaatcgccgggtgcgatggattacgcctgtaatcccagcactttgggaggccaaggtgggcagatcacctgaggtcaggagtttgagaccagcctgaccaacatgcccctgaccaacatggagaaaccccatctctactaaaaatacaaaaaaaaattagctgggcgtggtggtggacacctgtaatcccagctagtcgggaggctgaggcagaagaattgcttgaacccgagaggcagaggttgcagtgagccaagatcacgccactgcactccagcctggcaacagagcgagactccatctcaaacaaacaaacaaacagtaagacccgaaatattatttttgaaccccaagctcacttttgtatagatatacctactctagaaacaatgacaaaactaggaattgtgacacaatactaaagacaatattaaaaggcttttttaaaaagttacattgggagcaaaaagaacaaggaggcctaggtgggtggtatcatattaatgaatgaaagaaagaaaatagagcattcacctctattttggtttagtcttctctgtcaaagaggatactctttggactggaaaagataaaataaacactggttccagggaatgcagtcaaacgtagttgagattgaaataggtcatgcaactgctttaaatgatttcaagttccttaatcttatatttcaagatactgaggactaggctgggcgcagtggctcatgcatgaaatctcagcactttgggaggctgaggtgggtggatcacctgaggtcaggagttcgagaccagcctggctaacatgacgaaaccccgtctctactaaaaatacaaaaattagctgggtgtggtggcaggcacctgtaatcccaggtactagggaggctaaggctggaaaatcacttgaacccaggaagcagagccaaggtcgcaccattgcactctagtctgggtgacgagtgaaactctgtctcaaaaaaaaaaaagatactgaggactagtggatgagctggctgaagcattgctggcagtctctgagaaagtgtgcatggggagggggaattaggggatgggggtcggggatggatagaaatttcagaagattagagtcaaggaactaatattcaggaggtcacttcagcagacttgacatccatcttaggtaatattcttaaactacttatgaacaagaataagttaagaggcctggcacagtggctcacgcctgaaatcccagcactttgggaggtggagtcgggcggatcacttgaggtcaggagtttgagaccagcctggccaacatgatgaaaccccatctctactaaaaatccaaaaaaaaaaaaaaaaaaaaaaatagctggctgtggtagtacatacctgtaatcccagctacttgagaggctgaggcaggagaatcccttgaacccgggaggcagcggttacagagagccaagattgcgccactgcactccagcctgtgtgatggagtgagactctgtggaaaaaaaattttttaaaaagaataaattaagaaaaggaagttgggatcaccataagcttaccagaatttattgaagatggagacagaaaaggggaggaagtagggggtaaagggggaaaggaagaagggaagagaagataataaaggggaagggaagggacaggaggcgaaggaaaaggaataggaaaagattccaggcttagtgggtaaagaagacttgatttcaaccctggctcttttacttcttagtaaaatgatgttaggcaagttattaattgctataagctagatttccttattggtaaaattgaaataagagaaactacttcatagagtagtcctgatgattaaattaaataatgtgtataaagtgcttatttatcaaaagcagtgataactgtgaagggggtgaatgatggtaatgacaataatactgacggagaaggaacgggagtagacaatgtaaacttactccctttttgaagagattattacattggtaagttgacagaaatctgtacagtatagctatatttagtatagctatatttagtatatttgtttagctaaattggatttctacaagactttgacaacatctccatgacatccttgcgaacaaggagaaggaatataggctggatgatataggctggttgaatagtcatacttaaagtgtgctgattaatgggttcctgtcatgctgaaattctccaggagtgtaaatctggactatgtacttagccaagcttttttaaaaaatcattatttgcataagagcattgatagcaggctaattaaatttgggaacaatagctaataagctgactgaaaaaaacagaacctaaaaagaaatggtataatacagagcaaagaatatggccttaatgtcatggatctatcactactagctgtgtggctttgagtaaattgcttaaccacctgagccttttgttcctcatttgcatggagataatactacatattccatgtggttgtgagaacataaaagataatatatgtgtattatcacacctgtaatcccagcactttgggaggcccagggtgggcagatcacaaggtcaggagatcgaggccatcctgaccaatatggtgaaaccccatctctactaaaaatacaaaaattagctgggcatggtggtgcgggcctgtaatcccagctactcaggaggctgaggcaggagaatcacttgaaccagggagtcggaggttgcagtgagccgagatcgcaccactgcactccagcctggcaacatggcgagactcaaatatatatgtgtatgtcaaatgtatgtgtgtgtgtgtgtgtgtgaattagttatctatttctgtgttataaatctcccccaaaaaacctgggggcctaaaacaatacacatttattatttcacacaggttctaaaggctgggaatccaagagcagcttactggggtggttctggctcagagtctcttctaaggttgaaatcaagattttgattgggactgcagtcatctaaaggcttgaatggatctggagggcctgcttctaagctcagtcatgtgggaggcctcagatctttagcacatgatcctcgtgatatgaggaactggcttccccagagcaagtggtcttagaagaagagagcaagcaggaagccacagtgcctttatcacttggcctctgacatcacattctgtcgcttttgttttattttctccattagaagcgtgttgctaagtttagctcatattcaaggggaaaagaattaggatccacctcttgaagtgggggagtatcatagaattttgtgggcatatcttaaaactgcaacaatctaaaaagtactcagtacagtgcctagcacataagtgctccataaatggcagttgttattctactattaatagtctacacttaatatacatatacaattaatatacatggtccctactatgaaaccggtgtgggtaggacaagataaactcatgatttcttagattcctggaaaacacagaaaaagaagtaccacatatgactacattaattacatctgttttgtacaccaaaatgaatggattatttttgcactgcatgtaatgcactaagaacaggactagtaaaaataaattttagtaatatttatttatttatttattttgagacagcgtctctctcttgcccaggctggagtgcaatggcacgatctcagctcactgcaacctccacctcctgggttcaagcgattctcctgcctcagcctcccaagtagctgggactacacgcatgcaccacaacactggctaatttttgtatttttaatagagatggggtttcaccatattgtccaggctggtctcgaactcctgacctcaagtgatccacctgcctcggcctcccaaagtgctgagattacagatgtgagccactgtgcccggccaaattttagtaatatttaataggcatacataaaatgtatagtctgtaaatatgagtgatatgaaaaattcgaatgacaacctaaaagtgatattatatggttttgttaaagagttttatatgtacatttaaatataagtattgatcatctgagaactcatcaaagcttaactgaataatgtatcaacttgtctttctgagtgtccttttctcatttccatttaaaaatgtgccacagctaagactgacaggccccagtctgcagcaaagatggggaagacttggtagttcacacgcctcccctgagggcaaggagtaattctggggggatgtaaactaacaaacataaaagtattatatcggcaaaggggtcgattaagtaaaagagttgatgttgacagtaaaaatttagaagcaataattaatgtggctgaatcactagataatttcctctttatgtatacatttatatgtgtatatatatatttatatatgggtccataatgcccatcattagcctcaaagattgtctaatgttcattggaaacaaaaacataagaactctcccacccgggtggacagagtaatttactgagccactttggtaagataagaacattagattgaaggtaatgtcacaccttaaacttgttaatttattggtgttttgatttgcattaaacattagacagatcctcaggctagcggctgacatggtagaactctccttagtatctcaccaaaatagcagtcaaacttctaagatgttcaaaacatagttactaatttgaaagtaagtagaaatggttgctgaggagccaggatttacagaggttatatgcatcattgtaggtgaggcaggaagtctcctaagatttcacagggagcctcctgacttataaatgcataaatcacagtattgatcaggtcagcagtgacagataaaaagtagtgacgtgggttttaactgttgctagccttagccacacactgacagttgtgataaatggtaacagaaaagggagttattatagatccaaacagtgaagagaaaatatatatttaaaaaccaacattttaagtaagataggtagtaatttactgtgtagaggacaaataaatggctttatacgtctttttgttctttttttgtttgaacggagtttcgcttttgttgcctaagctggagtgcaatggtgggatctcagctcaccacaacctctgcctcccaggttcaagcgattctcctgcctcagcctccggagtagctgggattacaggcatgtgccaccatgcccagctaattttttgtgtgtttttagtagagacggggtttctccacgttgctcaggctggtctcgaactcccgacctcaggtgatccgcccgccttggcctcccaaagtgctaggattacaggcgtgagccactgcacctggcatgtctttttgttctttaagggtatctactatggtccaagaaaatgagcagtatgcacaatgttgaaacagagttgataaacaaaaggtgactgatgttcactatcatcttttttaggaagtcaagtaagtttgtgatatagtttacagatacttctatcaaatattaaaatgtcttaagatggaaaaaaaaacagttttgacactcaagtaggttttacatattaacatatatagaatgcacatagaagaaagggtcagagaggtccctggaaatgccgtgtactgattcagcatcatgggggctgcacagcctgcactgtgagtaataactataataatagctatcatttaatgagcatttaccatgtgccaggaattaggttaaatctttacatgaattatagtattgagcccttttatccatgccttgagtaggtattattatatctattttaaagataaggaaattgagggccgggcacggaggctcacgcctgtaatcccagcactttgggaggccgaggtgggcggagcacaaggtcaggagatcgagaccatcctggctaacacggtgaaaccccatctctactaaaaatacaaaaaattagccaggcgcggtggcgggcgcctgtggtcccagctactcgggaggctgaggcaggagaatggcatgaacctgggaggcagagtttgcagtgagccgagatcacacaactgcactccagcccgggcaacagagcgagacagcgagactccatctcaaaaaaaaaaaaaaaaaaagataaggaaattgagacatagtggttaaaaatttacctaacattggctgggggcggtggctcacacctgtaatcccagcactttgggaggccaaggcaggcggatcaggaggtcaggagatcgagaccatcctagctaacacggtgaaaccccatctctactaaaaatacaaaaaaattagctgggcacatccagctactcgggaggctgaggcaggagaatcacctgaacccaggaggcagaggttgcagtgagccgaggtcacaccactgcactccagcctgggtgacagagcgagactccatctcaaaaaaaaaaaaaattttacctaacattgttcatgtggttaagtggcagagcccagaatcaaagtgaagtctgagtacctccatccaggtttactatctcagtctacgtgttttatggaaatgaggcatgccctttctgagaaggaatgatgttattatacctccttatatattttcattaagaatgagtgaggatctcctcctttattatttattcatgtgaccctttcttttccctcaccctgtgggaggctgaataatggccctaaagatattcaggccctaatccaggattatccaggtgaaccctaaatgtaatcacaagtgtccttttaagagggagtcagatagagatttgatgacgggagaggaagaagacaatgtgacacaagaagtgggtgtgtttggagcagggaagtgacatgacatggggccacaagccaaggaatgaggataacctctagaaactggaaaaagataggaaactgattctcccctagaacctccaggaggaaccagcctgctgacaccttgattttagtcccataagactcattttggacttctggcatccagaactctaagagaataaatttctgttgttttaagctaccaaattgtagtaatattttatagcaaccataggaattgaatacatatcccatattactggcttcaggacttatttgcattatactttctccttgtatttttcctacattttgtaactgtttattacttccagaatgcaactgtagagtgtgtaaataacatattcgtaaaagcattgtttcagataaagtctaaaaaagaggtattttattttaaaataatatccaatcctatggctatcccatatcccagcctttccaatggctgtaaaagggaaaattatgggacgaatgttgtcaagtatataatgaaaggaaatcttttcaatatgaatgatcaataaacttgtagaaaaatgtccaccataacgagagtcacaccagttaatcataacccacatctctgactaggaatgcagtaggtttcccccattcccaccactctttatttggagatttgttgaaacctataagagaattatgagaatagtatgaaggcacttgtctgcccttcaccaaatgctaactaatatgtcaccatatttgtgaacaacagatagataacttgaaactaagttatgggaatcatgacatcttacccctcacatccctcatctcctaagagtaaggactttctcctcttctcctgcataactccaatgtcatttgagaaaataacactaattttataacatcacctaacatccagtccagtgcaaattacaatttccccaattgttcctaaacattattaatagctgtttgttttctgacccagcatccagtcagggtttacacattgcacttggtaatgtctctttagtttcttttaatctggaacagaccccttacaattttgttttcatgatactgacttctttgtgttttcctgaccctcccacactagaatgtacattttacaggggcagggattttcgtctctgttaattgccatgtccttagcattgagaatgctgcctagcactttgtaaatatttgtttaataactagatgaatgaataagtaatacaagtacaatgagtgtcatgaaaggtgatttagaggatgccaagggtcctgagaatctaatctgttgttgtttgtgtgtaactcttacctctgcattacacgtattgtgttacacatatacgtgtttcaggcttgagcaaagggctcattttacaaatcagtggggagatataagtgtaataaatataaataagaattgagttttaaaaaatacctaagttggtcaagattaaaaggcatgatagcaggcactttaacagcaaaactgcaagagacttaagctgagtttgggcaactgtgatgtgactggcaagatgctaaattagctttagacttaatacaataagaacagaggctataatgaagaaggtgattgtcttgctctatttattcattctttcattcaacaaatatttattgagtaccttgtgtgccaggcactgttttggtgctggatatttagaattgagcaccacaaagtcttcggccacatggagcttacattccatgatgaacaaacaatacttaagtaagttttttgagggtaggggctctgtgctttcacaagagaggcaacatagcgtaatggtcaagagcagtggtttttgagccaccagacataggtttgagtcccagtttgtatacttttttgctgcttggtcttgggtaagttccttaagctctcagagcctgagtttccccagtagtaaggtcatggcaaataacagtacagcctcataggttgggaagggacttaagcgagataatgcatgagaattgtctcacatggtgcctggcacttaatagcttcttgataaatgttagttgttgttttcatcattattaacattgactaactaaaacatgtcttactagaaaagggatttgaaaccaaatgatgaagaacagttgaaggaaccagggatgttaaactcatagaaaagtaaatggaatacatgcttactggtttcaaatacttgatgatgtagcatgtgacctgagcttacttattctgtgtggtcccagaaaacagaattaggtccagccggtggaagttaccaggaagacaattttcacaatgtaagaagaaatgttcttaacaattagaattatctataaatagaaagagctgcttgggaggaaatggattttctgtcattagagataataaagcaggtactagacatgtgctctccaatatgtagccactagcctcctatggctatttaaatttaaagtaattaaaattaaatacagttataaaggcagaggataggatggtggtttccagggattggggaagggagaaactgggtattgttgttcaattggtgtaaagttacagttatgcaagatgaatcaattctaaagacctgctctatagcataatgcttataactaacaaaattaggaacctaacaatttattaagagggtagatctcatgtcaatcattcttaccacacacagagagagagagagagagagagaaacttttgaggatgtggatatgcctgttatcttgatggtagcggtgatttcaccattttatgcatatatccaagctcatcaaattgtacatattaaatatgtatagttttttgtatgtcagttaaacctcaataaagctaatttttaagaaattaaatacaaatacaattcagttatttagtcacattagtcacgtttcaaagtgctcacaagccacatatggctagtggctgctgccatattagtgcagaataacaaacattgccatcatcacagaaagttctgttgtatagtgctgttctggacaatgaacaaagatgtttaagaagaaatggaggcacaagatgagaaagaagagctgaattaattaggtaacttgtaaagtccattctaagcctcagttttatagattatgaaaggtcatcttttaaccatttcattttggaataaaggaagagttattctcacagaaataaaactgttgtgttatttggagatatttttattttactgatttgacttaaaaattgcttcttttcagctcatcactctagttagagaaataaatttctgaggggaaatggcctagcaatggcatggcccaggagaagtacagtaatcattgcatctttttcctgaaagaactttccatgattttttagttcagcctgaagagccatttgtgacgcttaaaaatcaatgaaggggaaaaatgggactgagctgggccagttttcaaaggacatgaggggtgagtcttgtttcagttgctagtattagacaggatttcatttatgaactttgttctcttgtccaactccagttcctacaggtttcctttttcctttgctctccagtcaaaaggaaaaatactcacatgattattagaaatactggagcaataaattgtttgagggacttgaaacaccctttttttctttcccttcaaagccttaaatgatagttgcttcattgaagcttacagatcattaaaagcagtcctgccagggtgttgtaatatatgttttagcttccaattgaaggaaaatctctaccaaactaacctttgagtcatacagaattttttattttctatttttgatgtcttgggtgttccagcactttttcatcacctgccatatacaaaattcccatatcttatttgagccaaaaatgaagcctggtatcacctctaacaagtacaaattcctagcgcttttcaactatgttattatttgcctattttatttattgcagaacagttcccaaggagtaatgtcctggagaaacagaaataacactgtagaagagcagtagtgttatggacattgagagtaccattgcaaaacctgattttttttgcattttcatggcttcagtttcgagtaattgtagatggacagaggccaagctgttttcaatttgacccttggttaagctaaaaaactacataacaactaagggtaccctatctcctgttacagagatagatacataaaagggccagactaacaagaaaccaaatagccagtctggggtatggccagagaatctgtaactctaataagcacaccaagggattctggtgaacagactaatttggggaactgcttaggtccacattattttgtaaaggaatgattgaagaacctttttctgaatttttaaaaataagacaccaatttttttattgtagtaaaatatatgtaatatagaacttaccattttcaccatttttaaatatacaattcaatggtattaagtacaaccatcaccacgcatttccagaactttttcatcatcctaaactgaaaccgtacccattaaacaataactcctcattccctgctcctttccctcccaggccctggtaacctctataacactttctgtccctctgaatttgcctgttctaggtccctcatataagtgaagagataattgatttttaacaaaagcttaattgctttcttgcctggaggcatgggtcggagtgaaggggagcaaacattaattggtgtcttgacctgacaagtcaaggtcacattcggatttactggatttatctcaagcaatagaaaactgtgtttttaaactttggttccatggaatcatacagactccttttattctaattgtttttatcatgacctgtgtgttcacctatgaaattattcatttgaaattgttactgactagttggtgatattcaatctgattttctcatgaaaattaataagtatgtttctgaaaatctcctctcaattatgtcattctaaacaatttctgcaatgttaaggcccagcagaaaaaaaaaaaaaaaagttactatcaaaatgtttccaaagttcaaaagcagaagaattagcactttttagtttctttttataaaatgcatctacttcaagccatagcaaatttgaagtttcagatcctctgtccacaagattgagtacttaacgatagcccttttggctccttccagatctcctaataaagcagggagctcctctcagcccggccagccaccccgtccgggagggagatggggggtcagcccccccacccggccagccgccccgtccgggagggaggtaggggggtcagccccccgcctggccagccgccccgtccgggagggaggtgggggtgtcagccctccgcccggccagccgccccgtctgggaggtgaggggcgcctctgcccagccgcccctactgggaagtgaggagcccctctgcccggccagccgccccgtccgggagggaggtgggggggtcagccccccgcccagccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggggtcggcccccctgcccggccagccgccccgtccgggaggtgaggggcgcctctgcccggccgcccctactgggaagtgaggagcccctctgcccggccagccgccccgtccgggagggaggtgggggggtcagccctccgcccggccagccgccccgtccgggagggaggtgggggggtcggccccccgcccggccagccgccccgtccgggagggaggtgggggggggtcggcccccctgcctggccagccgccccgtccgggaggtgaggggcgcctctgcccggccgcccctactgggaagtgaggagcccctctgcccggccaccaccccgtctgggaggtgtacccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaataaataaataaaaaataaaaaaaaataaagcagggagctccttcagtgtccagcatactactctggggagaaggcctcttcatcttgtctagagcagggcttcagatatctgtgccagaggcttaggaaagacctaccacttggaatgtagaacaaaagaaatgattgttttcttttttctttttttttttttttggagatggagtttcgctctgttgcccagggtggagtgcagtggcgggatctcggcacactgcagcctctgcctcttgggttcaagtgattctcctgcctcagcctcctgcgtagctgggattacaggtgtctgctaccacagctaatttttgtatttttagtagagatgaggtttcaccatattggccaggctggtctctaactcctgacctcaggtgctctgcccgcctcagcttgttttgttcattttaaacaattttccataaatttataaagccattctccatgacatgcttaccactttcacggtctgtgtaaatctgatccatcagtaatatagtatggcagcacctaattatgtgttttgtgaaaagctatggaacaaaaagtaccacctgttacttaactccctaattgtaaaattgtgttttatttctgtgccctgaggttggaccacagtattgtgataaaccatgggactgacgggtcttgctacccattcctgttctccattaaaaaaaaaagtaatcagatttcttctaactctcaaacctctaaaagcgcttctgaaaacttagatctaactgtttaaagttgacccctggattctataaccctctctgtcacaaatctgctttgtaactttgagcgaattatttatcttaaacacttaactttccatacaactattcattgagcataaaacctaaataatgatactacctctggaaaaaaggattcatgactcagtgggtctgtttccctacttaaatctggaagggaaaatgccttcttactcttccttctgaattttcccatttagtccctggcacaaatgaagactcgctcttcttggcagcatccatggctgctaagagaaactttgccccactgcctttgatgtggtgaaacaaagcctttaccagagtggttggaggatctgtcaccctggagactcctagggacccccacccacaacctctttgggaagttcttttcctaaagttgtattcagatttataccaatatgcagaggagacgtctttcttataaaaagcttgcttttcctctcaaagctgtgaagaagctagtgaaggggaagttgaactgggtataatattgacaaatgttttgagcacttcagataaaaatgtttgataagtgcagtcctgtttgtattgccttattacactgctcattggagaaagtgttttctttggtcacctgccaatgaaaaagattagccttttcctgtatttaggattgtttctttgactagttatgttggtagaacaagatagacaaatgctgctgaaattagcaaatcagtattggaacacagtgatactcatttctcctcactgccctttccaattcattgacagttgccgcaagcagtatgaatgggttttttataggactctctttctctccttacctattccaatttgtattttcactttagttcccttgctctgatgttcaagactttaaaggatttgccactgcccaccacaccatgctttcctattttataggatccaataagaaacattttttcatttaaatgcctcttctataacatgagtcaccttttagatttctataccttgtatcttctagtttctattttagtacagaaaaattatagtttcatcttctttgaggcaagatatgaagatttttttttgccctccctcaaatttattccctgtttacagcaaaggaagccactggctgcttttctaacatttctctatcagaagctagttgagctaaatgtatatacttttatattccccttaatatgtttagattgatctggggtacatcttttggatctggacattatgaaacaaagttaagccctttaacccatcatcagcctacatctgtctcttcagacaaaaaggaaatgaacttccattgctgtaggaaaaatttatgtcacacataagggcaaatttgttagcaataatgttattcaagccaggtgtggtggcgcatgcctgtaatcctagcactttgggaggccgaggcagtggattgcttgagaccaggagttcaagaccagcctgaccaacgtggcaaaaccctatttctactaaaaatacaaaaattagcctggcatggtggcatatgcctgtagtcccagctccttgggaggctgaggcacaagaatcgcttaaacccagaggcagatgttgcagtgagccgacattgtgccactgtactccagcatgggcgacagagggagaccctgtctcaaaaaacaaacaaaagagatagtgttattcagtactgggttcctaagcagtattacagtataaccttctctgaaattctttgcttttgtttttaatagaatagattttcataaggaatggattaggtgcagaccttcttgacagcatgagataacaagttatttcttgaagtcactctttagaataaataagtcgtattttattctgagggaatttttttttttttttagacagagtcttgctctgtcacccaggtaggagtgcagtggtataatcttggctcgctgcaacttccaccttctgggttcaagcaattcttctacctcagccttctgaatagctgggattacaggtgcctgccaccacaccggctaatttttttttttttttttttttttttattttatttttagtagagatggggtttcaccatgttggtcaggctggtcttgaactcctgaactcaggtgatccgcccacctcagcctctattccaagggaattttaacattgatttaattgagagaatcaaaagagcctgagggtagtttacagagaagagcccttttaggtagtattttttatttgacttgccaacctctaattctcactgacttatggtgagtttcaagtatggatagttttaagatgtggttagttcccatgactacaaaataaaatatgaatttcccatgttacttgaagactgtttgtgggaggtcttcatttaggtctttgcatcttctcaggagcatatcataatttaatagcctgtcatcggaaccctgcaaagatagtgatattcatcttagaaaaaaaaaaaacttgcatacctcctatacagcattctttgctgccacctaaagccatttgctcatgaaacagtaacctttagaacaatagcccgagttctcttcctatcagtcaattcttagagactctattagcaccttcctttgcttttgtcctgtcagatggagagacggggttggcagaagcaaaacagcctttataaatttttcttagaggtccgtgatcctagattaaagtaggaatcagaagacatcaggtctagaaatcctcagagtgaccttttttgacagagaagatatttatatgaagaaacatcagtgccaatgacctaaatttagctatctaacctctcaatatgatcatttctctgcttgtaaaaggggaatagtgacaccaatcactaccgtcctctggagtttgagagatacttaatgaaataatgaacgtaattctcctcttgcaagggaatatattgttgacttttaggagaatgatttgggggtccctaaggggcttaacaatctattacctctctggcactcaaataggattattgtaaaaagctaatctactgccaaaaagtaagccatttattctgtggatagatcaggtccagtgtgaaaaaaaggattttgatctcttttttggaataactattactaactagataggcacaaagatgtcttttttttctttctttctttaaaaaaaaaattagaacagaagtgtaattgtgtttgatggttcactttgggagaatgttaggttcaatcctgaacacagtaaatcagatgatatacttcttttaaaaagcctctagaatatgccttctcaattgaggcaatattgcctccaagggggcaaaaattggttctttgggaggcaaaaaaaaaaattagatattataatggtttgtgacccttaaaaaatatatagatagataatatgttcatgatatcaaaatttcatggggagtggacaaatagaaaaaaggtctaaaaagctagggggtgataatgaaaaaaagactgagaaacttttctcaagtctagaatgtgcatataactgtcaattactctttcagctgtgtttgtccctaagcatgggcaagctgcacattgtcaggtcgaaacagcttgctattgattattccttcagtctgagaggaactgagttcatagaaaacttgaacgaaatgaaatgtataccctaaggggtaatgatttcagacaaacaaacgtaacaaacatctacttgttagaaccaatactttgcactttaaaatgtggttaagcctttaaggtaagaggtttcttttttctcttgcctctttagccttacagaaaggcacatcaagggtaggaatgatcttcaaagtgcctcacagaaaaaaaaaaaaaaaaaagccagattgggagaaagtgtggccccaaaggcatactttggagagagtgtggccccaaaggcaggaagggaataattgactaaatagtaatgtaaagtgtacagcatcggcagggtgtggtggcttatgcctataatcccagcactttgggaggccaaggtgggaggatcgcttgagccctggagttcaagaccagcctgggcaacatagtgagacctcatctctacaaaaaatacaaaaaaattatcctggtgtggtggcacatacctgtagttccagctactctggaggctgaggtgggaggattgcttgagcctgggaggtgggggttgcagtgagctgagatcatgccactgcactctggcctgggcaacaaagcaagaccctgtctcaaaaaaaaaaaaaaatgtacagaatcaaagtcaagaaaattgatgggaattgacactgaagtacttaagaaattttaagtttgctcttgctgctggtattaataaactttcatatatccaacatattcttccttccacctttctcatatgtcttattagttctttcaaacactcagaatggatggaatgatccaaaattgacttgctacatactggggaatttggaagggacctgtgttttgcttagcagccctgaaacaatagaatggccttttttttttttttttttttttttgagacagggtctcactcttgcctaggctggagtaaagtggtgctatctcagctcactgtaacctctgcctcctgagttcatgcgattcttgtgcttcagcctcctgagtagctgggaccacaggtatgtgttaccacgccctgctaattttttttttaattaatggggtctcactatgttgcccaggatctcaaactgctgagctcaagtgatcctccctccttggcctcccaaagtgctgggattacaggcatgagcgactgtgcctgataatggccatatttaaagatatattttttcctcagtctctgactcttccttgcttaatcatcctattctttaatatacaaacctataactttgaggaaagagaatcagagattatttctccctacttacccatttcatggtgcgacaatgagcactcttctccaagccaagcatttgataagcattcattgctatgggtattttactgccttaaagaaatccaccccaattccctgccgattgatttcttaagatcacagaagaaagtggaatgaatcctagagaggccttcaagctccctgacacccatggggcccactcatctccacccccaatactccaatttcaaaatctaacacattgtccttttcttagttcctcagttccccgcccttcagcttctctttgttagccactgggtgggtgtaaccaaacctcagtcacactgtggccccagcagctgggcttctctctcccccattacattgcagacattcttttcacatcattttgtcctctctgctgcattccctacatttggcttcattccctctgtgcaaacttctgtttcaagggacagcagtttgccaaggagatgctggcagagagggtccagttctttcctttctatctgaagagcccagtgtcattcattagcatatgagaagaatggttgtaaataaacatcaaatgaggttaacgagctgcagctcatcaatattaatgaagtccacctcacagccttggtatgaggtaccaatggctctaatcacaagaagcagtttcataaggccccagttacagggcaggaagggttagatccagcgtgttgaaatgtttgtcattttatgaccccaggaatgctgcagggtaaggcagtctgataccagatctgtgcttgcaaacccctcttgtgttcagtttacatctgtttgtctcaacaggtggaagcctaggaaaaggctatatctgctaagccagaatctggggtgggaattctccaggtcaacctgcagttcccaaatcaaaatgaagttccagagtaccagggtttgatctctcattgcccttccatcagttaccccagataacccaaacacttgtttccagtgtagtgaaggatggtttgaggatctaagcccagcttggtaaggaatgaagaaactcccatttcatgtagctcatgtgcctgccagccaccagttaagtccctgtgcctattatttagaggattcaaagagtaacaagggccaggcatggtggctcatgcctgtaatccctacactttgggaagcagatgtgaggggatcacttaaagtgaggggttccagactagcctgggcaatatagggagacctctctcaaaaacaataaataaataaaaattttaaaagtagttgggcgtggtagcctgtattcccagctactcaggaggctgaggtgggaggatcacgtgagcctaggagtttgaggccacggtgagccatgatcatacaactgtactccagcatgggcaacagacagagactctgtctctgaaaaaaaaatttttttttaattaaaagaaacagtaagtacagctatcatttattgaacacttactgtgtcctaggcatggtactaaacatttttgttatataatcctcacaataatcccatgaaggtattcccattttacagatgaggaagttgaaactcactgatttgatgtcatgggtctaagatcacacatcagcaagtggcagaagaggagctcagatttcgatctgtctaactgcagagcccatgctcttacttcctaccctctgtggtatcatctcagagccaagcacataaaatgcaagcttttgtgctgctccttttcgtcaaagatgtgtgtcctccagtttcaagggactaaacacaaagtagttccctggaagtagaatcagaaggctttagaattaatttttttaagtcaaagtgcctctttgaaattatttttagaaaggaaactttcattaaatatgttttccttgatatataaatttggggtcagagggattaggctttgagaatatgtgtgtgtatgcatgacccagtctgtgttgatagccatgatactgatttatccaccttgtcacactagttccttttatgattaagcacacaccttgcatgaggtcagtgaccatggaacacagggaaaccgctcccatggctgatttgagcctatgatcttagcctcaattacattgtttcaacaactgaacgcctggtttattacttaaagtactatcattgtactttgtcttaggggtgggaaggagaaccgatcaaattgttgttatcacaaaagctacacctgattgtttgtaaagaaggacttctagtgaaaggatgaaagtgaaacagctatttctctttcttctatttttctccttgaaaattcagggacctaggccaagacaggcggatcacttgaggccaggagttcaagacctgcctggctaacatggcaaaaccccgtctctactaaaaatacaaaaattagccaggcgtggtgacacgcacctgtagtcccaggtacacgggaagctgagacacaaaaattgcttgaacccaggagggagaggttgcagtgagccaagatcacaccactgcactccagcctgggtgatagagcaagaccctatctcaaaaaaaaaaaagaaaagaaaagaacatgaaagaaagaaagaaaactcagggaccttacttggtaatttttacctaggcaaaatgcccaggaatgtttccacagaatggtacccaaagcccacccatgcaggagcccttcctgccaccaaggtaaccaagactaggaagcaattgaaactgggccttcctttcccaggcctgtggctgtcaacttggctcagaaagaggcagactgatgactttgtctccttacccactcacactaccacacagttctcatttgagcctggtcacatggctgtgccttcttatggccaaacaaggatacgctgtttcccgttctttgcaccctgggtttggcctgagcatccttagatgaaaccatcaggacccccaaaccttgaagcttttccaggggcaaattgcatgcaggggaaggaggggctgagctgtgtagtggagcagcggatggtgtgcagtcgggatgtttgcaagagccaaggggttagttcattgctgctttgtatactcaggcacaccagaaaactcagattaataggctgtttattcttcagcatgttccttgaatcaaaggctctggatggtattattaaagagtgtttgtgagagcgccctggaacactcctcctgggctccgctcactgaagaggaacgattgagtcctttcatttcctgggcagcatccctctcactcattgctcactgtagtataaaggtctgtagaacctttgttagaaacaggatcttttgttctgtccttatgaggtcccattacctacagcaccttgatctgttggagtctaattatttaatgttcttgtcttttgagctacctgaacctaatgaatgcagtccactctatctcagggagttgttttgctttggttttttgcctctatttggcaccagtttcctgtttggacagtattgccttttattttcatggttttttttcaaggagtttgtccaggagagaaggagacatccacctgaaacctactctgtgaagcaaatgaatatgttttttctattagaagattctcctaaaatgttctgaagtttgttcatatctgggaattgaagcacattgaattaagaaagaattacttcctccacctccacccctgcaatagagatttatactggacaaggtggcaaaaaaaaattagggggaaactgctcggtacaattcccccccagttcccttggggcagcagcgtgctgcacatgaggaatcactgtaccttgttcccctggcagtgatacttctctgtggccaggcaaatacagtagtccaggccttccacaacttctgcatgtgcgcatgtgcgcacacacacacagacgctcaaaaccatacccctcctgggcatccccttaatagaggcatccagtatattgcaaaggtactcatcactatacacagtgcaaatactcagcactcgtttatagcaaacccagtatgaataattagcaatagtttgggatctggcacaacccttaattaccacaactagaggccagaaaatgaaatcagggtcatatatctgaggttagaactctagaatctgtctggcatcctatagcccaaagcaccacagggaggtacaccttggagcaatgggagcactgtcatccaggagacactgtcccctcactttcctccaaaaccagcacagctgtttgcacgagggctatctgccgtatatacagtgagactaagatatatatacacaccctggcgcttcgcctgatttcttctgtgaagtccatctgtttatccagttccagatcccaaaaggcagtcaccaaaaactaaatagtgagaagggacaggcttttttttttcttttttgataaacatgttacagtgaacaaaacagattttgcaaacacattccatctagtaaatcttacctcacagctgtgtgagaagagcttggaggagagaaggatggggagcaggagggtctcaggacttgattggagaattagaaagttcagaaacccacaagggtgggacagttcagtactatctacttttttttttttttttttttgagatggagtctcactgcgtcgcccaggctggagtacagtggcacaatctcagctcactgcaacctcggcctcttgggttcaagcgattctcttacctcagcctcctgagtaactgggattacaggcgccggccaccatgcctgactaatttttgtatttttagtagagacagggtttcaccatgttggtcaggcttgtcttgaactcctgacctcaagtgattcgcccacctcaccctcccaaagtgctgggattacaggcgtgagccaccgcccctagcctatctacttcttatagggtgataattggccttttcccttcattctagcccctcatcctaaacctggaatctgtgatgggctcaccaaaaatgaagatctggctgcagactttggcttctttcactgaaaagctgatctagccagactttatcttcaaaagacaggccctgcacttctgatgttccctgagcctctcccactgagcctactctcgtccactgtagccatgatgctctctggattcagacaatggtgtgttgtcccagaacactgtatctggcctgtctgtgcttcacatctacccctttggctaggaaaatgagggacagagctcacatcagtaacttggattctgaggaccgaggacaagcagaagaaattgaccttttgcctcagaggtggctggatgtttgtgtgtctctcttcgatgtcaaattggctcactgaaccactcaagagttgttttttaaaaatgttctgctcactcctcatttgcgggtcagatgctttggataatccagtggaattctctctgcttcactgctggttgctgccagacacagagtgctaaatcctgtcagtcggtgacttgaaatgatgatgtgtgaaacagtgctgcgatttggacatcctgcactcatttgcatggactcctttgccagttaaccacagtagtgaaatggggcagcctggggcagcttccacagcccttgccttatctttcctcagtgtccccaccctcccccatggcagtatgtagctccagtaattggtaaggcttggaattctgtttcatttaatattattcccttcctaggcatcatagagcaatttctttaacatgctagattgcaacatgccagagacagagaaatagcatttgtgtgcagaatggagaggcgggaagcaaaacactcttgttgctgattcccatctcccggtctttgcccttccttctttccctagattgcatggctggctgattctcatctggtgagttctcagctcaaatggtacgttctcaaagatgagcctggcacagccatctcatgtggtcccaccctcagtcactgtgtatcacaccaccctgcctgatttatgtcattgctctcctcacttcctaaaagtatttctttctttgttactttttattctctgtctccccaaccactgcctccacacatacacactagaatgtaagtaccatgaaaatagggatttttatctgtcttatcccttgctgtttccccagaatctagcacagtccctggcatacctttgacacttagtatattgactaaataagtagctaagaatgtagcaattaagaacttctaaagcaaatatccatggttactatcaggaaatagtaaaggcagacagacagagagtttgaggaatggaatgagaagacatgatttcttatactgattttaataatggtcttaattacaaattgaatacgttaagtcaaagatcacaatatcgagtcgctcttcatttcttctgactcagactaaactgccccttattgagtaggttaggtcagggtcatagagaccaagtactacaaacttcctggccaaactggcataattgatgccacaaagtatgcccacttccagatttccactgggtggtgcctggctttgctttccttagggcagttgccagaagaaactggcacaatttaaagcagtttaaagcccagcctgggtatcttcatctagcctttattatattcttgcctgcctccagttcccaaaaagactgcattcctgtctgcaactccagggccctgaagccccttcagtcatgaaagccatggaggtgggttagccctgatccacccagcgtgagacagtatgaccaagagaacacatctttttttttttttttttgagacagagtctagctctgccgcccaggctggagtgcagtggcgcaatcacggctcactgcaagctccgcctcccgggttcacgccattctcctgcctcagcctcccgagtagctgggactacaggcgcccgtcaccactcctggctaatttttttgtatttttttagtagagacggggttttactgtgttagccaggatggtctcgatctcctgacctcgtgatctgtccgcctcggcctgagaacacatctttagtccagcagatacatggcactcatctcctcaagagtccttcacccaaacgagaattattagcttctcagaagttatcctttgtcttgttggggcaagatctgtgcctagtgtcaagagagagatgttaaagattaaagagcctccaccaggaaagggaatggttttgcctgaatctcttaatttgtttttccccgctacgagtgcattcatgttgctgggctccctggcttactccccggtggtttgtagtcattttcatcatgactttgcggttgcattgatatcagaatgagtttcgactgctgtacgtgatgcttccatgctccattgctttctctcttatgttgctaacgactctcctgttggcttcagcccttagccaagcccaccccactccacaccccactccttccctgtcttttattgatgctatgttgactttgcatgcctcagttagttcagttttctgagcacctgcagagaattaaccatctctgcttgctgctgcggatcacctaggcctttgatctgtttgatttctgtacttctaaaaatgttgaaggactctctaaccccaccaaagtacataaatggtgctacagttcctgtagcctgacctcctccagactagctctgcttagggaacagaagatcttcatgtaaatacagatgtagataccatttattaaatgttttctatgtacgattttactgttctaagcacttaatgtgaatatttcatttaatctttgcttatagagctaaaaggccatatacatgaactggcccattatttctctaacctcatctcttcttcctttccctcttattcttttggctcctgccatgttggtttccatgctgttcctcttacccaataggcacactccctccttaagactgtaatggctattccctctgcctggaatgctcttccctcagatgtctgtatcagttactccttaaccccttcaaatcttcacttgagtgttaccttctccattaaacctacctagaccactctagagagaattgaaccaccagtaccacctcatattccctatctctgacttgctgtattctctttttttccattatatttatcactgaatctcttaatttgcctcagttaactttctatatagcttatttgtttgtttgtttgtttgttttttgagactgagtcttgatctgtcacccaggctggagtccagtggcacaatctcagctcactgcagcctctgcctcctgggttcaagcgattctcctgcctcagcctcctgagtagctgggattacaggcatgcaccaccatgcccggctaatttttgtattttttgtagagacgggttttcaccatgttggccaggctggtctcaaattcttgacctcaagtgatccgcctgccttggcctcccaaactgtcaggactacaggcgtgagctgctgcgcccagcctatttgtttattttctttatcattcattatctgtcttccccactgcaagataagctccatgaaggcaaagagcttgtctatttcttctctaatgtatcctaagcacctaaaaagtaacatgtgacacataatagatgctacataatatctattaagtcagtgaactttgtcccctaaaaacccatgctgtaggttcttctgttatccccattttgtttatttatttatttttattatattttaagttctagggtacatgtgcacaatctgcaggtttggtacataggtgtacatgtgccatgttggtttgctgcacccgtcaactcatcatttacattaggcaaatctcctaatactatctctccccactcccccaaccccacgacaggacccggtgtgtgatgttccccgccctgtgtccaagtgatctcattgttcaattcccacctatgagtgagaacatgtggtgtttggttttctgtccttgtgacagttttctgagaatgatggtttctagcttcatctatgtccctgcaaaggacatgaactcatccttttttatggctgcatagtattccatggtgtatatgtgccacattttcttaatccagtctatcattgttggacatttgggttggttccaagtctttgctattgtgaatagtgccacaataaacatacgtatgcatgtgtctttatagcagcatgatttataatcctttgagtatatacctagtaatgggatggctgggatggctgggtcaaatggtatttctagttctagatccctgaggaatcaccacactgacttccacaatggttgaattagtttacagtcccaccaacagtgtaaaagtgttcctattcctccacctcctctccagcatctattgtttcctgactttttaatgactgtcattctaactggcgtgagatggtatttcattatggttttgatttgcatttctctgatgaccagtgatgatgagcattttttcacatgtctgttggctgcatagatgtcttcttttgagaagtgtctgttcatatcctttgcccactttttgatggggttgttttttttcttgtaaatttgtttgagttctttgtagattctggatattagccctttgtcagatgggtagattgcaaaaattttctcccattctttaggttgcctgttcactctgatggtagtttcttttgccatgcatcagctctttagtttaattcgatcccatttgtctattttggcttttgttgccattgcttttggtgttttagtcatgaagtccttgcccatgcctatgtcctgaatagtattgcctaggttttcttctaaggtttttatggttttaggtcgaacatttaagtctttaatccatcttgaattaatttttgtataagatgtaaggaagggatccaatttcagctttctacatatggctagccagttttcccagcaccatttattaaatagggaatcctttccccatttcttgattttgtcaggtttgtcaaagatcagatggttgtagatgtgtggcattatttctgaggcctctgttctgttccattggtcaatatatctgttttggtaccagtaccaggctgttttggttattgtagccttgtagtatagtttgaagtcaggtagcatgaagcctccagctttgtcctttttgcttaggattgttttggcaatgcgggctcttttttggttccatatgaactttaaagtaattttttctaattctgtgaagaaagtcattggtagcttgatggggatggcagtgaatctacaaattactttgggcagtatcaccattttctatccatgagcatggaatattcttccatttgtttgtgtcctcttttatttcgttgagcagtggtttgtagttctccttgaagaggtccttcacatcccttgtaagttggattcctaggtattttattctctttgtagcaattgtgaatgggagttcactcatgatttggctctctgtttgtctgttattggtgtataagaatgcttgtgatttttgcacattgattttgtatcctgagactttgctgcagttgctgatcagcttaaagagattttgggctgcgacaatgggttttctaaatatacaatcatgtcatctgcaaacagggacaatttgacttccttatatcctaattgaataccctttatttctttctcttgcctgattgccctggccagaacttccaacagtatgttgaataggagtggtgagagagggcatccttgtcttgtgccggttttcaaagggaatgcttccagcttttgcccattcagtgtgatattggctgtgggtttgtcataagtagctcttattattttgagatacgttccatcaatacctagtttattgagagtttttagcatgaagggctgttgaattttgtcaaggccttttctgcatctattgagataatcaagtggtttttgtctttggttctgtttatatgatggattacatttattgatttgcgtatgttgagccagccttgcatcccagggatgaaactaacttgatcgtggtggataaggtttttgatgtgctgctggatttggtttgccagtattttattgaggatttttgcattgaagttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaatccatctggtcctggacttcttttggttggtaggctattaattatttccttaatttcagagcctgtctattcagacattcaacttcttcctggtttagtcttgggagagtgtatatgtccaggaatttatccatttcttctagattttctagtttatttgcgtaaatgtgtttatagtattctctgatggtagtttgtatttctgtgggatcggtgatgatatcccctttaacattttttattgcatctatttgattcttctctcttttcttctttattcatcttgctagcggtctatcaattttgttgatctttaaaaaaaaaaaaaccagctcctggattcattgatttttttgtagggttttttgtgtctctatctctttcagttctgctctgatcttagttatttcttgccttctgctagcttttgaatttgtttgctcttgcttctctagttcttttaattgtgatgttagggtgtcgattttagatctttcctgctttctcttgtgggcatttaatgctataaatttccctctacacactgctttaaatgtgtcagagattctggtacgttgtgtctttgttctcactggtttcaaagaacatctttatttctgccttcatttagttattaacccagtagtcattcaggagcaagttgttcagtttccatgtagttgtgcagttttgcgtgaatttcttaatcctgagttctaatttgatggcattgtggtctgagagacagtttgttgtgatttctgttcttttacatttgctgaggagtgctttacttccaattatgtggtcaattttagaataagcgtgatgtgatgctgagaagaatgtatattctgttgatttggggtggaaagttctgtagatgtctattaggtctgcttgttgcagagctgagttcaggtcctggatatccttgttaaccttatgtcttgttgaactgtctaatattgacagtggggtgttaaagtctcccattattattgtgtgggagtctaagtctctttgtaggtctctaaggacttgctatatgaatctgggtggtcatgtattgggggtgcatatatatttaggatagttagctcttcttgttgaattgatccctttaccattatgtaatggccttctttgtctcttttgatctttgttggtttaaagcctgttttatcagagactaggattgcaatccctgcttttttttgctttccatttgcttggtaggttttttttttttttttttttttgagacggagtcttgctctgtcacgcaggctggagtgcactggtgccatctcagctcactgcaagctccgcctcccgggttcacgccattctcctgcctcagcctcccgagtagctgggactacaggcgcctgccaccacgcctggctaattttctttgtatttttagtagagacggggtttcaccatgttagctaggatggcctcgatctcctgacctcgtgatctgcccacctcagcctcccaaagtgctgggattataggcgtgagccaccgcacctggcctgtttggtagatctttctccatccctttattttcagcctatgtgtgtctttgcacgtgagatgggtctcctgaatacagtacactgataggtcttgcctctttttccaatttgccagtctgtgtcttttaattggggcatttagcccatttacatttaaggttaatatttttgtgtgtgaatttgatcctgtcattaagatgttcgctggttattttgcctgttaattgatgcagtttcttcaaagcatcgatggtctttacaatttggcatgtttttgcagtggctggtaccagttgtttctttccatgtttagtgcttccttcaggaactcttgtaaggcaggcctggtggtgacaaaatctctcagcatttgcttgtctgtaaaggattttatttctccttcatttatgaagtttagtttggctggatatgaaattctgggttgaaaattctttaagaatgttgaatattggcccccactctcttctggcttgtagggtttctgccgagagatccactgttagtctgatgggcttccctttgtgggtaactcaacctttctctctggcttcccttaacactttttccttcatttcaaccttggggaatctgataattatgtgtcttggggttgctcttctcaaagagtatctttgtggtggtgtctgtatttcctgaatttgaatgttggcctgccttgctaggttggggaagttctcctggataacatcctgcagagtgttttccaactttgttctattctccccatcactttcaggtccaccaatcaaacatagatttggtcttttcacatagtcccatatttcttggaggcttagttcatttctttttagtcttttttctctaaccttgtcttctcgctgtatttcttttcttttttttttttttttttttttgagacagtctcactgtgtcgcccaggctagagtgcaatggcacgatcttggctcactgcaacctccgcctcccaggttcaagcaattctcctgcctcagcctcttgagtagctgggattacaggtgcctgccaccacgcccagctaatttttgtatttttagtagagacggggtttcaccatgttggtcaagctggtctcaaacccccgacctcgtgatccacctgcctcggcctcccaaagtgctgggattacaggtgtgagccaccgcgcctggcctcttgctgtatttcattaatttgatcttcaatcactgacaccctttcttccacttgatcgaatcagctattgaagcttgtgcatgcgtcacgaagttcttgtgccatggttttcagctccatcaggtcatttaaggtcttctctacactgtttattctagttagccatttgactaatcttttttcaaggtttttagcttccttgcgatgggttcgaaaattcttctttagctcggagaagtttgttattaccaaccttctgacgcctacttctgtcaactcttcaaagtcattctctgtccagctttgctctgttgctggtgaggagctgcgatcctttggaggagaagaggtgctctgatttttagaattttcagcttttctgctctggtttctccccatctttgtggttttatctacctttggtctttgatgttcatgacctacagatggggttttggtgtagatgaccttttggttgatgttgatgctattcctttctgtttgttagttttccttctaacagtcaggtccctcagctgcaggtctgttggagtttgctggagttccactacagaccctgtttgcctgggtatcaccagcggaggctgcagaacagcaaatattgctgcctgatccttcctctggaagcttcgtcccagagggcagccacctatatatgaggtgtctgtcggcccctactgggaggtgtctcccaattaggcttcatgggagtcagggatccacttgaggaggcagtctgtcctttctcagagctcaaacgctgtgctgggagaaccactgctctcctcagagctgtcagacagggacgtttaagtctgcagaagttgtctgctgccttttgttcagctatgccctgcccacagaggtggagttagaggcagtaggccttgtagagctgcggtgggctccgcccagtttgagcttcccagccgctctgtttacctactcaagcctcaccaaaggcagatgcccctcccccagccaggctgccgcctcgcagatcaatctcagactgctgcgctagcagtgagcaaggttctgtgggcgtgggacctgccaagcttggcacaggagagaatcaccttgtctgccagttgctaagaccttgggaaaagcacagtatttgggcggagagtgtcccgtttttccaggtagtctgtcacggctccccttggctaggaaagggaactccccgaccccttgtgcttcctgggtgaggcgacgccccaccctgcttcagctcgccctccatgggctgcacccactgtccaatgagtcccagtgagatgaaccaggtacctcagttggaaatgcagaaatcacccatcttcggcataggtcatgctgggagctacagaacggagctgttcctattcagccatcttggaacactgcccacttcttttttttttttttttttttttttttgagatggagtttcactcttgttgcccaggctggagtgcaatggtgcgagctcggctcaccacaacctccacctcccgggttcaagcaattctcctgcctcagcctcccgagtagctgggattacaggcatgcaccaccacgcccagctaattttgtatttttagtagagacagggtttctccacgttggtcaggctggtctcgaactcctgacctcagatgatctgcccaccttggcttcccaaagtgctgggattacaggcgtgagccaccatgcccggccttatccccatcttaatgatgatggaattgaagctcaaaaaatttaagtaactaacttgccccagatcatttgtctagtaaccagtggagctgagctatgaacccagaacccaggattgactaactccaaaaaatgtgctttcaaccatgaggacaatcctaagagtcacctgagctatttaattaaatgtggattctcactctcttgaccccagggattctgattttgcttctgtgggtttagggtacaggtgattcatgatcatatgttgagatgcattgagatatactacattgcttttagggtttcacatctgtatagggaggcatagggataaaattcattgaacgtttttttaactgtgtactgtgtgccagtccccttgatatgtataagcaagtgagatggagtccctaccctcaagacttggtctaatgggaccttggaaccctgccttgactctgtcagactacctcacttgagcaagccacttactctttaagccttagtttctctatctgtaaaatggagatagtcaattacttacttcagagcaaaaggcctgatctatgatcctgtgattcccaaggctcttttaagttgtgaagtcacagggtggactaacttccaatgctgagaacaatgatggggtggtgatgggtcagatagacaaataaatcaataattcaaccaccaataaatagtggaatatgtaaaagcatgcgctttggaatctggcagatccatgattcaaagctcgaatgtgcttgcctcttgctagttacgtaactgggcaaattacttcactgccctgtgtctgcaagtaaaatgaggacagtacttaccctataggactgctgcgagacattcaatgagagtaatgatgcacagcactcagtacagcagcttaaaaacaggtaacaccatgaagcactacagaagcagtgatcaataaatggtttagagacagtaaacatccaaagacgcagaagagttttacagttttacagcctactattttatagtttaaatttggttacattttttgttgtttttaatataacttacatggaaatctttttaaaatgtatatgatacgtatacagtggccttccctgccatcttatgtaatttaactcctctaggcatctaagcatcatctttgtcatcataaattattttactctgctggaaaagatcattgccttcaggacccactgaaatgtaccctaaatgtatccagattatatttaaaatatatttttctgcctctctgttaggtcatgtagttaatgcctaattatagttctttttcctctccttgtttaccctgtctaatctgtattgggcttagaaactagtggccaagcttgttaaaactgcgagtataatcagagtatgtcttggaaccctgtaagttagccacacgagcttttgtatgtggacttcatgaaatcttcttgcctacttggagacttattgacatttagatatttggcattgcctattagttaagttttaaattgactagatattactgtgtaaggtacagatacctgaaaaaaaattccattattctcagctttggaagttgatccaatctatgacttcacaacttaaaagagccttgggaatcatgggctcataggtctggccttttactctcaagtaaatagcaattgattattatctcttttttacagacaaagaaattgatccctaagtgtaagtagcttgttcaagtgaggtagtctggcaaagtcaaggcagagtttcaagtctcccaagcctgcccttccgctctgccacactgttcccaggaggaaacaatcatcttaggctgtagaaaggaaggaaaactatcaataaatatggttaaagattagaaaaatggcccagcacgatggctaatgcctataatcccaacactttgggaggattgcatgagcccaggagtttgaaaccagcctgggcaacatagtaaacacagtgacatccctacaaaaaaaaaattgctgagcatagtgatatgtgcttgtactctcagctactctggagactgaagcagaaggatcacttcagcccaggaattcgagggtgcaataagctatgatcacaccactgtactctagcctgacaacagagcaagaccctgtctcaaaaaaaaaaaaaaaaaaaaaaatatatatatatatatatatatatatattagaaaaatgagatctatggaggatattgtaactattcagttctatgcccttattttgatagatgtttttcctgtcactcctgccctcatttgaaggggtttataaccttagtatgccatcagtgagcctgaacatctctataagggaggaccaaggggcattataataagatccaaaaacatagaattataaaagatgatgatcttttcatcatggatgaaacaaggtgtagggaaggaactaaatggcattcaggtgacttagagggggaagaaagagccactgagaacgagggacatggaaacaggtttctgaaggaagatacatacttgaccatctctgtggatggtttcctgcctgccggcctgccatccttccttccacagctttgttaagatacaatttatataccataaatcaaaatggctttttaaaaaataaatcttcttaaataattcttttttattttttattttttttgaggcagagtcttgctctgtcacccaggctggagtgcagtggcatgatctcagctcactgcaacctccgcctcccaggttcaagcagttctgcctcagcctccctaatagctgggattacaggtgtgcaccactgtgcctggctaatttttgtatttttagtagaaacgtggtttgccatgtcggccaggctggtctcgaactcctgacctcaagtgatccaccggcctcggcctcccaaagtgctgggattacaggcatgagccactgcagccaaccaaaaaataaatcttattcttctgattgcaagaaagcacatatcatccacggtccccaaacactgagttaactactatttttaactctgttgatgtatcccattcttttccctatgcaaatttttattcttttttttgttgttattttaaagcaaacatggaaccatactctatatgacaatttttattttgctctttcctcttaatatcatgaggtcatgtactttgttttcatcttaaactcatttcatcagatgaattaaatctttattgtaaaagcttccaaagagaaattcctcatctggggttgaaaattcagatgccaacactggccaggcaggtcatataagaagcatacgtgttattcggtggtaaactggcaacagcatcctcttccccagctccagctgattgtggtcatgcaggaatgctggcccatcattaccaggtcttctgatttttttctaaaaaagagagctatctgaaatctagattgtgttgtgggaaatatcttaatgttttgcctcaaaatttaaaaagtacacttcaagccaaacaaaacctggctgccagctatattctctgtcccagacagtgagtgctaagagtttcacaagcattatctcatgtattcttcacagcagtcttgctcctctaatggttatttattaggaaccaacaatgaataaaaaatcaaaatccttgctctcttggagcttctgttggggagacagttactgctctggagaaaaaataaagcaggaaaacaagatgggggtagagggagagttcacagcattcccactctgctagcaagttatgtgctagatggtcagattatgactgggcaccgtggctcacgcccgtaatcccaacactttgagaggccgaggtgggtggatcacctgaggtcaggaattcaagaccagcctggccaatgtggtgaaatcccacctctactaaaaatacaaaaattagccagtgtggtggcttgaacccgggaggcggacgttgcagtgagccgagatcatgccattgcacttcagcctgggtgacaagagtgactctgtctcaaaaaacaaacaaacaaattatgcgctacccagtctttgtgctacttcctcaaccacagagaatgacaatgaaagaatcctagaatgttaaacccaaaagcaaccgtcacaattattgagattaaaaggtttgtacattttcaaatagttcttaatggtcttactttttttttttttttttttttttttttgagacagaggctcgttccgtcacccaggctggagtgcagtggtgcgatctcggctcactgcaacctccacctcccaggttcaagcaattcttctgcctcagcctcctgagtagctgggattacaggcacgtgccaccacgcctggctagtttttgtatatttagtagagacggggtttcaccatgttggtcaggctggtctcgaactcctgacctcgtgatctgcccacctcagactcccaaagtgctggggcataagccaccgcacccggccttaatggtcttacttttaaaaaatcctttgatgtcttctcattgctcatacttttgtttactttcttaattttaaaaataggttatacatgaaaatgacaaaattcaaaagggtatacaatcttatatactttaaaatatactttacttagtctatcctatatactttaaaatgtattttacttagtctaatcagccgtgatcatttatttatacgtgaggcatgacaggaagaaattgaggcacagagttggtatccaatggaaggccacccattgatggagaaaccaaaccccagtgagtaaaaccagactttgtctttcagaattcttgtgcataaatgaagttgggtagattcatcctgatgccactggatatttttcattttttttctttactttttgtatgcctgccagtctcagtgaaagataaggatcagggttcagaaagcctaactattgtgtcgtttcccaggatggagagcactatcatttggttcacatttttattaaaataagatgagtgattcactcacattacaggcaaaggatcctttaccaggaaaccatactttgaaaaacaaagctgatggctttaaggaacagtaactactaacatcaatttcctttcccatcaagtcccaaaagagtcagacactcttctttctctagctgcctcattctcttcccgatacatatccatataattatagatagggtacattacatatacccataaaagacaaaacagcaggaaagacaaaggtagattcatctgaagagatgtgtgtgtttatctatatccagtcttctttctggttcttgctgtttctgttccttacgtctgtttttttagttgataggtagccgtaaatccatcatcattggtggaagctagtggattctgacgagaaaacaggctgtggtcttcataagcacgcctacatgctggccaccaccctcccctgctcgcacacccatcaagaactggagaacttagattgttgcttttttatttttagtctgtcttggttccactcaccctcagtgagtaaccccgttagccactgcttctgtttatatttatttagaaaagaaggaaaatgcattttaagaaaatcaaatgcataatctgttccacttcttatttattctgtggctgctttggacagtggaaagctcagaggaagtataataacttttattcatttttgttttctgtggcttgctctcttaagttctcatcagacagctttgctaataacataaaatttcatcctaatgataagcctgattttaaattgcaaagaaaaaggtagtggggccaggagcagtggctcacgcctgtaatcccagcactttgggaggccaaggctggcagatcacttgaggtcaagagttcaagaccagcctggctaagatggcaaaaccccgtctctactaaaaatacaaaaattagccgggcacggtggcacgtgcctgtaatcccagctacatgggaggctgaggcatgagaattgcttgaacccaggaggcagaggttgtagtgagctaagattgtaccgctgtattccatcccgggtgacagagcaagactctgtctcaaaaaaaaaaaaaagtgggaagtattttttatatatataaatgaaatatacttttctcttcctaatctgtgtctagtcctgttaaaattgcagatacaggcttataatggctttaactgtttattacttttgttgtctcttctctattttcttataggcatcagtagcaagtcacttaaaatagaaagggcctgtcagtttgaggggaagcaagttacaagccagacagactacatctgaccctggagccaccctaggacaaaaagtgatagaaagagatggaatagctagtgggagatttaaatgttcacagtaatagtcactggccaggtgcggtagctcacacctataatcccaatacttcgggaggccaaggcagaaggatcatttgaggccaggatttccagagcaacctgggcaacatatcaagactctgtctctagaaaaaataaaaatgaaaaaattagccaggcatgatggtgcatgcctgtagtctaactacttcccgcctaggctaaggcaggaagagctcttgaacccaaggaattccaggctgcagcgagctatgatcataccactgcactccagcctgggtaacagagcgagaccctatctctaaaaaaattaaaataatggccagcacggtggcttatgcctgtaatcccagcactttgggagaccgaggcaggtggattacttgagctcaggagtttgagaccagcctgagcaatatggcgaaaccttgtctctacaaaatatacaaaaattagccaggcgtggtggtgtgtgactgtggtcacagctatttggggagctgaggtgggggggattgcttgagcccaggaggtggaggttgcagtgagccaacatgacgccaccgcactccagcctgggcaacagagcaagatcctatctcaaaaaaaaaaaagaataaaattaaataataaacaaaataataatagccagttgcagctaacatttactgggttctcactgtgggaattcactgtgccaggtgtttttcatccatagacgaaggaaaagcaggttgggttcccagagacttacagcaaaaagaaaaggacatcatagggagccagtctgtgtagcagagaaaggccagcctttgaatgagaaggcttgatctgatccaggaactaccacttatgcggcaattttgtcccttgcttgagcctcattttccatgtctataaaaatgggaattaataccattttcttttccctgccccacaaaattcttatggggatcaaaagtgataatgcatatgaaaatggtttgcataattctacactgtctgcaaatatgagccatcagcactattaaaagtgaggcaatagaggattggcagtgcactgacagtctgggaaagtggcgcacctgccttcaggcaggaactctgttattcattcatcaataaagaacaaaggcttgacaaaataatcatgagataagaaataagatcgtttcagccacccactggctggagctgaaggagaactgtgataaattgtgccttttgttatgcaggtgccatcccacctgtgtctgtgtgccttaaatgaaggaaagtaataaaagtaataacaagagcaggtactgttgattggatgcttatctatgccatgtaccagcaccttaatttaccatctcttcctttaaaaaaaaaaagattttttaatcctctcaaaaattcatgattagcattatcattattcataccattattactattattcactgtcattttcaattggctcgcctaatgtcacatggctagttagcagaagaaccaggatttggacccagatcggctgattcaggagccttgattattattattattttttttttgagatggagtctcgctgtgtcatgttgcccagactggagtgcagtggtgtgatcttggctcactgcaacctccacctcccaggttcaagcagttctcctgcttcagcctcctaagtagctgggattacaggcatgcgccaccaggcccagctactttttgtatttttagtatagacgaggtttcaccatgttggccaggctggtcttgaactcctgaccaagtgatctgcccgcctctggctcccaaagtgctgggattacaggtgtgagccaccatgcccagccttagcctgtactcttaaccattgcactatgtaagacccacttaggttttagggcctaactgccctttgtagagctctagagttttaaggtagcacctcaggccttctttcctcgacttctcgtctgggtgagagctgttgaagagaaagttggctaaaaaaggctttgtttttataaatattaaatattgagattccttacaagattttcatttgttatctctttgagacagggtctcactcagtcacccaggctggggcgcagtggtgcaatcatggctcattgcagccttaacatcctaggttcaagccatcctcccatctcagtctcttgagtagctgggactacaggcgtgtgccaccatgcacagctaattttttcatttttattttttgtggagatgaggtctcactatgttgcccaggctggtcttgaactcctgggttcaagcgattctcccgtcttggcctcccaaagtgccgggattacaagcatgagccattgcgccagacctagatttctattttttaaaatgtatatatattaaaacatttttttcaggccgggagcagtggctcacaacatccttattttacaggtgagaaaactgaggcctagaaaaattgtgcccagataggtataatcctttgccgaagtcagaccaagttcttttctctatcatgatgtgtctctgtagtaaacttttgcccccctaaaacaacataaaaaccttcattctggctttaaacaccccccagaaataaatttaaaattctgcctctttttcaaaggttgagtgaggtatatcaccattgggagggtgtgatgttttctcttgcctttagtcaccattaggagggattaaggtttattctccagtttagctcttgtgcctgtttaaccatttctgttcaattaagaacaggaatgggttgcaggagtttgtaacaacacctgcttcttggaggagaattataacttggccctgagttgtccgtttcaaagggcccaccctgtcctcctgtttccaaagaaaaactggaagtggtaacacctggtggagctgcatgagcacgtgagtggtggtgcaaattctaggctggagtcacttctttgatgggctgccggagcctttgagagcttatggtgccaagatcctgctctacattctagtgtccaaaactgccttccatttcctcaataatgggtaggaaactgtgtccatgccagagtagctagccccgttgctactagagaggctttcttttctcctagcactggtgcctccttccacaatgcatacggctgcccaccctcgccatatgcagcctgtgtttcatatcctcacactttctaagacaggacctcccccagaacaaagccttgccttggtcctccaatccctaatggccccatcgtgatgaacagacccccaagggttcgacacagtataggggattcttatcagaccaggcctgtggtttaagccaccagtggtggttcaggatggccatggttagcctaaaaacctgatcagattgccatggtatgtcctacatgaccctgggtagaatgttgagatcctggttagaaatgcctgcatttctttaaatctttacctgctgtatataaacagttcctggagagttgtttttgttcattttaaacgttgccataaaattgttactgtgtctgatttaatactttgcctagaacaaagatactgccaaatagaaatagactaaatacatttctagcttggtgtctggcttagtcataataaaatataaaactaaaggggcagccgggtgcggtggctcacgcctataatcccagcactttgggaggccgaggcgggcggaccacgaggtcaagagatggagaccatcctggccaacatggtgaaaccccatctctactaaaagtacaaaaattagccaggcatggtggcagacacctgtagtcccaggtactcgggaggctgaggtaggagactcgcttgaactcgggaggcagcgtttgcagtgagccgagatagcgccactgctcttcagcctggcgacagagcaagactctgtctcaaaaaaaaaaaaaccaaaaaaaaactaaaggggctttctgcccccattggaacacactgaagatgctctggggagtaatgagctggcaaagggtagtgttcataatggcccaaatactttaccccacaggtgtcattcgaggccattgcctcttattccttttgtaaggtcatttcccattcagtcaactaattatcatttccctccatttataatataaaacaacagtgctgccagaggagataaaattgaataacacagccttctcttcttctggggctttgcttgacaggaacatggccctagtagggtagcaatctttctgtgacatgtgataccaactgctacatggggagtgaagtcgtcagatgtcttgcctccttcttcccttcccccacactgtccctcactcccttccccctcctcacagagtagcactgagaagtatttactcagctgtggcctggtaacaaagccttggtgccccagggattggaaggggtggtgtggtcatgccccgaactatccatgtccttccgagcatctcttggcagagcagcctggctgaggatgagtgtcatttagagtgagccttcacaacccctgcataaaagaacataaaaacaattgcagctgaaaattggagagtccacacatgggctgtggtattctctggcctctgtggtagtactattgagatcatgcagccaacaaactagaggctgttcagtcctctgggactcccatggcttgtagcatttcattatctttagctcttgtccagcactagctcactcaaccaacatataggcactcacacaaatgaatttagactgagccccatttcatcccccataaatttagagctaaaagtctttgacttcaggctttagggaaggttttctctgaaggaatgaatatatggccccacttccttccatctggcactcctccatgggtattctttagtgacaccactgtgatcctggcaaaggtaccatttcccaggaagaggagaggtatccgatctacagctatattccaccacagttctgagcaaatgtggacacgcatggtggtctgcaaggaggatgtagaaatgactaagctgctcccacagagcttcagaagcaggacttgccacagcaagaaggcagaccagatgtcaaaaagacatccttttcctacaaatgagaatgagttagcccttgaatatattgggaatcaataatttctgactaattttcttagctaaagtaaattcatctaacactctctaggattagagtggatataaccaacagaagaatattttgagtcagggcagtgcttatcttgaaagcagtagtattcatgctagagttgtaacagcaataaagtgaatttctgtgaagtgaaccctaggcttcctttggttttcatggaaaaatcagtgacatggcctggcgcagtagctcatgcctgtaatcccagcactttgggaggctgaggcgggtggatcacctgaggtcaggagttcgagaccagcctggccaacatggtgaaacctcacctctactaaaaatacaaaaattagcctggcgtagtgatgcatgtctgtaatcccagctactcgggaggctgaggcaggagaatcgcttgaacccagtaagcagaggttgccatgagccgagattgtgccactgcactccagcctgggtgacagagtgagactctgttaaaaaaaaaaaaggaaaatcagtgatacattcttatgaaaagaaatattcaagctgattgaactgagcacttggtgcaaaggccaacaagcccatgaagtgtagtacactggtcatggtttatcatgtttactgacagttatagtacctagcacgtaggggattttccttttttcacactttacaactcctggtttctcctcatacccctgtaattttgcagaaatgcctcctgtgcctggagaccccctatctttgtgttcacacagtaaccagaactttttccctatgaatttttatttgggtcactgtgtgaggcatgtttttatttattcattccttcaacaggtgtttactgcaatgcaccaggcattgtgctgattgctttagctaagttcaaagattccttaatttcaggacttcaagttttaatcagttaataattataaaataatgctaccacttattgagcactttgctaacttttttcagaaaagtgtatatgttacctcttttgatcttttacaacaattccattaggtaggtactgtagttcttacacttttaagacaaggaaaccaaggttcagggaagttgtacagcttgtctaagtcatgctggtggcaagtagtggagccaggtttttgaagccaggtcatctgattgcaaagtcagagttctgcactaatacaactgccctgcccaactaccctgtgctgtttaaagtggcctgcctgaagggtacctgtatgtttaacttagatagaaaatctgtcagtcacctggtgtgaataatcctaacatcagaagtccttcacaaaccagctggatcccacctgctagggtggaacttgcaggaccttcagagcctgtgctaggcctaggtctgaatctcagccctcttcctagctgtttccttgagaaaatgattacacctcactgagccctagtttctttatttctaaaataataatagcaagtactaacagatggcccttacgatgggtcagacactgttctaagcactttacattaactcataacaactctgcaatgttcatactgtcatttcatagatggggaaactgaggcatggagagcttaaaagtcaagtaacttgaagtcagtggcaaagctaggatttggacccgaacaatctaactccaaagtccatgctattaaccacaatgctatgctgtgctgcctctggagaagataggatcaagggtgtaaaacacctctggtctggagccagccacataattggtgagactagtgcaaggcttagaagaagaaagtttagcagtctgaccacccacaaaaggagacacacaaatttgtggagagtgttctgattttgatcttacaccaaagccttattatgtctttgcctttgaacttgcaggacctactggctgacactcttctaattgtggggggatctagagaaggtgtctactgatacacaatacttacctcccctgcacctgccaggtagaagagtggctggcaggtgggtggggatgagagaccacggtgtggccaccagcacagtggtcccccagcccatgccctctggcctgaggctgctgtgctggagcctcagtcttccctgttgacagtaattagaacttttcagactcggtttcttacatggaaaatctcaattcacttgaattgtctccttgatccagttcaactggagctatttagttcctgcagttagtttggaggggaaaacaagctcttaagcctcacacattatagctgataagatcaaggtgctgacagtgttagctgggtaggctttggagccagactgcctgggtttgaattccagttctacctcttaagtgtgcacaatctgagtttttgtgtctgtgaaatgaggataatagtcgtgaagattagtgaggtgacatatgtaaaccccttagaacagtgcctccccaagaccaagtgctcaataaatgttagctgtgttattgttaagcccctcctgccatcagcctcccttctctccctcccaccctgagatcttgctcagggaagacaggtccccttcctctcccctaccctggaccctcctctctttccttgctcaccagcttatttcatccctctaaactttctcatcctcatctgtgaaatgggactggaaataatggagtctacttcataaggtagtatgctgtgaaggctaagtgagttaatttttttttattttttatttttttgaggggggaaggagtctcactctgtcacccaggctggagtgcagtggcatgacctcagctcactgcaacctctgccttctaggttcaagagattctcctgccccccaagtagctggattacaggcacctgccaccatgcttggataatttttgtatttttagtaaagatgggtttttgccacgttggccaggctggtctcgaactcctgacctcaggtgaactcttgccttggcctcgcaaagtgctgggattacaggcgtgagccactgcgcctggcctaagtgagttaattcaagagctgagcacagatctccatggctactcactctctttacagttattgctggagcacaaagggctgtgagaagggcctttgagatcttggacagttctaagagccaaagggcccaaaatagacaggagcattagggtgaactggtgcccaaatgcaggctgcagaagctagggggactgctaccttgttcatcataatggggagcctggaacagagcaggcacatgggaataggaagtgagtggccactgcaggagagtgttcaaaacggatttggctcaggcaacccaacagagaactttcaaggcagaaaacttttaggtgtttaagtgtccaaactcagcaacagccaggctcatgcctgtaatcccaacactttgggaagctgaggcgggaagttcaagactagcctgggtgacggcacgagaccccgtctctacaaaaattttttaaatgcgcagggtgtggtggcatatgcttgtagtcccagctacttgggaggctgagatgggaggatcacttgagctcaggagttcgagactgcagtgagctatgccactgcactccagcctgggtaacagagtgaggcccccatctcaaaactaattaattaattaattaattaaaatttaaaataaaaaaaactcagcaacaaataccttcctcctctcttcttctcacctccagaatttgaaaacagaaccaaaacaaactcccattgtttgatgttactaagttctagacattctgctaagcactttatagacatcatctctcttacacttgactttaaccctgagaagtgtcagtgtcacttgcattttacagatgagaaactgagacttagagagattaagcaatttgcccaagattacatacctggtgaatcgcagagccaaaatttgaatcctagcctatggagcagaaagggaacaagctcccatatgcctatcagtgttctgattttgaaataagtcttaccacttatagttctctcaatacccactgtacaacagctgaggagtgtctcgaagtagcagaaatcatctgcccttgacattatctggtcactacttcagtagaattagaactcctctctccacatcccaacacagagtctgcatggaagaataataataacaactaatagaactactctctccacaattaaaagttgtttatttgcttgcattttcattaatctctttatctgactactgtcctcacttaacatttagaagagtcaagttccagaagtggtgagcaggatgtattctgtttttcatatttttaagagcttttgttgtgttagagaagcacgcagtgatttttgtaaatcattcttctgtccttggaagcaagtacttgaagtacatgagttagaataatatcaaaaacctgaagagggcctagggtctagaaaccaggaagctaatgttgactcctagcattgtctttcttaattaagtaactctctctctctctctctctcattttttcattttccttcattctgttatcttcccaaggatattttgtaggtaatttgggggataaatgtaagttcctatgaaacactctgactctccctaagaatgctatcagatatatccaccaaagtttagcctagaaaagcacgatgattcaaagatagaactttcctttatttactccctgccctgccagaaatcactcttctcttttctctacatggggagttctggagtgagaataaagtgggaacacattagactcagtggattttctcccttcccttcgcctttttcctcaccccaagcctgagaccacgagtggcaatgactccctcccttgaagaacaagacctcctgccaggctgtgcccgaggtcaggcaagtgggaagaggagagtgccacaaaaccatcttgatcctttgacctatattgacgctgagtctgttcctttggtgtttctgactttggcagtgtggttagtcaaactctctgtccccaccttgaattaagctttgatgaaaaagtactaggaacccaggcctttccctggagatttggggtttttgtcttggaaaagcatcaaccaaactaacgggggcaggagatctggattcctgtggcttgggctaacttaggtccaaagaaaccaagtgcctgtgatcatcatcttcattccccaaatgtagccatgccctctggattccctcctctcactcatcctcctcccaattaggcaggcttccgggtggattgctctcactttagcattaccaggcccttccatattcgaaatgctttgatatatgataatacttacacattcttactccttggctgatctaaaatcttttgccttcagtacatgcagcaacaaaataacttaagcatcagtgtatttcttctccctcaggatcctataaatttctctgagattcacctctctgggttctctgctggaccacagagcctcatcctggctcacctctcccaaagcacaaagcattgcttctgtatatcaggaatcatttggttgccttgactgtatatcttggacctttgtcttggcttcctataataggatgaccagatttgtgttcagccattcaaaagaagccagcctgctgcagtactggatgacagagtaatgaggtctgtgggtttctatgctgtactcttctccctacacagcaagactgtttgcgttagtactgcttccagatattctgtggatggtctttgggcatgtggtgggaaacgttaccatgccagagaatttcagcaaatttaaccggctttgaaatgacttgttcttccagatttttatatacaaggaaaaccaaactaaagaagactgatgaaggtgcctctcttgtttgctctcttcacccgaccaattttcataccagtgaagctcctttggtcaaaatggtgtaactggatgcctcccaccctggaaaagctttgtagaaatactgatcttaaaatctcacacctggaggttagagactagcatacccttcacactgacttgcttttaaaagaacagctctaccaagaccaggtctgaaactcatgaaatgaacaaaaagagggcagtgacttgaaatgcagagacctaatgtgttcctctccatttccacttcagatttgctgaccatgaaagaatatcactgtttgctgcaattactgtgtcctgatttcccgctggagctcactcagaaagcagccaggtacgtctcctggactcttgaaaccaactcagctctctgtgggccactgcttcctagagaaacctggagtgtatacaaatgaaaaaaaggagcatttagggaagaaactggcagtgggagaggggtctatttgggatgtgccccaaaacataatacattctgcatttccaaagggaagcgaaatgatcctttgtggtttctgtggggagcctcagggtctgaagatagagttggagggtggtgagatgaagaggcagaaaaagcccagacccctccaatacccccacacacacacaccctagaggatattctgagaaaagaggggctgcatttgtgtgttttcacgctactgtaaagatactacccaagactgggtaatttatgaagaaaagaggattaattgactcacagttccgcgtggcctcaggaaacttacaatcgtggtggaaggcaaaggggaagcaaggacctttttcacatggtggtaggagagagaagtacagacaggggaaatgtcagacgcttataaaaccatcaaatgtcttcagaactcactcactatcacaagaacagcatgggggaaactgcccatgtgatccaatcaccttccaccaggtctccctctcaacacctggggattacaattcgggttgagatttaggtgggaacacaaagcctaaccatatcagggggcaagggttggcagtgacttgtgatgaagagagttgaggttggggactggaagggcataaaggtgataaagccccagttgaaggaaaggcacattatattatttatgccagaagaaggttttcaagatcagtccagaaccaggacttggcagaaatagttagaagcccctaatttctgtgttgggtttcaccatcattcacaatttttaaccacatgaggtaattggactatgcctcagttaacttttacttacttaactcaaaacctgagctaggccagacacggtggctcacgcctgtaatcccagcagtttgggaggccaaggcaggcagatcccctgaagccaggtattcaagaccagcctggcctacatggcgaaactccatctctactaaaaatacaaaaaattaaccaggcacggttgcgcttgcctgtagtcccagctattcgggaggtggaggcaagagaattcgcttgaacctgggaggcggaggttgcagtgagcagagatcgtgccattgcactccagcctgggcgacagagcaagactccgtctcaaaaaaaaaaaaaaaaaaaaaaaaaaaaaaaaacctgagctagggttgcaaatggacgtacagcaaaaatcatgtttatcgaagaatgcctaccttccctatatcatactgaatgcatttaccttcattgttctatttaaatttgtttaccttaactatctcacctaatccttgtaaaaactgttacttccctttaaaatgatcctttgtggtttctgtggggagcctccggctctgaagacagagttggagggtggtgagagtattaggcaaacaacaaaacacacacacaaatacatacccacactcccacacacacccctagaggatattctgagaaaagaggaggcaagggttggcagtgacttgtgatgaagagggttgcggttggagaccagaagggcctgaaagcagctgggcgtggtagctcatgcctgtaatcccagcactttgggaggccgaggtggatggatcacctgaggtcaggagttcgagaccaacctgaccaacatggtgaaaccctgtctctgctaaaaatacaacaattagcctggcgtggtggcaggcacctgtaatcccagctacttgggaggctgaggcaggagaatcacttgaacctgggaggcagaggttgcagtgagccgattgtgccactgcactccagcatgggggacagagtgagactgaacgtcaaaaaaaaaaaaaaagggagcatgaaagtgatgaaccccagttgagggaagggtactgttactgctcacttcactgaagtgggaactgaggctcagacgggtgacaatgttgtgcgaatatactgatagcttgtaagtagcagtggcagaactggaaccgcagtcagcctgaatccagagatgggggatcgggagcacaaggagtctcttcatgctcccacctccctgtgtcatggcatcatttctgctttgtggtttgacccactgaaaacaaagctgcattggctgcactgcaccaagaatcacctcgctccttttgaaatgtgccaaccagctcctctattgacttggaagatgggaactccattgctcccagtgacagacaccagcctcacggtggggcacggtgttttgcagctaacagctcatgacctacttttgctggtcatgtgcaaaacctgtttagtgatcacacatgcaaaattttgtaggtttttttctccctcattattcagtggataattttctttcctgatggcaactggccactggtaaaagccgcagttcaggttttataattttaatttatctgctatccaaaggagatttggatattttttttcttcactgaaaaaaaaaaagtatgggagattatctcttgtaatttaaaagcagccaaatggagttagctttaaatttccatgatcgttcccctttgggcagaaatcattttattaaaaacatttttgtttgtttgtttgttttctttgagacagaatctcactctgtagcccaggctggagggcagtggtgcaatcttggctgactgcagccttcaccccgcctctccctgggttcaagtgattctcctgcctcagcctcctgagtagctgggattataggtgtgcacaccatgcccggctaattttttttttttttgtatttttggtagagacggggtttcaccatgttgcccaggctggtctcaaattcctgacctcaaaagatctgcccacctaggccttctaaagtgcctgggattacaggcatgagccaccacagccagcctgggcccagattgttttaaggaatattcagccccaaaatctggggagataaactcagcatccttaaagaccgaacttaaggccgggcacggtggctcacgcctgtaatcccagcactttgggaggccaaggcaggcggatcacgaggtcaggagatggagaccatcctggctatcatggtgaaaccccatctctactaaaaatacaaaaaaattagccgggcgtgttggcgggtgcctgtagtaccagctactcaggaggctgaggcaggagaatggtgtgaacctgcaacaactatatcctatattcatttgttcatttgtttattcatcaaatgtttctttttaacagctttttgggatacaattcacataccatacacttcactcatttaaagtataaaattcaattgcttttaatatatttccagagttgtgcatccattaccacagtccattgtagaatgttttcattaccctaaaaagaaatcctacaccccttagccattactcttcagtccccactccaccgtcttccccaaccctaggcaacccctaatctactttctggctctgtagatttatccactgggcatttcaaataagtagaattgaggccaggcacagtggctcatgcctgtaatcccaacacttggggaggctaagtggggaggattgctcaacatggtgaaaccccatctctaacaaaaatacaaaaacttagccaggcgtggtggtgtgcgtctgtggtcccaattacttgggaggctgaggtgggagaattgcttgagcctggggggcagaggttgtagtaagctgagattgtgccactgcactccagcctgggcaactgagtgagactctgtctttaaaaaaaaaaaaaatcaaataagtagaattgtatatgtggtcttggccaggcatagtggctcacgcctgtaatcccagcactttggaaggctgaagcaggaggatcatttgaggtcaggagttcaaacccagcctggccaacatggtgaaacctgtctctactaaaaatacaaaacttagctgggcatggtggtgcacatctataatcccagctactcaggaggctaaggcaggagaatcacttgaacccgggaggtggaggttgcagtgagccgagatcatgctgctgcactccagcctgggcaacagagctagactctgtctcaaaaaaaaaaaaaaaaaaaaaaaaaaccacgaccaggtgcagtggcttacgcctgtaatcccagcagtttgggaggccaaggtgggtggatcacgaggtcaagagatcgagaccatcctggtcaacatggtgaaaccccatctctactaaaaatacaaaaattagctgggcgtggtgatgcacgccagtagtcccagctacttgggagcctgaggcaggaaaatcgcttgaacccaggaggcagaggttgcagtgagccgagatcgcgccactgcactccaggctggtgacagagtgagactccatctcaaaaaaaaaaaaaaaagtgttttttttgtgactagtttcatgttttaggttggtgtaaaagtaattgtggttttgccattattttcaatggcaaagactgcaattacttttgcaccaacctaatagcacaatgttttcatggttcatccatcttgctgtatgtatcagtacttcatttcgccaaatgtttcttgagtgcatattttgtgccgggagctattctgcaaatggggatacagtcatgaataagatatagttcctgcccctcaaagaacttgatatagaaggggactgcttaggtactggtcattggctgccaccactctgtgacgtatgaccttggttttgatcaatcactccagaatactgacctcttttccctttcccatgatgtgagggagcttatgagagtgaggcttcaaaatgcatcttagccccccgcagccacagctttgcatttgccccagctgtctcctcagacccttccaaacaatctgatacatgaaagcaccacaagatttgagtgtaggtggtagaatcctgtaagaaccaaaaattctcgataccaaggtagaattgtacagttattgataccaaggggcttctggaatggtattcctctatttgcggctggaaacttacccactcctcacctagaggcctgctgtttgacagacacctcagacctttctgtctgagcaggaggaagcatcgtagccagtccatatcaatagcagtctgagggaattatgggaatggcagtaacaacagaagggccaagggtaacccacatggcactggctgcagttagagatgaattcagaattaggataagtttgttttctccccgagtatgagcatcaagcttctgtgtcaacttctcctcccaatgccatgctttccccactgtactgcagctggtgcatatgtagaaaaattgtatgtatcccagaaagcatcccctgattttgtaaactattctcattttgtcctgaagatcagggtcccagcttccccacacacatacctatgcatctgatcagaactgcaaatggaggtggtagagacttcaaggcagttactattgctagaagaggaactgccctctcccatttcactgccaggcttactttattcaggacactgaagtctggggacaggctgcagaagcaggctccagtctgtgatgatgtgtgcgtaaaagaatgtaatccacatgcagctggaagccggagcctgttcaggggcatggtgtctccacatgcgcctgccttatgtgctacaagcatcatggccaggccctggggcagcaggtgtgagctggaaaaacaggaaaagaaaaagcaaacagactccatgacagcagccaagccagagatcccctccacctcacatattcctgcagcaactggagtagttcttttatccccagatgatcaccacagcatctcccactccccatcctccatggactggaagctttctggatggttaagagcatgcagttggaaccagacttcttgagttcaaatcctggttccacaatatactagctgtgcccttgagaaaggtatttaatttgagcctgtttcctcacttgtaaaatgggaataataatagttgtaatgattgaaggagaagtatatgatgtgcttaaaatggtggctggcacagagtaaacttgtcataatcgttagaaatggtaatattaaccttgacctagaagaacacaggccccatggcattagaaagatctactgtacatcccacctgtgccccattaactggatgaccttgaggatatctcttaacttctctgagccctgtttttatatctgtaaaatggggatgataataataatagtaactaactcatagggtgtttgtaagatttcagtaacaccaacaaaaccatgaacactgcttaccacattgtagacattaaatcagtaataattttttttttagatgaagtcttgctctgttgcccaggctggagtgcagtggcgtgatcttagctcgctgcaacctccgcctcctgggttcaagtgattcttgtgcctcagcctcccaagtagctaggattatagatgcccgccaccacgccttgctaattttttgtatttgtagtagagacggggtttcaccatgttggccaggctggtctcgaactcctgacctcaagcgatctgcctacctcagcctcccaaaatactgggattacaggcatgagccaccacgcctggccagtagtaatttcttgctgttacaattatgttggtattattaatagtaccagattaaaagaaaaatgagatgttcctgggtttccaaaggcaatgcttcctggcctttttgcacttcacagcaatcagaaaataatatataacaaaaatctccagtaaagacaagacttcttgtgattggcctgcaggctctggcctcctcccagctgggccaaggggaccatcacatctgtaagtcatttgaggccgaagtgacaaagggttgggaagctctgctccaagggtgaagatttaaagcactggttctcaaacttgagcatgcatcagagtcacctgcagggcttgttaaaccacacatggccggaccacatccccagagttcagtaggtttagggcggggctcaataatttatatttctaaaaaattcccaggtgatactgatggtctgggaaacacacgttgagaaccactgatttaaagtattgcctgccattttttttttttttttttttttttttgagatagagtcttgctctgtcaccaggctggagtgcagtggcatgatctgagctcactgcaacctccgcctcccaggttcaagcgattctctcgcctcagcctcccaagtagctaggactacaggcacgcaccaccatgcctggctaatttttgtattcttagtagagactgggtttcacactgttggccaggatggtcccaatctcttgaccttatgatctgcctgcctcggcctcccaaaatgctggcattacaggcgtgggccaccgcacccggctgtattgcctgcattcttattctggctgggcatggtggcacacgcctgtaatcccagcactttgggaggcaaaggcaggtggatcacttgaggtcaggagttcgagaccagcctggccaacatggtgaaaccccgtctctactaaaaagaaaccccatctctactaaatacaaaaattagtcgggtggggtggcacgcacctatggaatcccagctactcaggaggctgaggcaggagaactgcttgaacccgggaggcagaggttgcagtgagctgagatcgcaccattgcactccagcctgggtgacatagcaagactctgtccctcccaaaaaaaattatttaaaaaatgttattattttttgaaatgaggtcttgttctgtcacacaggctggagtgcagtggtgcattcatagctcactacagcctcaaactcctgtgctcaagtgattttcccacctcagcctcctgagtagctaggaccataggcacgttctacaaagcccagctaattttttattttgtagagatgggggcagtgatcttgctgtgttgctcaggctggtctcgaactcctggcctcaggcattcctcctgcctcagctttccgtaaattattttattttattttattttattttattttaagatggggtcttgctgtgttgctggggctagactcaagctcccaggctcaggcagttttcctgcctcagcctcccaagtagctgggactacaggtgcacaccaccacacccagctaagaactttttaataaagaattcctacaaattggctgggcacagtggctcacgcctgtaatcccagcactttgggaggccgaggcgggtggatcacctgaagtcaggagttcaagaccagcctggtcaacatagtgaaacctcctctctactaaaaatacaaaaaaattagccgggcatggtggcgggcgcctgtaattccagctacttgggaggttgaggcaggagaatcacttgaacccgggaggtggagattgcagtgagccgaaaccgtgccactgcactccagcctgggcaacaagaatgaaactctgtctcaaaaaaaaaaaaaaaaaaaagaattcctacaaatcaataagaaaaagattaaggatctcagtagaaaaatagtccaaagatataaacaggcaatgcacagaagaacattagtaataaacctttgggcatattttcatgcccacactcactagtaatcaggaaactcccaactaaattgagataccacttcatacctatcaaattggcaaaaattttaaagtctcataatacaaatattggtgaggatgtgaaatagtgggaactctcataaactgtgtgtgggagtgtaaattgttacaattactttcagacaatttaggcaaatttttaaagttcaagagctactcctgggaataaggaaacatgcagtattgtttgtaatggccgccattggaacaatctgcacgtccctctgctgaaggaaagaataaagtgtggcatattcataccatagttgtggaattctttccagcagctaaaatgaatagctatatatgcatcaatcctgatgaatctcaaaatatcaaagttacagaatgacacagagtttgagaaaaagcaaaacaaagctatataatgttttaagaacacagacatttgcatgagttaattatagtataaagacatgcagaggaatgctagactcccaagttttagtaaatcatggtgatccccccaggaagaaaggtagaggataggatgagggaggggtgcacaggtggctgaaatggtatctgtaatgctgcattttacaaagcttttaaaaactgaagcaaagatagtaagacgttatggtctgataaaattggctagtggggacacaagtgtttgttatgttattctctgtagttttctgaggttctaaacatttcctttaaataaaaaatgatggggggattaggtagagagcaatgagagcaaaaagcatttcagggaaagtaagcagcatggaaaagaagctaggctctcaccaatgatggcctggaggaaccaagagaagccagtaggtctggaatttgaggcatttgagggcagagggagggaaagtggggctttacaggccatacattgggtttgggtctttattctaaggtctgtggaccagttcacccctagctctcaggcttcttgggaagttccagagtaatgacaccttcaggctgtctacagggaagcagcagcacccaggccaaatcttccagtccttctgcgggcagctgctctaacaaacactcaggctgggagaagggaaaggggcagcaggaaggcttcattaccacgagacagcacagagtccactctttcttaccagaagtggctgcaggtggtctcggaactgtgactagcgtcagagaggcctgtatttgaattatagcttttttgctcctagtttgtaacctgagtcaggtttcttaattcctctgaatgtctgcgttctccataaagatactcactgaactgacctcataggattaatacgagcagaaaatgaacttatgggtgtgtagtgctgacagagtaagcccttggtgaatattcactattattatcatcatcatcatattgtttcccacaccctctggatcaagcgtcttaggcatttcagggcaagtagggtttgggataccctggaggtgcgggctggagctagggcagagcaatgacctggacaccccacgccacttcaaggccctaggctagaggcagcttgtgcagcacgagtgtgcctccaacacagtccagaagaggagcaaccctcaggaaatggcccaggacaccttcatagcggcctttttcctcccacctggagaaggtaaccagacatcgtgtcatcgctgcttctctcatggccctgacattcaaacaaaaaccctagaggtgcactgtgagcccaaacagacatggggacacccttcagccaccccatgactgccaccttgacctggggacacccttcagccaccccatgactgacaccttgacctgaggacaccctccagccaccccatgactgacaccttgacttgcggacacccttcagccaccccatgactgacaccttgatttggggacaccctccagccaccacatgactgacactagtcatgtgacctcctcaaagaagtccagtcatggaaagtggctcttctttctggccgtggctgagggctggcttcccccaaaagtaaactggaaactagatcgctggcttctgcctgagacctctgcctggtggatgctggcagcacgcatttcctctgggctctatttttatttgctcttttgggctctcccagcactttaaaccagatagaatatacttactgattacagccggcgctcattctgagcacctgttagacactagcatatataacatcatcatgctgactctccacaagaatcctgggaaacaggaactatgattatatcctcttcacagatgaggaaactgaggctcagagggaaattgtcacttggccagtgagtagtggaactaggacttaatcctggggtcaactaatccagaacttcaggaaaaccggtgcagcccgtgccactagaccagggaaactgaccctaattaggggtgaataggaagttggcaagtcagtaggttcaggctggaagctgttgcttccttggcacccttagaactcccagccagactgcctatcccagctgctggaagtcagcaggggagggagaaagtggccagtctctcagaccagccacgtgctctttctccactccagttgcctgtcctaggctccaccccacacatggttctgctcagcacagcctgaaccaaagtgcctctacttctccccaagagtccctctctctagcccggaggcatggtccgcaagggtccctccatgatccaatagatttgtgcagactctcactggcagcagctccctgttggctccacttcaaagcaggggcggccgggcacctccaggtgtcagaagcagctggcacgttagcagaaggcctctggcaggaaggggtgttgagccaactgccagcaactggaaaacagcacatggggatgacctcgtctccaagaagattctttcccgagccctctgggagtggcaatgagcttgagttcagaaggaaggagctgtctgtggggatagaagggttgcaggcaaaggcaaagaggcaaagacagaccaggagcttcctgcttgccttttcccatagttctgctgagattccaaagcaagatgcagatgcccacagccagaaagatcccataggtgggttaaagacacagatgcctagaactttcatggtctcagcattcatttggagacagacagcacagcatatgatgtgattaaaagcacctttcagtaagtcttctgcagccatagacctctgaacatcaaactgtccccccactagatttaacactaacaggaggagctgttagttctgtccacccttgggacaacactgtcagagctggaagaagccctttgggaagtatgagccttcaaacttctgcttgaacatttctggcaatacacatctcattcctttacaaatcagccacaatcctagaactaagcagcttgaaaatgtctctagagccaaactctagatccccgtggcatctccccaagaggcagtcctttgagagttgggtctcagccttcacttcctccctagtcttcacttctaagcaaaagatctaaatgcagccatttatccagtatcctggtttttagactgtccatcagcctgaccctcttctccaggactctagtttactccccttaaacggactgtccagacctgaaggtagtagtatttgaatgacagctcttttgctcctagcttgtaaccttcgccaagtttcttaatccctctgaatgtctgcattctccataaagattgtaagtatctttatgagagggattaagaaactgctccaggtgccacctggccagaggaaaaggggaccgtggcttctctcactcatttgttcatgcatttcttcattcaacagacgttgactgagtgcctactatgtgccagacaccataccagagtcaagccacaagcagggagacagaggtgtcacttggtagatcttatgttcccaggacaaagacaacagtgtgaggaggtttccgagaactgcagaagccagtagcaggggggcctattctaggctgggttagaaaaggtgctttcctctttcatcttccccaagagatgctgtggaggcttcagcctgaagaatatggagatatccggtaggtgaggaggaggcatggagggcagggagcatcatgggtagaagggacagggagcattatggctagagggacagacttgtctggagggcatgagtaaggacagcttcagggaggatggaaggactagtgtggccagaatgcagtgggggagtcgagggaggcagggggcagatggagcgggctcacaggccagatccaaatgggggaacgtgtcctaagggcaatgggaagactgtgaaggtttttttttttttttttttttgacatggagtcttgctctgtcatccaggctggagtgcagtggcacaagcttggctcactgacatggccacctcccaggttcaagcgattctccagcctcagcctcttgagtagctgggattacaggcatgagccactgtgcccggcctctgtgaagggtttccaacacaatggtaaaatggtcacattcacattttaggaaaatctttctgcccacaggatggatactcaattagaagaaggctcacgcctgtaatcccaacactttgggaggcctaggtgggcagctcatgaggtcaagagatcaagaccatcctggccaacatggtgaaaccccgtctctactaaaatacaaaaattagctggacatgctggcgcacgcctgtagtcccagtactactcgggaggctgaggcaggagaatcgcttgaacctagggggcggaggttgcagtgagccactgcacttcagcctggtgacagagtgagactccatctcaaaaaaaaaaaagcaagaggagtagttgcagggaaactgggtaggaggtcatgccatcatcaagaaaagagaggtgaaggctgggggtaggatggtggctgtggacgtggaaagaagtagatggattcaagagaaatttcagcaatagcattgataggacttggtgactggttgattggcttggagcagagggtggcggggggaagtttccaggatgtctagtatgcccagcgtttctggttgaggagagtcatagccggtgttgctgttaacacaagctcggatccatttggctttttaaaaggtagccagtcttacttcttgcagttgaaaaaaaaccctcagtcctttatacatgtgctgctgggatccagccacatgtcccccagaaagaaagccctcgcctctgtctgcacccgcttcactcgccccctactccctcctgctcggcatatgtttcagctccccagtctctgagactcagactcttcacctgtagaatggaaataacaataagacccacccgtaggactgttgtagaataaaatttaattaatgtagtcaaatgccttaatagcctgccatgaggtagggtactcaggaaagatacctgcctctataggcggatcacttgaggtcaagagttcgagaccagcctggccaacatggtgaaaccctgtctctactaaaaatacaaaaattagccgggcatggtgacaggcacctgtaatcccagctgctagggaggctgaggcaggagaatcacctgaacctaggaggcggaggttgcagtgagccgatctgcaccactgcactccagcctgggcaacagagcaagactcaaaaaaaaaaaaaatgcctctattgttacccgtattaagggcacctgcagggctgccctgctctgacggacactcctaccctcccacggtgtgcgccccctcttctgcaacggcccatctccaaagggactgctgatgtttgaggtcaagatggcccctagcagaaagctgcagaccacttctgaggctggaagggtgtgccctgtttatagcttctagtcccatctgtggctgaaagaggaagatgctagtggcactcagcattaaggcttccgcgaggctgcgaggcaggggtagccctttgggaagtacgagctcaagcttctgctccgaggcaggctctggaatgggcctattggtgagaattgcaaatggaggtaacttctgtaattagacagtggtgatggtggcgctactttgtgaatatactaaaaaactgaattgtacgcttttaaagggtgacttttatggtgtgtcattatatcacaatgtaaataaatagcaagtggaagttgctgctatgggagtgctgtgttccaactgatgatcaacagaagccatggaacacggggaaagccttgggctccctggtggtttcctgcttggggatattcacagcccagtgctgttctgtcgtaattcactttagactattggggctccagctgtcctgagaacagggcagtaaaggaaagtcagtggcttctcatgtccagagcctttgcctgccctgctgagcctgccaaggaaaagctttgaggtgctggtggcccttgctccctgagcgctcccgggggagctcactcttcctctgcagtttggaggtctttgctaaccccagtcctctctagctgcccgctctctgctgtctccctgctccctcaatccagatgtcaaaacagattctgccatctgggtggggagggagctgttctgctgcctgggttttccttgggttatgagatggggtaaccacttggcctttggcactgcacttagtcctgtgaactactgacagagggaccagggcaccctcttgtggccctcagcggcactgcttcttcccgccctccagccttgaatttcttccagctggaattctagtgttgaactctggtggtggaggcagctgtcgttctccccaggagatgcctaacatatcagtaacaagaaagaaaataaatcagccacagaaactaggaggtaaaatgttagtgtttttgctctgcagctttattttcaaagaggcagtgtgctctcatggaagatgtgtggcctgtggagtccagcaagctccccagctgtgtgtgtgactttggcaggctgacctctgagcctcagactcttcacgtgtagaatggaaataataagacccacctgtaggattgttgtgggataaaatttaacgaatgcagttaaatacctcaatagcctgccacgcagtagggcactcaggaaatggcacctgcttctattgttatctgtattacaataaagactaggcaggaaccactgtctctcttcaggaagatcgcagcaaagggagtggcaccacaatatcgtagtctctgtgaagccctttccccagcagtgagcaatcctggctttctctggggctgatccagttgccagtctgggaaacctctgactcagggaagtggagagagatttagaaaaatatgagagagcaaaagaaaactttttttgttttttttttgacagggtctctctctgtctcacgggctggagtgcagtggtgtgatctccgctcactgcaacctccgcctcccaggttcaagcgcttctcctgcttcagcctcctgagtagctgggactacaggtgcccaccatgcccagctaatttttctatttttagtagaagtggggtttcaccatgttggccaggctggtctcgaactcctgacctcaaatgattcacccatctcggcctcccaaagtgctgggattacaggcatgagccaccgcgcctggccaaaaacaactgaaaaaagaaaaaaagaaagataaagccagaaggacctgatcagaaacagattgggggcccgccccaccccatctgatagcttggcgcctgcctggcatgtgatggagcccagcaaacgctcgtttccttctcttcttgtcctggctcagatgaggtgctgagcagaggatgaacatagccttggtcggatccctttatgagtcagacggttttcttcctgtgaggtgggtcctcagtgggagggactagagacaggaaaaccgttgggtgggcaacctgtgaacatggatgcaaggaggagcagggcggcagcacaagatgagtgtgggttttgaccctcacaagtgcagattccccaatagctctttgccctctccccttgtctgccatctgtgccccagggtggcggtgtctgtcgctgttctggccctttggtagcttattaaatctcagtaccacttgccaagaccctttaaaccccttagctgttctttttgccttttctgatcagctgtatttattctgaactaaatggtcctcacggcagaatgaaaggatttactgcttaagtatatgaaaagaaaccttggctgcattacagttgcaccctctcctcgccaccccctgcccatgctccatccgctagctggtgccactgagactgaaccgggagcccgctctgggtacagtgtggtcagttcagtttggtggcagagtccaattgatggagcagtgaggtgactgggaggagcttgcttttgggagccctctcctaaatgtcctgctgccccaggggagactggcggcccaggaacagctctctctctccctctcccccgcacttttcccttcctccctctccctctctccctcccctccttaaacctctcccccattctctctctcagattctctctttccccttcaggattgtgctcatggacgatgccatggactgcttgatgtctttttcagatttcctctttgccttccagatccagttttactactcaggtgagtgttccggggctccatctggctccgcacaggaccctgtctccctgtcctgccctgctgccctgcccatctgtgtgcctggcacacacgtttctcttccccacttcctttgggggtgtgcttcactgcgggtcgctaacaggatgtctagtgttcagtggtggtcacaagattcagtctgcagagccgacttcctcagcctcctgaagacactgaacaccgcagtgttttcagtcagcaacgcaacaaatcagtttaagtgataatgacaataacaacatccatagcatccacagcattcactgcttactgaaaacttactatgtcccaggcacagcactgactttaatcttgacaacagccttgagagagagtcctttcagagacaagctcacagaagtagtagccagtcatgcagctcataagtggtggagaccagacctgaaggctgactccaaagccagcgttcccaacctcgctgctattttactgccttcaagggtctctcccttggcaactgatcgtgcgtttgggtgcacattctcctccaccccacagctttaaaaaagcatacaccagtcctttgtcacactcccactctgctccccaattcacacagctgcacccttaagtctctctggaatcagatggaataaatatagacaaataaatataaatatacaccagctcacgcacagagacatcaaatggagtgccgggtttacaaattgctgactgtgttcataaacaaacttgcttaaaacaggctcttccagtaaatagaaggctgtccttagatcctagaggtggccttcctgccaactggtgtccccagccagccctggcctcatttgggcgccacattctgtttacttgatggcagcccaagggctgtacagttaggggctggagcctggggtctcgccacctgctcttagcagcaccagtcatttcccatttctctgaagctcttgggccctagagaaggagcagccatgtctgggagaacatttttccctcactgtctccccagccctcttctcacagcacccccagagggatgggacagccaccacattgggctgggagcattactgacactgcccagcggtgtgtgtagagacgagatgggccataagtcagcagttctaacaatggctcaactacgaaatttgaaaaccatttcaaatgactgactcatcagcagctttcaggctttctctgttcctcgctggtattccaacacgctttcttgaggtagagaggcaggtggccacacaccatggggcttaccagtgggagcatactcatgttcactcctccaaaaaatatttatggccttaatatgtgccaagcacagtgctaggcaggagaggccaacaaggcatgaccccgcctttgtgcattccagcaaggagacagattagacaattaatgacacagaaagctcctcactggctaagtgccagaaaaaaaaaagcctatggtgctatgaaagtgtgcaatggcaggtctcacctggtccaggaacaactgagccaaggatgggacatttgagcaaaaacacagattagtgtcatctctcatcaatgtgttgtcaaacaaggttgagaacttctgctctcaggacaccatgccctgagcactgaggctggtgtggaactgggctgacagagaagggaagacatagtgaacagacaaaacatgtcctccctgcctgagccgtccacacccacacccccacccccacggttccagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacaggtgaggaacgggcatgcagcccccagccccccagccccagggggtcggactgctggctgcggaacagagctccgcaggatgttctgcgcggcccaggcattctagggcccttgctggtcataatgtaacagtgccatttgcccccaaaccagttgttgactgaaaggctctcaattagctcacttcaaaaggactgctttcactcaggcaagaccactgtagttgaccaatttactgggtgacagactggccttaacattttagagagaaggaaagagtactccttgtataaaacttttctacacaaagagaggggtaagctgtcctgtgtggcacaagtacccttagggactgagcaacaggtttggtttcccgtagccatttcccacccccactccccaccccggtgaaagcaccagttagtgaacatgccagcccctcctgaccatagtgaaggcctgatcccccagggccttggggctcccaaggcaggtccctggcttggctgtgggtatcctcatgaacctgaaagtatggatgcagaggtggccctgaggctggctaggctctgaatgtggcatctctccttcttagctgcccacccccagcacttgtcaaagaggccctcagcaatgttcagagactgaccttctatggattcctcatggctctctcaaagcaccgtggaatcaaccaagccctcggtaagtcagagctaagcagccgtcagcctctcctgccgcacaacacagggagcagctggcctctgttagcaacacggctccagaggggaaggggcatcaccatctctgccttgacttcccagggccggactcaatcccagggagcaggaatatggcgacaaaacatggctcttacacattcccatggtaggggacagccctccctgcctgcagccctgccccaacatgaaaccacctccccatagcagaagcgcccagcccctcctcagagaaccccagctctgctttggggagcagcctgcaggtcgggcagacacaggactatttactcagtgacgctagagattatatatcaaagagacctgaatcccatttataaacaaggcacaggtgtgtctgcggagaccttttttccaagctgaaaaaaaaaatctgattaatctgaaagggagaaaaacaaaagtaggggaagtctgcagtggcccagtttttcctgcctgctgttttttttcactgagccttctccacccaccccactgttcctcctcccacagccactgctctcctaagagaagagccagtaagcctccattctactacagtttaaggttttttgttttttgttttattttgggacagagtctcgctctgttgcccaggctggagtgctgtgtacaatctcagctcactgcagcctcgacctcccgggctcaagtgatgctctcacctcagcctccctagtagctgggactacaggcatgcgccaccatcctggaaaatttttgtgttttttgtacagactgggtttcaccatgttgcccaggctggtttcaaactcctgggctcaagggatcccctcaccttgctctcccaaagtactgggattacagttgtgagccactacgcccagcaaggagttcttttttgtgtctcgagagatcctcctgctgtgcttgggatcccaggtgcctgagtctcaaggaaaagacacacagcatcccccttccttttgccagttgagggaatgggattaagggaaggaaagttaacattcactaaatgccaaccacagcaggctaagtactgtgctggatgctttatattttttatcttacacaatatacagttagccagggatgctctgggatacacaagcacaaaccccagcaggctgaactgcatgccacccacagcctggttattctgagtcagtgcttggggcatgcacaggtctggggagccctcaactgaagttggtagccaaggttacccactggactaagactagaaaggaggcaattgacaggccaggcgtggtgcctcacgcctgtaatcccagcactttgggaggctgaggcaggtggatcacctaaggtcaggagttcaagaccagcctgaccaacatggtgaaaccccatcactactgaaaatacaaaaattagctgggtatagtggcccgcacctgtaatcccagctactcgggaggctgaggcatgagaatcggttgagcccagaaggcggaggttgcggtgagccgagatcacgccattgcacgccagcctgtgcgacagagcaagacagtctcaaaaaagaaaaaaaaaacaaaaacaggcgagagtcaggaatcaagagtaagggggaggcgggtgggatctgccctggtgttctttcatactcctcgttatgaccactctttcttcccaccagtagcagccactaggaaggagaagccaattagcaactgggtcacagcctgaagtaacctcatcccccttttctaagggcctttaaaaaggacactggctgggtgtggtggctcacgcctgtaatcccaacactttgggaggccgaggcggcggatcacctgaggtcaggagttcgagaccagcctggccaacatggagaaaccccgtctctactgaaaatacaaaattagccagttgtggtggcacatgcctgtaattcctgctactggggaggctgagacagaagaatcacttgaaccagggaggcggaggttgcagtgagccaagatcgcatcattgcatttcagcctggacaacaagagcgaaactccatcaaataaataaacactaatagccagacatggtggctccacctgtaatcccagcatttggggaggctaaagcaagaggattgcttgagcccaggagttaatgaccagcctgggcaatatagggagaaccccgtctctttagaaaaaaaacaaaaattagctgggtgtggtggcatgtaccattggtctcagctacgcaggaggctgaggtgggaagatcgcttgggcatgggaggtcgaggctgcagtgagccatgatcactgcactccagcctgggtgacaaagcaaaactctgtctcaaaaaaaaaaaaaaaaaaaaagtcactctcattcaaccacttttactgcacactaacattgggtggttggatggaatgggagacagaaagaagcatgtggtctcaggcctcacctgcatctccagcgtatgaaatagaaatccggagatacactggttgacgcgtcacggaggtcagccctgttcccttagtccccagggcaccccacaaatgagagggttctatgagatgtactttgaaaaccactaacttagggcaagaggggccaggaggcatcatctgaaaaagatttggaaaaaggggaaatctgcctgtgccgggttaattctggccctgacccagccttctcctcttgcccctgggatcctccttggagaagcagaggcagcattttttttttaaccatctgtctccaaagtggggtcatcctgatttagggacacaaaattaggtaatgtctgacctttgggcttagcctggaccatatccttttcagcccagtacctgaggcctcaagaaggaactcaactcccagcaccaggtcacaaccaccacctggtgttggaaggggatcaccacactccttggctgtggtgtctgccccaggcagggaaagtaggcagtgggattcaataaatgtatcaagcaacagcgagcaccttcctgctccgtgactgttcttggcccctctagcagtcctcagatctttagatcggccctcgcagggtcagcagaacaggcagccgtgaaggtgaggggcatggaggaatctgttgcctggctgaagggccctcagattaactactgtgcccccaatgatctcctaggagctttgcctgacaagggggatctgatgcacgacccagcaatggatgaagagctggaacggctgtaagtgtcaagtgggaggatactgcccccttgtgggggccagacgggtcggacacggctgtgccccatctggggccaacaccacttgtctgtaacatcccacatctgccagggaagggtctgggggccagtggaggcctgaggtgtccctccctctgagtcctttgggggctgcagcccaggggtttaccctagtgttaagagtgggcatggaggccctgctctctgtacaggaggcctctcgctgccctccaggcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaa

SEQ ID NO: 2431 - DNA, 227682 bp, Homo sapiens
gctcccgtcccccttccgccgcgtgggtgccatggcaacggagagagacggcaacctgggttccggaagccggagagctggagctttgaagccaccccggtcaaaggatgctgagtccggagcgcctagccctaccggactacgagtatctgggtaggaaccccctttaactttggggagggaaagacgtgcagacgaattaggccagggtctgggaggaggcgggggcggggtctgagtgggatcgggtccgggtggtatggggaggggcggagaggcgggggttccagggcctgagcctgtaaggccgagcaggaaggaaaaaagcacctgggaagtaaagaatgtttgaagtgtaggggctggaactcaggcaatgtggattgtgttcaaatgggtcaggttggcgttgaggatttggggccctgttggggtattattgatatgctggtagtggagtaagaataaccttggaacctcaagtgccaaatcagtcagcgaacatttcgagcttttctttttcattaggcactgtgctaagcatttttcatgcatcattcttcatttgaatttctcaacagccctaggaggaattaccgtgttttcttccagttttgcaggtggagaaactggggctgaagaggtaacttgcgttaagttaggccacacagctagaaaatggtagcgctaggatcagaaccggatttgcccactccaacagaacttgagatattgacttggctcttgagctaagactgtatatgtagtactttgttgagcatctttagtgtataaggcatttaatgaatgaaaaaaggcacacacacgcatagatatgtacacacacacacatatgcacacaatacacattttattttattttatttttgagacggagtctagctctgtcgcccgggctggagtgcagtggcgcgatcttggctcactgcaagctccgcctcccgggtagctgggactacaggcgcccgccacctcgcccggctacttttttgtatacttaatagagacggggtttcaccgtgttaaccaggatggtctcgatctcctgacctcgtgatctgcccgcctcagcctccaaaagtgcttggattacaggcgtgagccaccgcgcccggccacaatacacattttaaataattcatagacttttatttttttaaagacgttttgttttgttttgttttgttttttgagacagagtttctctcctgttgcccaggctggagtacactgcaacctctgcctcccggattcaagcgattctcctgcctcagcctcccgagtagttgagattacaggcatgcgccaccacgccaggttaattttatatttttagtagagacggggtttcaccatgttggtcaggctggtctcaaactcctgacctcaggtgatccgcccacctcggcctcccaaagtgttgggattacaggcgtgagccactgcacatggcgagaagttttaagtttacagaaaattgagcagatagtacggcgagttcccatataccttgggtctccctcactcacagtttccgctattatttacatcttgcattagtgtggtacatttgttacaatggataaacatatatatttataatatataataatatattatatattattattattatatagatatattattatagatacatattattaactaaagtccatagtttacattagggttctttgtgttgttcagttctgtgggttttgataaatgcatgtcatgtattcaccattccattatcatacagaatagtttcactgtcctgaaaaatcccctgtgctccacctattgatccttctccctccccctgcagcccttgccaaccactgatcttatggtctctaaagttttgccttttccagaatatcatgtagttggagtcatacagtgtgtaaatttttcagatgggcttctttaacttagcagtaagcatttaagtttcctccatgtctttctgtggcatgataactcatttctttttatttctgaataatattccattgtatggatgtaccatgcacatcttttttttttttcttcttctttttttttttttttgagacaatgtctggcactgtcactcaggctggagtgcagtggcactatcacggctcactgcagcctcaacctccgggctcaagtgatcctgctacctcagccttccaagtagctgggactacaggcacatgccaccatccctggttaattttttaattttttgtagagaaagagtctcactatgttgtccaggttggtcttgaactccagggctcaagcaagcctcttactgtggccttccaaagtactgagattacaggtgtgagtcactgcacctggcttacatctttttttttttttttttttttttttgagatggagtttcactcttgttgcctaggctggagtgcaatgatgcgatctgggctcaccccaacctccgcctcctgggttcaagtgattctcctgcctcagcctccctagtacctgggattacaggcatgcgccaccacgcctggctaattttgtatttttagtagagatgggtttctccatgttggtcaggctggtctcaaactcctgacctcaggtgatccacccacctcggcctcccaaactgcttggattacaggcgtgagccaccgcgcccagccaacatctttttaaatgaaaaacaattctggtttacattttgtttaacttattttaaaaattaattttaaaatattttttaaggttggtaatatggaaacttgattcaaagtattttttaggcctggcatggtggctcatgcctgtaatcccaatactttgggaggctgacgtaggaggattgcttgaggtcaggagttcaagaccagactggatgatagagtgagaccctgcctctaaaatgcatagatagatagatagatagatagatagatagatagatagataggtagatgtttttagtgaaaagcctacccctttgcctccatctgcccagtttccatccatcctcagcctcccaaaagtaaccactattattgttttcctgtgtatctttccagagtttattatatacataaaggagtatacagtgcatactttttcatttaatacatcttgaagtaatttccgtttcttttgttttttcttttctttctttcttgagacagagtctcactctgtcacccaggctggagtgcagtggcaccatctcggctcactgcaacctccacttcctgggttcaagccattctcctgccccagcctctcaagtagctggaactgcaggcacgagccaccacacctggctaagtttttgtattttgggtagagatagggtttctccatgttgcccaggctgcttttgaacttcctgagctcaagcgatctgcccaccttggcttcccaaagtcctgggattataggcgtgagccactgcgcctggcctcgaagtaatttctcagtcagtagggagcttcttcgttcttcatgaaattcatttttagctatatagtatttaaataatttatttaaccagtcccgcactggtaaacaagttgtttttagccttttgctgttactaagaatgctgcaatgaataacctgcagttttgttcctttgcaagtgtatctgcaagaataagttccacaaagtggaattggtggattaagggcatatgcattgaagtacttatagatattgtcagattgcccttaataggtgttgtaccattttgccaccagcaatgaaagagaatgcctgtttccccattgtgctgacaacaaaatacatcaaacttggatttttttcaatctaagtgacagatagtctgagtagatttaatatgcatttttaaatgaagttgagtgcctttttaccaagtttaagggctgattggtctttgaaagctatatatatacacatatatacatgaacatatatatagacatatatatagagagagagcttaagacagtgaccacatccattaatcagctaaaaggggatatcacagacaattttgtatctaatgaataacagtatcaatgtcaagcaatgcctagacttttttccaaagattttatgtattttattacccagtactcaatgaatatatgaaatatttgaaaaggctagttcattgttcagttccttgggtgtttgctgtttgaattttatgtctcaaaggcttggcagatttggtgtattggtgccttggtgaatagaagttggtggtctcttcataaatggcgttttcaggaaggccaattcagtggcagtgttgagaatgaatctacaaacagaatcagagtctcaggttggttgaaaaagcttcaatgtttgtgaagcccaaccaatcacctaataattgaatcctatacaaatgcttcttcatgctttgttgcatatttaagtgtcttaattccttgtcctaaccactaactagacattcatactgccctcagcatggtcacacccctcactgccttctcctggttcatcaaaccgtatcactctgctgaaatgcgtttgtctttagttgagaactatccctgccttttacaatttgtctctcttagaggcatgctgctttgacctattcaccctcaattttttttttcttttttcttgagacggagtctcgctctgtcacccaggctggagtgcaatgatgtgatcttggctcactccaacctccgcctccagggttcaagtgattctcgtgtctcagcctcccaagtagctgggattacaggcacctgccaccatgcccagctaatttttgtatttttagtagagacagagtttcaccatgtttgccaggctggtctcgaactcctgacctcaggtgatccacccaccttagcctcccaaagtgctgggattacaggtgtgagccaccacgcctggccaacctattcaccctcaatctaatgaccgtttaaaaccactccctacagaatagattaataaaatatttcctgatttaaatttttaaatacctgtgatttttccatttgtttttatttttatacattataaagttacttgtatgtgtaagcctaaagaagactatacttatagagaaaacaaaactgcagactggaaagccctaggcattcagtgaaacccaaaagctaaagttgagttccccttggttagtgtatctggagacctctctttaggattatggtgtaaattacagggatacctatccaaagaatatctagagatatccctttctccctgctagctagggattgtatttacctttctgactattagtgaagaaatcaatcttttatcatgttgggtaaactgatcctttccccactgactttgtagattaggaacctgtaatcatggccttgcatggcttaagatcttaagatcatcactaaagaatagcttagtgatgttcatgtctgcagtcatcagaatgtagtgataaaaattgtgttaatgcctaggcctgaagagagaaaggagagtctggtaaggagatgaaataagtatagaccctctctgtaggacccgcaaaaggtttccagccttatgaaacctacttagtggaagcttctgccagaggctgaaggtgtgtctgtgtatctggttgggtgtggcgagctctctagagccaaagggcagcctgttctggtcccaggtttgccaaacataccacctacgtgctgacctgagtataagcatgagggcgtgaggtttattttttactccacctaatttggtgaggtgcatgctttcactcacgctccaagttgcctcttcttttccatggaacctgcttattctcactacggttgatagtgggttagtataatagataactctagaaatcaaagatggcctttctcctttggggactagacatttagaagaatcacaataaattgggtagttttttttttaagctatagtttttgaactcttcctatatgcctggcactgtggtttatctcatttaattttcacaactaccatatgaagtgggtactcttactggtcccaattagtagttattaatatcatcttctcattttataaataaggaagctgaggcttagaaaggctaattgatttgcacaaggtcacacaggcaatgatgcatagtaaacaggggttcatacccaggtttgtcatattccacagcttgtgttttttcctcttcactaaaaagataaaaacaaaccaaaaaacccctattggttcaaagggcagtaattcttgcttccttattaaggatgaggctcttgcaaataaatttcttgggaacaagaattgtgttttactcatcattgtcaaccttctatcattgtctaccttctatcactgtataccttctatcattgtatactctcctacacttaattcatacgtatatgtgaaatggaatatgaataatctgaccttagggtaccctaaacatgagtagctaacaaaagcaaccgagacttattaagaacttactctgtaccaggtaccattttaaatgctttacatatattgatgtatatgaagatagtttcagttgttatctccattcggcagatgaggaaactacacacaaagataccaaataacaagttgtaagtggtggatccagaattctaacccagcagtctaattgaagtccacatggttaaactctatgctataaatactttgagcaactcccaaagtggggctccaactattgtgtagacctatacgtggatcctggagtaaggtcaagtgattccagtgtcttcatttaacatttctgccatgaggaggcatccgaggaatgaggatggatcagggaatggtaaaatttccaatttcttcttgccactggactcatctctcagaggcaggcagtgaggaagataacttctaccatttgggagaattttattgacaatcatctttgtactttgggtagctgtatgacctagaagaaatcacttaacctctctgtgccttagtttccacatctccaaaatgtgggtggtaatagtacagtcatggtggcttacgcctatattcccagcactgtgggaggccaaggagggaggattgcttgagcccaggagtttgagaccaatgggacatagtgagacttcgtctctactaaaaataaaaaaaaaatagctgggtgcaacagcatgcatctgtagtcccagttactcaggaggcggaggtgggaggatggcttgagcccaggaggtcaaggctgcagtgagctgttttcacaccactgcactccagcctgggtgacaaagtgagaccctttctcaaaaaatttaaaaaaggccaggcatggtggctcatgcctataatcccagcattttgggaggccgaggcgggtggatcacctgaggtcaggagttcgagaccagcctggccaaaatggtgaaaccccatctctactaaaaatgcaaaaattagcagagcgtgggggtgtgttcctatagtcccagctactcaggaggttgagacacgagaattgcttgaacccgggaggaggaggctgcagtgagctgaaatctcaccactgcactccagcctgggtgacagagtgagactgcttctcaaaaaaaaaaaaaaaaaaattgtgcttgcctcatacatgtaagcatttatcctgttagagcacctgtgtaggtgctcaataaatattagctgctagtgttattaccatatttttgtgcaaatacgtaaacatctggtggcaaccaggaatgtgtgcctctcagatctcctacactggggaggggagggtaattgactcctgaccccagctctgaatctaacaccttgttcacactgaggtcacactttccacagactgctcctagtcaatgactgggcaggacagacccacttccatgagatgttttactcctctagtgggtgactttggcttaaagactctcactgcacactgctaagtccctcattctcccttctccctcctaaaggagggataataattagggtccctcctaaaggagggataataaattagggtcacacctgcatttgatctcttagctctcccagactcctccggcttccttcccattttctatcatgggcgtttcccccagtacatctctcgcatgtctgatcctgttttggtgtctgtttctcacagtatctgagctaagacaacatctaacagttactgatatagtctcttccagccatgaggttaatacaacttctttaggacttggcaaaggttctgacataggaccccttctatgtggaagataagtgttactaatcttaattttttttgtatttgctgataccacagcatatgatagttacttgtctgacttccagacacattctattttttgattttgaatgaatcctgataaacttatttttatttgaatataactagtgagccttccaaacccaattctattctaggaaatattgctgtttacagtaagttagcagaaattctcttagggccttaaagtgtttggttgctgcagaaaggaaatgaaataaaataggtgttaaactgacttcctaaatctttggaaactaggtttataatacataaaactggtcactttgaaatgattatgggccaggtgcggtggctcatgcctgtaatcccagcattttggaaggctgaggcgggcagatcacttgaggtcaggagttcgagaccagcttggccaacatggtgaaaccctgtctctactaaaaatatgaaaaatagctgggcatggtggtgcgcacctggagtcccagctacttgggaggctgaggcatgagaatcgcttgaacccgggaggcagaggttgcagtccactgagatcacgccagtgcactccagcctgggcgacagagcaagactctgtctcaaaataataataataaataaataaaataattatgaacatgttcacaaagtcacctctttctttccttttcctccccctacccttctccttccttttcttcctccctgaataccttctctatataaagccaggcatgaatatatgaatataaagcatccctccccacaggaaacttacacagtagatgggagatgggacatattcataaatgaccataacataaaaagacagtataataagtaaagagtatgtgacctatatggttctagagccagcagctatcttggccttttctcagtttggtcagcagcttctcagtcatggaagggacagcagttcccttggtagcctagttctggaatgggccttttgggagttgttcctggaaggtcgatctagatttttttccttttccaaagattctgtaacctatttaatacatgtaataaataaatatctttttgttggggggaaaaaagagccagtaagttctaagccatgttgttcccaacccttgcctacctccatttctccaaagtaaattgcagagtgatgtcagtgttattctggggttttaagatagctttaaaatttttgactttgtttatcatttatatattcaagtaatgttaaaatctttattccaaatgctattcagaagttggggatcacttttatttgcacaaatgcaatatgtgctaaatgaataattctaggaggccgagtagataaattgaagttttaaaaataatagtagagcaggccgggagcagtggctcaacgcctgtaatcccagcactttgggaggccaaggcgggtggatcacgaggtcaggagatcgagaccatcctggctaacacggtgaaaccctgtctctactaaaaatacaaaaaattagccgggcgtggtggcaggcgcctgtagtcccagctactcgcgaggctgaggcaggagaatggtgtgaacccgggaggcggagcttgcagtgagccgagattgcaccacggcactccagcctgggcgacagagcgagactccatctcaaaaataagtaaataaataaaaataatagtagagcagaagagacatgatccattatcctatttctggttcatcatcctatttatgtccttcatagcacttatcagagttatcttgtgtacctacttgtatacttggttattgtctgtttcttattagaatgtgagccatgagggcaggccttttctctctaaaatctagcacaatgcttggcccaaatgaagtgctcagttgttgaatgaatggtctactttaagtaacagaataaattttaaaataaatgggagaaaggaatccagttcaacaaatagttactgaattcctaacatgtgagagaaactatgtttttccccccttccatgaatgaaaaaggatgattaaatctgctctggatcttttcggttttaactctgatttatacctaaagttaatttcttggttgataccatagtttctgtgtttgggttacataacattaaaatttaatccattttgtaaaaccaatattttaaaaaggaaggagattttctacaattttggagcatctcaatgagatcctgtcctttagttggacagagtgatatgctttgattaagactggaattacccttgtaaactaatctctgggtcctctttctgtgttgggatcacccttacactacttccctaggggccttaggaaatagctcattctatgattggaatttcaagtcaaaacacatttatctgagcagaattttaatgatttatcaaagagaggagggattttcccaaacacaactgaacttacaaattactgatcccactagctatgttttttcttaagcacctttctttaaacaaagcaattactgctgaaatcatcaaatgtatttttttcatggaaagcttttgactaagttttgtttgattagcaggaacctactaaaagtaaatattgtttgagacagcactttcagagcctgttctttttcttcattcaattagcttttaaagcactattctttggagaaagtaagagccttttttccagctgtcctattgtgtaactcaaggtctcgttaatactattatctagccccgagattacaggtaattgtgataaaacacaagcttcagtttctgtaatctcagacagaaatctgcttgtgccccaggacttcagatcaggtgttttttaaattcagacttctctcacctgggacagtcccattggcccaaagtaaacagaggcatctggcggggatagagctgcattagggcccattgccactttttttttttccctttaaattaatgtggcagaactcctcctgtggccaacttacaaagacctgttctaaatgggaaaattctgtattttaaaataggcatgcttgaaacaataacacttttgaatgtaagatatatgaaaggccacacgtcttcggctttgcttgtcaaatggagaggctgccagaaccggtcggctccatggttctcatgccccaaagtcctgcaaattgacacgtaagtaggcaacacacaaagaagttcagcccatgagaaagtgagtttgggcgcttgggctggcctcctttctctctgtgtggagttctttccaactttgcctcttctgtcccatcttagtttttcagaaaggagagattaaatgtgtctggtatatcagcatgttaactgcttgggcaacatgaggctagcactcaggacactgttcagcctgtcatatggaaggaattgcctttcagaggagattataattgtgtatatagccacacaaatgcacattctgcctggaggaaattgcacagaagaggatgccttatgctgccactcaggtctctttgtggaaggctgcgtaagaagtgcttacatggcatagtcacctcttttggacttaatgagtcatctttttgtgtgatggctacataaaaaaaaaggaaagaagaaatgtactcttccccaagtgagctgcttttattggccctgctgctttgtctaagagttttatacactcctcatgacatcatttacaatgctggtgcacagacagtaaacaaaaaataatttagcccttgggcacctagacgaaacttaagtagtccaatttagagaaatgataacaataaacttcataaacagtgaacacatgagcttaaacagcaagcatgactccagtcctttttggaatgcgatgcattgaaagatggctatagagaaaactagaagctccacacgtcagttatgtgcagttaagccttgagtccatggtctagtgttaatctcaagagtacattctagttagtggataaaatacaggctaccatgtgagtaagtcattaagctccttgagccacagcatttcacctataaaagtgggaaaggtaatattgccacctacctcacaggaatgaaagatgattgagaagataaacttgtggagttccttatagggaaggtattttgtaaatagaaaacactgttattattctccttgatcaaatttccccaacaaatggagttgataaaagctacctcacagagggttgagaggctgaattaattaatatacgtctagtatcttaagagtaaactatttaatgaaacctaaaattgattgtctttcttgatagtctatgaactaccagacctgctgtttagaaacatgattgtcttctaaagtctcacatatgcagtctttgccttctcttcaagggttggcacgataaagaatagtgaatgtacaggcaaaagataggctaaatcttcagggagaacagccttgccttttttcttttcaagggtatatttacaaatagcctttggagtcttgctaatctttgttaccatgcctgaacatagggactgttttgacctttgttcttccaataaatatttatttttgatatcatatttctaaatgagaaacaaacttagaaggaaaagaagtggttgaatttgtctcacattataaattttttcttatctttcctaggatggtaagagaaaataacttttttttttttttttgagacagagtttcgctccatcacccaggctggagtgcaatggcacaatctcagctcactgcaacctctgcctcctgggttcatgcaatcaattctcatgcctcagcctcccgagtagctggaattataggtgcatgccaccatgcctggctaatttttgtatttttagtagagatgggggtttcgccatgttggccaggctggtctcaaactcctgatctcaagtgatcctcccgcctcggcctccccaaatgctgggattacaagcatgagccaccgtgcccggcctgaaaataactattattgaaggaccagacatcaggctctccaactggaaagttctcaaacttagccaagtgattaaaaacagctttggctgttcagaatttaatcttttgttttcaattacagttagtagtatttgggtaacttcatttcccagatttcatttgctgttaggtgacacaaaaaggggaaagactttttcttttctttttttttttttttgagatggagtctcgctctgtcgcccaggctggagtgcagtggcgtgatcttggctcactgcaagctccgcctcccaggttcacgccattctcctgcctcagcctcccgagtagctaggactacaggcgcccgccacctcgcccagctaattttttgtatttttagtagagacggagtttcaccgtgttagccaggatggtctcgatctcctgaccttgtgatccgcctgcctcggcctcccaaagtgctgggattacaggcatgagccaccgcgcccggcctaaagactttcttttaaattctaatcccttaggcagggatcatgtctcatatatatattttttaatacagagataatatttcaacttttaagtagtacagctgcctaaatactgtcttaagtagaaactgttttcttttttccttttttctttttttgaggtggagtctcactttgttgcccaggctggagtgcaatggcccgatctcggctcactgcaacctccacctcccgggttcaagcaattctcctgcctcagcctcccgagtagctgggattataggcgcctgctatcacgcctggctaatttttgtatttttagtagagacagggtttcaccatattggccaggctggtctgttggtcagggtggtcttgaactcctgacctcatgagccacccgcctcagcctcccaaaatgctgggattacagccatgagccaccaggcctggcctggaaactgttttcaaataggtgttcttcatatgccatctagagtaattctcatatgcaggaggactgaaggagacagcagtctcgttcagtcctcacagcaggtagacaccagctgatcccacttttctttgaggaaactgggatttaagttatataacttgtccaaggtcactgagctagtatgtctggagctgaagtttgaatgaagtttatctgactctaaagccagtagtattgttagccactttctttcaggttttgtaatttctaagagccttctttcccattcagttcaataaaaatttaagtgtcagaacttaaattcagtagaaaattctacagaatatatgatatattccttagactctttttttttttttttttttgagacaaggtctcactctgtcatccaggctgaagtgcagtggcatgatcatggctcagtgtagcctcgacctcctgagctcaggtgatcctcccacctcagcctcccaggtagctgggactataggagtgtgctaccatgcctagctaatttttaaattctttgtttgttatgttgcccaggctggtctcgaactcctgggctcaggtgatccacccgccttggcctcccacagtgctgagattacagacgtgagccaccataccctgccagattgttttaatatatagaagataatttaacattttcttggtgaggtagtgtcattattttagacctaatttattatattgtgctataaatgtgttataacagttacccatgaagatggatgttattttttttatgcatgagaagaaatggtggctcaaataacttaagtaaattttccatttatatagatagcagttagtgaagctgttatttgattctaattcttctaatttgaaattaagtggtttaggtgccactcagtgttaaattctaatttatagctattaattaataagaagacatctccctgctcccacaccagtacttaccattcccttctctccagactaatgtttcctactgagtcagtaagctgttgaggtctactgaggtttgtttggcgcttcaggtggtttggtgctcctaatctctcagggtattagggtgagggctgagctggtgttataaaaacaaaacaaaacaaaaaacctccaccacttaactccccctccctcccagtgcaatggctcatacaagaagcactttctttctttcttacttaatccaaatccaggatgtgaaaggcagggtctgctttaggaagtcatcattggatttcagctagcagagcagtcattctgtctgaaacacatggtttccaaagctgcctcaattgtagccattttcagccagtaaaaggggaaacagtgaatccagggcaaggaccttttaggcaagtgaagccgaagatgcaaacatcacttgtgctcacatttcataggtgagaacttaataaggtccctgctaactgccaacgaggcagggaattttagtctaatggacagtcgtgtgcaagaagaatggcagtgtatttttggtggtacacaaacaaaaatctgtcatacctagtatatgcggtggagacatctaccctactcaaggcaagttgtattgttggtagctgcttgcccttattcacaggtgaagcatagatgtgctggtcagtatttggtttttgtcctctacctcttgaagtacaaagttattttatccttggtccctgtctctgagttcagttgctccctttttacaatggttattattttctttcttaactttatgttgcctgtcatttctctgtgtcacttcctgtcctttgtaaacatttccaataatcagaatagttcctctctatactctagtgagtcgttcaccttagtgagaacatgtaattttagaatttttagttctttataattggtttgttgctgggcgttggaggtaactttgctgctaaataattttatttttctattgagagttagagacccattgtagaaaccaaaatcttgtttccagagagctagttttacaataaagaaagatatttatcttcctagactggagagtgatttgtaagagatttaggaggagagtgagaaaaaggcagtgccacagacactggggacgtgggggtggagagtttcaagatggaggaagtgttcaatgataccagatgcctcagagaggtcaaagaagatacgggctgcaaggcaggttgttagtggcattaagggaggttttcatggagtagtgtggcaagatgcctgattttgctggattgaagagtaaatcggagggtgaaggcgttgagaataggctagattcgtttcaagaagtttgaccaattagggaaaggaggagagggggtgatagcaagaggaggaagagagagtttattgtttttagtttttagatgggagaaacttgagtatgtttttaggctgaagggaaaggaaccattgtacagggagagagggaagatccaagggaaggaaaggatgatgaatacttgatggaacatttttagaagtacgaggaaatttaggatcaaaggcagaggtgcaaggctattttgaagttgggagtcaggaccatatttatccagaaggcactgtttgtgtggtgcctaaccaacaaactgttatgggatctttgaaaatatttgagacctaaaaaaaaatttatcaaccctaaagtatggatatatgttttattatatatgtataaaacaatataatgtcaactttcattattacatgtaatattgacagacattttgccatatttgaaagcaattcataagtaagaattttctcaattaggaagaattcccaagtgagaaatcaggtcttaaggtgatcttaaaaccgcttcacatggcgtaattaaatttgaacaacagaggtgggaagtaagggtgatgaaggacatggttaaacttagaaatggagctagaaattggtgttctttacctgatgacctcttctttgtctgaagtaagaatcaagattatcttcttagagttagggaagcagaagtaaaaggcttgaggagagcaaagaaagtttgtattagctactgggggaaagaagaaagatagctcgactagggccaagtacaagtattctgagctacattaaagcatgtgaagtaaggctgcataaatcattttaaaaaaagaagtaactaagaatgctaacaggagcaaagttgactatgggaattggtaaaagaaaaaatacaaaagcattacaaaataataattagaagaaacagttgaaaaactcttttaggaaaacatgatgtcacaaataatgcataagaagagggaggattcggctggatgcagtagcttatgcctataatcctagcacgttgggaggctgaggctggtggatcacttgaggtcaggagttcgagaccagcctggccaatgtggtgaaaccccatttctactaaaaatacaaaatttggttgggtatggtggcaggtgcctataattccggctaccctggaggctgaggcaggagaatcgcttgaaccctggaggcagaggtggcagtgagccgagatcgtaccactgcacttcagcctgggcgacacagtgagactctgttttgaaaaaataaataaataaataaaaaataaaataaaaaagaagagggagaatccagagagcgcaaaattccacttcttccattgaagaaagttcaaagaattgctggatttaaagtttttgatgtttatgtttcttaactacagaattttaaaaatcaaatgggtctataagagttataacaaaaaaaagcagtaccctacaccataaccttctcaccccgaagtctcactcctcagaggaggccattttctttcttttttttttttttgagtaccagtaagtctttatttattcattgtattttcccagggaaaggagaagggaagggaagagtcagcatgtgttaaaaaatgatgagaaaatgggaaaggaagtacccagtacagcaaaatcaaccgtcaaataaacacaccccagtgatggggtcaccaaagcccaaaggggctcagtctcctgcagttcaggaatgagggaaaaggatcaggaaaaaaacagacaggtacaggctttcctaccctccctccccataaattcaagattttacacaaagctttggtttctagcagtaaacatggagttacattcattcatctcctattaaacaatcttgtggccactttgacataagtttctaccacctgcataaaagttcctgagtgacttggatatacattcatattccctttcttggcctcctgaccccactttctacatggaaggcccccaattgcatctctttactttaggattagaaattaaaagtaagtaggtttgatccatccaaaatacagtagtgtggttttttttttgttgtttttttgttttttttttttcgagacagggtcttgctctgtaaccaggctggagtgcagtggtgcgatctcagctcactgcaacctccgccttccaggttaaagcgattcccccgcctcagcctcctgaatagccgggaccacaggtatgcgccaccacacctggctaatttttttgtatttcagcagagacggggtttcaccgtgttggccaggatggttttgaactcctgaccttgtgattcgcccgcctcagccttccaaagtgctgggactacaggtgtgagccactgcgcccaggctacagcagtgtcttaagtgtttggcatgaatacatgaagaaatggtcggcctagcgtggtggctcatgcctgcaatcctagtaccctgggaagccaaggtgggcagatcacctgaggtcaggagttccagaccagcctggacaacacggtgaaaccccgtctctactaaaaataaaaaaattagctgggcgcggcgggtgcctgaaatcccagctactcaggaggctgaggcaggagaatcgcccgaacccaagaggcagaggctgcagtgagccgatcatgccactgcactccagcctgggcgacagagcgagactccatccacccccccccccccaccaaaaaaagaaagaaatggtaatggtcttgacttaggaggttgggaacaagggatggagggttttcctagcttcaggatttttgcatacatcatttaagagttgtggagacactccaagcattaaatgtgtatgtgtgtgggtgtgtaagttttcttttgggggtgaacagaaaagagggcagggtagaagacaagtttttaggacagaagatctggtctaataggtaataggggaaggggaatacaaaagaaaggatggttcaagatccccactttaagaagcgggccccccaaactaatgtttcagatctttttgcctggtgcagaaacttctgtcaaagatgctttggctatttttctctcaatacaaaaagaactttgtaaacaaaacccccaaagaacacggaggaagaccaatacattatatttacacaaactaggccacctagcaatcaacttagtgaagtcctacaaagcccagacaaatacagtaacttggggggcagcatttaggggagacaagaacccaggatcagacacacaccacccaatgcgttctattgtatttgtcccgtttcaacacagtgaggtaggtttgcggtgatctcacagcatgtaaacgaaaccccctttttcgaggaggccattttcaaatttttcagcattaaaaacaatttttttttgctgtgtactttaaaataacatgcttaaattgctcttcttgatttttcagttttagatattatttaatgactttatattatagaagatgaggatttaggtctcttatactactcaatttcccttcttcctagtcttccaacaaaattattataatttttggttaaatcaatattcagtgtttattatgactgtgaaaattatacatatgtatgcacgtatacatagtatatatgtatatatatatacacacagtatacaacatatatatgtaaaatatatataatatagtatactatgattacatttctcctttttgaacattttttttcattttcctgcaattaataattgcctttccttttgtgcatggttttcgatgaacttgtgccccagactttatagcctaaggtcagttcaaacacatcaggcatcctctcagtttcaatttcttttcttcaaggtaacttttctgaagtacttcttcatctaactggtccccctgcttcagtctggcctggttgctctctaaatccttcatctttatcatgggtattacttcattcttcatccttacatggatattacttgtcttgcttaagtaagttttagtgcatatttcctaaagcctatgtcttcctttttccttacatgttccttctttttattagattgcatcctctagtagctttctgagaaagggtgcatgcaaagtaatattttagggaatcttctgtttatgaaaatgactttatactacccttacccttgattgatagtttagatacatataaaattctgtgttggagataattttcccttagaatttttaaagcatttctcccctatcttttagctttctgtattgctattgagtgatctaatgccattctgatttgtgatatttcatgtagttttacattggtgtggatcttctttcattgtcttgagatcctttcagtgtagaaattcatgtatatcagttctgagaagttttcttgaattatgtgtttaatattgtctcatctctgttctatctctggaactgttgttacttagacattggacttatggatttatgctctaatttttcttgttttctcttttctgtcttttttgatttttgtatgttatatgaatatccttaacctttccaatccttttgttgaatatcaaaaatatctattgtattagccagagttccccagaaaaactgaactaataggatatgtaaagacctagatacatagctatatagatatacagctgacccttgaacaacatggatttgaattgtgtgatccacttatacacagattttctttgccacctctgagacagtaagatcaaccccctccatttctacctcctcagcctattcagtgtgaaaacaacgatgaagacctttataatgaatgatctacttccacttaatgaatagtaaatatattttctccttgtgattttcttttttttaaattttaaattattattattgtagagatgggatcttgctttgttgtccaggctggtcttgaactcctggcttcaagtgattctcctgccttggcctcccacagtgttgggattacaggcatgagccaccacgcctggccccataattttcttaacattttcttttccctagcttactttattgtaagaatacagtatataatacatatacaaaatatgtgctaattgactgtttatgttattggtaacgctgtcagtcaaatattggctattaatagttatgttttgggggagtccaaagttatatgtggatattttttcttttctttttatagagatagagtctcgctatattgtccaggctggtcttgaactcctgggttcaagcattcctccctccttgaagtcccaatgtgctggggttacaagtgtgagccactatacccaggccccactttgttaaagggtcagctgtatagatttattatgggaattggctgacatgactatggaggctgagaagtcccaccatttgtgcctgcaaggtagagaaccaggaaagccagtggtgtagttccgtctgagttcataggcttgagaaggtagggtgaggaggagcagtgtgctggtataagttccagagtctgaaagcctgagaaccagaagccttggtgtcccagggcaagatgagagggagaatttgcctttcccctctgccttttgttctgcgtgggccctcattgggttagatggtgcccacccacattggtgaaggtgaatcttctttattcaatctactcattcaaatgctagtctctgccagaaagtctatcacaaacacaaccagaaatgatgttttaccagctatctgggcatcccttagcccaatcaagttgacataaaaaaattcaattatggtagatttgatgatttaaatttctactccatttaaaaaagtttgttgaattcctaaatataagatttaatcttgcctttctgagaatattaattgtagagtttcttttttgttgttgttttattggtttttttttttgcatgtgaatgtcgtctacattttctttttctcctgagttctttttttctagtttttaaatgtgtttttcatatacagacttttctcaagtttttgaagctacttgtttaggaaagggtcttacagatcaatatatagagttttatgtaatattcctgtttttagtagggcacctctgtcttcaaactattcttggtgttcccaagttcaacatccttctgattcaacttctcaatagagaataaacctttaattttaaacctgggtggaggaggagtagtaactttactatgtaaggttgggaagaggatctagaaatataactgcttcttatgtagacttttaacccaattttccatttttacctttacttactcccacggctttagaggtgcctgatacctactgttcctaagcctttctgatgttgtataagagggtgtgcttgttttttgttctcttttctcagtatagccacttaagttttagctttttttctgttcatacaataagttgtgtgtctaatttccattttccaaaatttttaacatttcttatctgctgccatcttaacttcaactctatttttataaatctatgtcttcttttatttagatatgcttagcacaccaattcagtggggtttaaataatttttttttttttttttttgagatggagtctttctctgtaacccaggctggaatgcaatggtgcgatttcggctcactgcaacctccacctcccaggttcaagcaattcttctgccttagcttcccgagtagctgggattacaggcacatgccaccatacctggctaatttttgtatttttagtagagacagcgtttcaccatgctggccaggctggtctcgaacacccaacttcaggcaatctgcctaacttggctttccaaagtgctgggattataggcgtgagccactgcactgggcctaaataattttttgaaagacacagagtctcaatatattgcccaggctgatcttgaactcctgggctcaagtgattctcttgcctcagtttcctgtgtaggtgagattttttagtatactatgcatgacgccacaatgcctggcattttttagtgtactcacaaggttatgtaactaccaccatgatataattgcagaacatttttatcaacccataaagaaacttcataccaattagcagccactcccattttactttccccgcaacccctggcaaccactaatctaatttttgtctctatgaatttgcttattctagatattgcatacaaatgataattattatacaatatggggtttattgtgtctggcttctttcacttagcataatgtttttaagattcatcgatgtttgctgggcgcggtggctaacccagcactttgggaggccgaggtgggtaaatgacctgaggtcaggagttcgagaccagcctggccaacatggtgaaaccccgtctctactaaaaatacaaaaaattagccaggcatggtggcgggtgcctgtaatctcagcaactcaggagtctgaggcaggagaactgcttgaatccagtaggcagaggttgcagtgagccaagatcgtgccactgcactccagcctgggcaacaagagcgaaactctgtctcaaaaaaaagaaaaaaaaaaagattcatcaattgttgtagggtatttcagcacttcattcctgttgtggctaaataatgtttgattgtatgggtacatcacattttgtttattcattcatcacttgatggacctttggattattttcactacttggattttatgaaaatactgctgtgaacatctgtatacaagtttttgttcgaacaccttttttcatttcttttaagcatatacctaggcgtggaatttctaggtcatttggtaactctatgtttaactttttaaaggattgccaaactttttcaaagcagctgctccattttacccaccagcagtatatgagggttctaatttctccatatcctttccaacacttgttgttgttgccttttttattatagccatcctagtgcatgtgaagtagtatctcattgtgggtttgttttgcatttccctaatgattaatgatgttgagtgtcttttcatgtgtttttggccaagggtttgtcttcttggagaaatgtctactcaaatcttttgcctctttttaattgggttgaggttaagatggcagtttagatctggactgttgaattgtaacagtctttacatattctggatactagacccttatagatatatgatttgcaaatattttctcccatcttgtgggttgtctttttactttcttggtagtgtcctttggagtacagtttttaattttgatgaagtccaatttattttttctttggatatttatgctttaggtgttatatctaagaaatggttacctaaaccaagttcacaaaactttgtacctattttttattctaagagttttatagtattagcttttacatttaggtttttgatccattttaaaatggcttgaggtaggagtcaaaaatcatttttttacatatgagtatccagttgtcccagcaccatttaaaaaaaagactgttctttccccattgagtgtttttggcactgtattagtccattctcacactgctaataaagacatacccaagactggataatttataaaggaaaaaggtttaattgattcacagttcagcatggctggggaggcctcaggaagtttacaatcatggcagaagaggaagcaaacacgtccttcacatgataggagcaaggagaagtgctgagcaaaagggggaaaagtcccttataaaaccatcagatcttgtgagaagtctctcactatcacaagaacagcatggaggtaatcacccccatgattcagttaccccactgggtcccttccatgacacgtggggattatgggaactacagttcaagatgagatttgggtggggacacagccaagccatatcaggcacttacgtcaaaaatcaatttgctataaaatataagggtttatttatagactctcaattatatttcattggtttctatgtctgccttatgccagtaccacacagtcttggttactgtagctttgaataagttttgaaattgggaatgtgaatcctacaaatttgttcttctttttcgagattgttttggttattctgggtcttttgcatttccttatgaattttaggatcagcttgtcagtttctctccaaaaagccagctgggattttgatagggattgtattgatattgtaggtcagtttgtggagtgtgccatttaacaatattaagtctaacaacctacgaacatggagtgtctttcctattatttaggcctttaatttctttcaacaatgttctatagttttcattgtataagtcttatacttctttgttaaatgtgttcttaagtatttcatttttatattatcatagttagcactgttttctctatttcacctttgaattgttcattgctcatatatagaaatatagtgccagcctgggcaacatggcgaaaccccatctctactaaaaatacaaaaaattacctgggcttgatggtgctcacctgtagtcccagctattcaggaagctaaggtgggagaatcacctgaacctaggaagctgaggctgcagggagccgtgttcacattactgcactccagcctgggcaacgggagtgagaccctgtccaaaaaggaaaaatgatcttgtatctttcaacattgctgaactagtatattagctctaatagtttcttagatttcttaggattttttataccagataatgtcatctccaagtagagatcattttacgtcatcctttccaatctggatgcttttattttttttttcttgcctaattgtgctggttagaacctgcagtagaatattgagtagaattggcaaaagtggacatctttgtgttgttactgataggaggaaagcacattttgtcttttgccatcaagtacaatgttaactgggggagttttgtagatattctttatcaggttgaggaagttcccttttattcctagtttgtttagttttagttttagctttttttttttttttcatgaaaggatgttagactttgtcaagtagtttttccacatctattgagatgatcaagtagtagggtttaagtctttttaaaatcccttcagtgatattttagcagaggttttggagggaaaaaaagaaaacacatttaagctgatacatttaactgcaagatacaaagagattttaaaaaagatattaggggccgggcgcgagaaggcctggatgggcagaccatatgaggccaggagttcgagaccagcctggccaacatggtgaaacccgtctatactaaaaatacaaaaaaaattagctgggtgtggtgcacacacctgtaatcccagctactccggaggctgaggcatgagaatcgtttgaaccctggagataaaggttgcagtgagctgagatcacgccattgcactccatcctgggcaacagagtgagactctgtatcaaaaaaaaaaaaaaaagatattagaaactaatgtagtttgtttgaagttggtcatagctagaccaactagctatgaccaattactagaccatagctagaccatagtttaagaaatttggaaatttagaaaagataactgcttgatcatgctaaaacacctaattcattatttttaaatgtataattaaaataataaataacaacctattatccctcaaagaaaaaggaaaagtataggtttttattcgatgactcagcagttttctatctggtctcgttaccttcaattctttctctttatttctatcagagctatctttctaaaacctaaactggatctggttaaaatctttcactaactccccatgttagcatggcatacaaaccttgtgatatggcagcttttttccctccgtctagcacaattcttccatcaaactgttttctctagctatgctgaacaatgtacagttccagaattcacagtgtcttctctctctctctcttttttttttttttgaaatggagtctcgctctgtcacccaggctggagtgcagtgacgcgatttcggctcactggaagctccgcctcccgggttcacgccattctcctgccttagcctcccgagtagctgggactataggcgcccgcctccacgcctgactaatattttgtatttttagtagagacggggtttcactgtgttagccaggatggtcttgatctcctgacctcgtgatccgcccgcctcggccccccagagtgctgggattacaggcgtgagccaccgcgcctggcccacagtgctttctcttatctctgggccttaatacggactgttttgtttacttagaactgtaattctcaaactttttggtttcaggatctctttacacttttaaaaataattgaggatttcattgagctttaggtaggatatatctatcaaattgttactgaaactctaggggtttggtataggtcccattgcttgcccctcagaaagctgatcactgagactacgagtattgccagggaacaaggctttaatcgggtgctgaagctgaggacatgggagatcagtcccaaattcatctcccgggactgactaaaattgggggtttctatagcagggaagaaacgtaaccatgtgtgggaaaacaggaattagggagggctaaggaaaaggaattggttagtaggaagcagatggttggacaggtaatcatgacaggtgagtgcacaaattttaagactgggggggtcgatttctatgtttattcaaagaaaccataaacatcagttctatgggacaagtggactactttcaaaatactttcaaaatgttactatatttgaatttaaaacagaaaatttaaacattaattcatttaaaataacaataatcagcctatagcatattaacacaaacagcttttttttttttatttttttttggagacagagtctggctctgtcgctcgggctggaatgcagtggtgcaatctcgggtaactctacctcctcctcccgggttcaagcgattcttcttcctcagcctcctgagtagctgggattacaggcatgcaccaccacgcccagctaatttttgtatttttagtagagatggggttttgccatgttggtcaggctggtcttgaactcctgacctaaagtgatctgcccgcctgggcctcccaaagtgttaggattacaggcatgagccaccgtgcctggcctaaagagcatttttattaaaaatattttctaaaaaccaaaataattagtgacaatagtagcattgttttacacttttgcatatctttttaatctctagcttagtaatagaagacagatgaattctcatatttgcttttgcattcagactgttacaaaatgttgctttagttgaagaatatgaaggaagtctatccttacacagatacgtagttcaaaaaacaggaatattttaaattgccttttcaggtatttatttcaccaaaactagagaaatagtagtttcttacaggttagttgcattgtgaaatctaaaactacatcagtgaacttttcagagtcttttatattaaagttcacaggtctatgtgcactacgaaaggacattttaccctcgtatgatttatgcagaaaatggtgcttcacttaagtatagcaggtcttccaaatgtgtatttcatgatacagtatcaaaagatcacgttcattaatatcaccacagatcttatcagaaaagtcttttttttgtttgtttgtttgagatggaatcttgctgtgtcaccaggctggagttcagtggcgtgatcttggctcactgcaacctctacctcccgggttcaagtgattctcctgcctcagcctcccaagtagctgggactacagacgtgcgccaccatgcccagctaatttttgtatttttagtagagacggggtttcaccatgttggccaggatggtctcgatctcttgacctcgtgatctgcctgcctcggcctcccaaagtgttgggattacaggcgtgagccaccgcgcctggcccagaaaagtctttaagaatcgagaagctctcaggctcatggatgaagtatgttttcctcctttttttcccatactgcacagatgtagagttttccaaaattttaatttttcatgtgaaagcttgactttttatcactgataacaaatactatcacttgttttccttgaagtaacaggctcattttgttcatttttgagaaaatttctgccaaatacccaagtctgaacaaccaggatttgtgcattagttctttcaagtaaaaatggtgttttataaaaaaaaaacagctagttgagcttgcatgtcaaataatcttccagtgcttttctttaagacaactttcatgcttttgcagaaattttttatgcatactttctagtttgtacatagaatattaaaaaggcatgtacttatggggcaaggggtaagatttaatgaaattaatatttactgtatcttcaagaatatttgtaagtgaaactggctgtattagtcagcttgggctgtcataacaaaatatgcaaactggggtggcttaaacaactgttttctcgcagttctggaggctcagaagtccaagatcaaggtgctggccaatttggctcctggtgagggctcccttcccttccagatttttgccttctcggggtgaccttatatggctgggagagacagactctatggtgtcttttgaagagcaaacatttaaaattttgataaagtgtaacatcaaattttttctttaatagctcatatattttatgtcatatttaggaaatttttacctaacccagggtcactaagattatctcctatattttcttctggaagttttatagttttagctcttacatttaggtctatggcccattctgagttaatgagttaatttttctaatggtgtgaggaaaggttcatttttttgtatatgagttgtatatgaatatcgaagtattccagcaccatttattaaaaagattatattttctccaatgaattgccttgccaccttgttgaaaatgaattggccatgtatgtgcatatttctagattcttatattccatcattgtatatatgtatctttatgctaatatcacactgtcttaatgactgtagctttaccataaatcttaaaatcaggtagagtaagtcctccaacttagtttttctttttcaaagttgttttcgctatttcatgtttcttcatagctatgtgatcttgggcaggttacttgtcttctctgtgcttagtttccagatttgtaaaatgaagaataatattagactcttaggaggattaaatgaataaaactcttacaactgtgcccggcacataggaagaactccataaatattagctaatcttagtaattttgggtatatttaatgaggtaaatattggatttatccttaatcctggcaaaaaataatcttaaaataggaaactatattattatttataactatattattatatattattattaactatattattatcgagacaacatttcaacaaatttagttcaaatatcaaattaacttttattaatgattcatgaacagggcagtatctcctctaaaaatttagaaaaggggctccggtgagctgagtggaggagattggctttataggtagggaagggcggaagaaagcagaaacaagaaactgaagcagattggttgttttgaagttactttccttgtagggtcagaacagaggagacttcttttcatgctggctgaaactggcccatttggagatttggctgttatctctcttgacttctcagaaggtcagataactgacttagttttagtttggtgacctggagctttagcctgagtgactccattttggtttagtctactggggcctagcgcaggaactcagttgaaatcaaaggccttctataaattttatttaacactattttaagatacaagcaaaaatgtaaacatccctcaatacaattctagcaaatggcataaatatatatatatttaattaatatatataatatataattatatataatatttaatatatttaaataatatatttaatatattattaaaataaatatatatacatatatatgtttatcccagaaatagaccagtcttatctataatattatttataagaaaatgataactggaattacccataggagcacattagtagacattcaaagccttttgataaaattatctaattttttttagtatctaatcttgatcacccccccgaacaattaaaaatagagtgtttctgctgggcgcagtggctcacagctgtaatcccagcactttgggcggctgaggcaggtggatcacgaggtcaggagttcgagaccagcctgaccaacatggtgacaccccgtctctactaaaaatacaaaaattagccgggtgtgatggtgtgtgcctgtaatcccagctactcaggaggctgaggcaggagaatcgcttgaacccggggggcggaggttgcagtgagccgagatcgtgccactgcattccagcctgggcaacagagtgagattctgtctcaataataataataaaaaaaagagtgtttctaacttttgttaatgtcttcatttacaaccaagagaagcattagggttatatttcttgaaaaataagaaaaagaaacactgttcttaggcctctagaatcctctagaaccactgttcgtttttatactattggatattcttgtcttacagaaagaccagatctgaacattttttttaaaaagatgaatataggtccccatgactcccacggcaacactgagtggccttgttctacctggctcactttgctaatacagtggggttttttttctttctcttctgtccttatgtgtaaggcagaatacaagggcctgaagcccccgcccctcctgcatttgacaacagggttggacattgtgtattgagtttttttgtttacattgttctgattaaagtatgcaaaataaaaagatgcagttttatataacagaagatggatatagaaacattataaatggtaaaagcttttataattgtttgctgatgagaatatgaaatgatatattttggaaaattgtttggcagtatataaagctgaacctatgtataccctgtgacccagttattcacttctaggcacagaaacaagggaagtgtggacatatgtttaccaaaaaactcatactagaatgctcgtagtggcactattcataataggtccagattatgggaaactggaactaaagaaaacaaatgccgtcaacagtggaactgataaataaattgtggtatattcaacaatggactgttattctgtaatgagattgaacaatgggatattatgctgcaatgagaattaatgaacagttacccacagctatatggataaaccccacaaacataatgtttttttttgagacagggtctcactctgtcacccaggctagagtgcagtggcatgatctcagctgactgcaacctccgcctcctgggttcaagcgattctcatgcctcagcctcccaagtagcagggattacaggtgcacttcaccacacccgactaatttttttgtatttttagtacagacatggtttcgccatgttggccaggatgcacaaacataatgttgagtgaaagaagccagaggcaaaagactgcatactataatagactatatagatagtttatatatgtatacacacatacatatataaaacaggcacaatttaccattgaggggttagggactagacagtggctgtaggatgttttctagggtgctgattataagtataaatttacatttttctgtatattattatatttaaatagaaagttgtaaaaaatgtttggtagtaaatttctaacttaaaactaagcaaatgatacacaattgagatcccggaaatagatgccaaagaacaaatctatttaatctgtgacaaactaagtgtaacaaagtaagcatggcacatgtatacatatgtaactaacctgcacattgtgcacatgtaccctaaaactttataataataataaataaataaataaataaataaataaaattcattaattgagataactagatttcaatatggcaaaaataaatttaggttcatgcctcataccatatggtacattgaattgtagtttgaattaaaatattaataaaatattaatgtattttttataactaaagtataattatggctgagataattttacatataaaaattgatatagatctgtaagggcagattgatgcataaatagatgttggtttttaaaatttgtgtacaacaaataacacagataaaaggaaaatgacagaataaggacgattatgatgaatatgatgaataaagcttaatatgatatgtacagaaaataaatgacacaaatttatgttacagtcctgtcaagcagtcaaaggaaatgatttaagagtttgttcatgtgcaacattcttcataaaggtgaaaaattagaatcaatccacatgcccatcaataagggaacaattaataaattatggtatttctatgatagatactacgatgtagccattacaaagaattagatttgttaatatggaaagatgtacatgaagtattaagtgaaaaaatgagttgtagaataaagtacatatgtatagtgtcattacacttttctacaaaacaagttaatgcaacatttgtcaacaagtatatggtcacatgtagtgtaagttatggaaggtatagatcaaactgttagcagtgaatactctggggaattggcataagagggcgcttatcctgtttttacttcacaccctcctgtattgttctgtttcattgatgtgtgcttttacaattaaaaattttaaactatatataaaggagaaaggtaagttaactaaatattcacatttaccaataaataaaccactggaaataagatacttttgagttagttaaaacacagaactttatattgggacatctgcaaggaaattggtctcttccgtttcttggatgtaatataatctggtgtaatctttctggaaagtaatctgacaatacataacaggagccataaaaatgagcatatcttttgatcctagagccttacttctgggaatataccctaaggaagtaactcaaaagagaaaagaaatttgcttgtgcaaatatatttatagccacattattttaagcagaaaactgaaaataatccaaaaagaattctgtatttaagcaatattttaaaatgcagtaatacattgatcttctaattttttttttttaagtattgctgggtgcagtggctcacgccagtaatctcaaccctttgggaggccaaggcaggaggatcgcttgagcctaggagtttgagaccaccctgggcaacacagtgagaccctgtctctgcaaaaactttttaaaaattaggcaggtgtggtggtgtggcacttgtggtcctagctacttgggaggctgagataggagaatagtgagagcctgggaggttgaggctgcagtgagccgtgattgtgccactgcacttcagcaagcaacacagcgagaccttgtctcaaaaagaaaaaagctaggtgacctaataagattgccatcagcttcatccttttataatgtcaaaaaaatgaaattaaaagtaaagtttcttttatcttttccctatagtaccattcaaattcttctgctcagtttaacatttttcttcaacttggtccctctaacaagactttttactgggtcattttgttttggaaagacaaagtatgaatttagagaagtagaagagagtatagtaattttttctccttatctatttatagtaaacattatagaagcaaaatatttacttacacttaatcaggtttccaaattgtcctggagagtagaatatcctcctccatgatctagtgaggaggttaagttggaggttaaataccttgcataataccccaaagagataggacagggattagagaccaggtcttatataatgagacccccttgctagggttgttgagcattggtgcctgtctgtgggatggcagtgcagggctgggatcaattctctgtttaagagcaagtctgaaggtcagttctttcctttttgagctgggctatttgagcggtacagtgtacactttctgaagagatttctggaagcaattgcagaagtttcttatacagggtagaatctgacctaagctgtccaaagagaaatggcccttagagagaagttgtgcttcccctttgctacctcatattttatgtgctgcctctcatttgttccttttcctctctagttcaaaatgcaggatctgagaaggagacggagctgtcatcagttctaaacctgaacagaatgtttcctcagttagtaaatggaaaaattattttaaaaaatcttcatgtatgtttgtgaaataccaagacattgatttgtggtctagtttgcaatcatgataattatattaattagtaccaatcatgatcattttaaactttctgaatttctctatcctaattctgtgattcagtggaaaatatttatactcaagagattaaggttcaattttctgccctaccacttaacaactgtgtgaccttgggcagtttcttcactggtaatatggagataataatcccagccttatctgactcctaggtttgttgtaaggttcaatgagataatgtatgtgaaagtattcggtaaactttcaagagcaatacaaatgtttttgttgaagttatgaaagtcattaccctgtttaaaacacagtaagcactgaagatgtcagtacgtctcttaagattctaaaatagtgtcaagaaatgttctatcctatcctagcatgcgctaacctaggtctgtgaataggccaaggagccctctccttggttgattggttgcttgccagatatattagtttgatctcttcatttatactttctggaaaatatatggatgctttatgttaggtttgtctgcatacaacagagaaacctaaaataccgtggtttaaacaagatagaagattatttctctttcatggaaaacaagtctgaaaataggcagtccacagctggtagagtatactccagggtttcatcaggactcaagcatatatttttctgtgccaacatcctcaccatagaatccattctttacctcatgacccatgaggactgaaggaactcctttttatccattgggataaataaaggatatctcaactgaatcagtcccatttaagtactttctagaaaatccacacagtattttgcttacattttataactgagtcacatgactaaagactagctacaagagaagctgagaaatataatctttatgccagtgaccatgaacccaggtatgtatactggagggtgtatgtgtgtgtgtgtgtgtgtctgtgtgtgtctgtgtgtctgtgtgtgttgaagagggtaatttataaccaaaaacattcatatttttatataatgctgtggcagagacttcaagttgcaaacttcaatggcttcttcttccttagaaacgtacttgcagttttggccagtcatggtggctcacacctgtaatcccagtgctttgggaaactgaggtgggaagattgcttgaggctggaagtttgagactaccctgggcaacatagcaagaccctgtctctaccaaaaaacaaaaacaaaaaattaaactgggtttggtggtgcacacctgtagtcccagctactccagggggctgaggcaggaggattccttgagcccagctgtggaggttgcgatgagctatgattgcaccacactgcactccactgtgggcaacagagcaagaccttgtctcaaaaatgaaacaggcctggcgcagtggctcacgcctgtaatcccagcactttggaaggccgaggcgggcagatcgcttgaggtcaagagttcgagaccagcctgtccaagatggtgcaaccccgtctctactaaaaatacaaaaattatccaggcgtggtgccaggcgcctgtaatcccagctacttgggaggctgaggcaggagaatcacttgaatctgggagcagaggttgcagtgagcagagaccttgccattgcactccagcctgggcaaaagagcgagactctgtctcaaaaaaaaaaaaaaaagaaagaaaaagaaacaggccaggcatggtgactaacacctgtaatcccagcactttgggaggccgaggtgggtggttcacttgagatcaggagtttgagaccagcctggccaacatggtgaaaccccatctataccaaaaaacaaaacaaaacaaaacaaaaattagctgggtgtggtggtgtgcacctgtagtcccagctacttgggaggctgaggtgggaggctcgcttgaacctgggaggtagaggttgcagtgagctgagatcatgccactgcattccagtctgggtgacagagtgagactctatctcaaaacacacacacacacacacacacacacacacacacacacacacacacaatactccaatttttacctggagattcgagaaattagggaagaaaccaaagaaaatatatttccttataaaataaatattaaaataaagaaaaaaaagtctgggtgcagtggctcacacctgtaatcccagcactttggggaggctgaggcaggaggattgcttgagcccaggagtttgacaccagccatagtgagaccctgtctctacaaaaaaatttaaaagttagccaggcatggtggtgcacacttgtaatcccagctgctcaggaggctgagataggaggattgcttgaacctgggaggtcaaggctgcagtgagccatgatcacaccactgcactccagcctgggcgacagagcatgaccctctctcaaaaaaattttaaaagttagaaaatatatttctatagtgcaataacaaagtgatttgtgcagggaaaactaaaaattctggagacattttttaagctcagcagtatttgcataaagaaatatttataatgtgaaaacaaagtacttcatttaattttgaaagatgtattaagcaaaaaaggaaagaaaaatgagaggaaaaatgctagaaatacagggggtacattggtttaatttgaaccctcttatgtatatgtatctttagctccttttactttagcttttctcgtctctttggaaatgaaaatattcagttgttgccatgattttgcttgctttgtacaaatgaaatgttggctttatggttatagacagaaatatggaaaactttagagctactttgagcaagcccaagaactttgaatcattgaatcaagaggagaaaaaatgaagaaaatatttcaagttctttatctgtaaaatgatggagataaacaatatgatctgaaagtctttcaacttcttaagtttttataattcaggagcagtggtaagaatagtaatgaagtttctaactactacttccaagttaagtacaatccagagaggccagtgggacagaatctgtgggacgatgtgggaggacttaagtgattttaagtcctggtgaagaggaatagtgtgttcaatggaaattgaggaagacaaggacttttcaggtcagggggcttaatgggtcatcattgtgtttgttacagagttttaggagagtggtggagaaaaagatggagaaaaagaaaatggactatgtgctcctaggaagagagatgtgattgttttctaacatgtaggcaatgaaccctcagaggaactatagatgagcattagggtgttcttgaatgctctaaaattatatgcaacatattatattcgtttttctgtgagaaagcatttgtagctttaatcagattcttattgtaagctaacaaagccacttgctcttaaaaatgaataataaagactttaaatgattaaaaacagaaaaagtgacacttcagtggtcctgcagtgggtgaatatagtcattgtgatattttcagagtaagctaggtttcagtcacacacacacacacacacacacacacacagtacacacacacacacaatgagagaaatgtatagaatcgtggggaatttgctgtacagttttgggttttggcttgctattattagctgcaccttgggcatgttacagaacctccctaagcttcaatttcctctgctataaaataaggataaaagtaccttaaatggtggttgtgaaaattagagacaatgtaagttgagtacatagtacagtgcttggcacagaataggtatttggtaaccctttccccacatgagttttttaagtttctgtatttactttaaggcccttattgtatgcagtcatccatgagtatatgcagggggttagttccagggctctctgagtataccaaaatctgtgcatactcaagtcctgcagttggccctgtggaacccgaatctacgagaagttgaccctccctatacgtgtgttttgcttcctgagaatactgaagtttcgacctacatttggttggaaaaaaccctcacttttaagtggacccaagctattgaaatccgtattgttcaagggtcaatcgtatttcactttgaaggactggtcctcagcaagttcatcttctgaactactcagtgatgctcacactcaagaagaccatatcttattaagtggttagtttagaagctctttcccatgcagatttgcaagcggagtgtgtaaaaatcacacattgcacttgttgcctggcagcacgtgtccctgagtggtagtacatggcttgcattgtaatgttatcagtgctggggccagctggctagacatgtactgctacatgggctagggactccattcctcaacaaaacagcagccagcactagggttaacagaaaatgacaaaccaggaatggatgagggaggcgccagcacagcagcgggatgtcttttgatttgcttctgttatttgcatgtctctcttgtgatgtctgtgaaatgtttagaatgacaaagtttttaaaagacctgctgactccgcctgaaaaatgtgaaaaacctcccatttagagacctattatgtccagctagcctgcattttctatatctttttctttattttttattaatgcaaacatttgcatgaagacagaacctttgtttcttaaagagttcatctgctcctgctgcttactggccctgccatgcaagagcacaacagaacctttgttaggctttcagcaaagctgtttatgaacggtggcttactgaggactgcttcctgtgctgtgtgcttccattttgtctaaaaagaaaaaaagaaaatagttattaggagtaaaaagaatttggactttcttttattcaagtcctggatgttgaaatgacaagtagcccccaaatttgtgaggaactggtaattgcatcgaatgcattttttcgctttaccttgaacataatgaggctcttagtaacaatagaaggaacaagtgccttctcattggaatagagagaaggaacagtagtaaaaaggcaacagaaagagtagttgagaacaggacaaaagtggcttccagtaagaacactaacattgtaatagaatgtgttttgatatttagcgtttcccacctgggaggcacagtcctaaagtggttgagttgaataaagaacagcatcacagtttataaatagtggatacagtttgtatgttcattaagtaaatatttgaatgtctaccatgtgaaagacactgaatggtcctgagtgttaaaggaaataaaagataaatgagtcatggtgcctatctttaaggatcaggacatccaacaaagaagataacatacgcataacagaaataactgtgtatcaaggtagaaagtgccactggaaatatttaaaatagatgtttagggagtttgggaaaagggaagatcacttctggctgggacagaatcagggaaaggttcacaaagaaggtggcatttgagttgggcctggcagaaaaggtaggactgaacattgcaacattcctaaaagtgatgagtcaaaaattatgttgttctagtaaaacagatccaaagtatgtttttatagggtactttggtggtgtttttataccattaatttagatgatatgttaagtgttatgagttttctgtgtagactaaactggggcctctctgtctagtctatgttgttccaaccatttgccccatacggtttttgtgcactttggcctaggcctttttgtatctataaatatctacaatagcatcctttactttcataacaaaaatagaaactcaaagggattattgagcactattacagctatatcccataaacagtatgtggagatagttcttagtggggatttcacatgtgagactcttatttgaaaaagaatccccaccttcgtgcagagccacatcaaccacaagagagaggacagggaattctaagcccgtgagttttcagttactttaaattagaacttttctgtatctttttgtcattagaaaaaatgagatcctgttactgttagttcagttgtgaatgccaactaatttttatgtaatatttttaatgtaaaatgccaagcaaatgattaagctgttgtattagtatcttattgcattaatatcactattctgtatattcatagttaaattgcatattaccaattaatattaatctgtaaatttaatgataattgataaatacatggtttgcccccaaaggctatactttttcttttttttaaagagacaggagtcctactatgttggtcttgaactcctgggctcaagggatcatcctgcctcagcctcctgagtaactgggaccataggcatgcatcaccatgcccggctgcaagactacaactcgtgctatagcacaattaattttcaccttgtaattttattacttccctgtttgaaaacatgagtggcatatgatttactacatgtttagcaatttacaggattttttttttacccatgatactttctggaaaatagttatgtgaatgtttatggcgttgacttgataactatactgctttattagtaactatttttgcaaagttattgccatgacaaatattacttgggttcttcatatgtcccttagattgtaactgtgggaaacttaagtgctactttagatttctctggtgttcaggaagtacattttgttatggtcagctagctgagtgctttaagtttgaactatgaaaatctccttaaaaaaaaaaaggacgcggtggcttatgcctgtaatcgcagcactttgggaggccaaggcaggcggatcacctgaggtcaagagtttgagaccagcctggccaacatggtgaaaccctgtctctactaaaagtacaaaaattagctgagcatggtggcgggcgcctgtaatcccacctactcaggaggctgaggcaggagaatcgcttgaaccctggaggtggaggttgcagtgagccgcgatcacgccactacactccagcctgggtgacaacagcgagactctgacttaaaataaaaaagattctgtagtttctggcacttgaaattgcaggactccaacctacaaatgctgtattattatgagatttaggctggaaatactgaggcagtaggatttaagcacttacccttaattgacatcccaaaactatatataaaacaaacaaacaaacaaaaaaacaaaaaaacccaccagttttaggaaagagaagggaagaggggaggattaatggttgaccagagactgttttgagtgtcaaggcactcagcttttcacagctattaaccagtacaataccccttttggttgagggaaatagactttagtttttcatcctctacttaacataaagatctttagacacctcttgttttctggttgtcacaggtgatgttagcatatgtgtaatgctttgtttgcctctggcgtgtcttttagtatttgagtttgactagccgtatagcaggactttagtggtttggatgcatagatgcaatgtattgcttttgtctgttttataattaacaattataaaataaaaggtcattccttaatttgcaaatttgttctcagaaagttctgtttgatacatgtcatactgcatggctctttaaaggtggcagtatcatgcagtacagactggaatataggataataggcttatacacttggagtagagaaggcctttttgaataggacacaaagcacaccaaaaaaaagccacagatacattattttgactgtatcaacacttaaaacttctgtaaaatgaaagataccacagacaagttaaaagaagaccatgaagtagatgtatgtatttgtgacatgtatagaattatctacaagtcaagaagaagaaaaaaagacaaccagagaagaaaattggcaaaggataagaaatacaaataaacatgaaaatgtgcttaactttatttgtaatcaagaaaagtaaaattaaaacaacagagaaaagctattttctaactattaaatcggcaaaattaaaaagcattaggccaaggatagtgaaaatagatactcatacagctggtggtgtgtaaattggaataactaatttgtaaaagcaattgtctatctctggtaaacatgaagatatcctgtgcatcctatgaaatgccaattccatcttgaggaatctaccttagaaaaactcttgcacatatatacaaggaaacacgtacaagaatgttcaacacagcccagtttattatagtgaaaacatggaaacaacctaaatgtttatcagtagggaaatatttaccattgggaactatcaaaaaggtaagtaggttccatattgttttataaaagatctccagacattgttgattaaaaaaaaaaaagatgcagaaaggatatatcagacacttaaaaacaacttaaaacatgaaaacagaacaagctcacaaactatatttctgtatttttgaaaatatgtaccccaaactgataatagttgttatctatgggaactggaattagtctttagctttatctgtattgtttgaacctttaaaaattattgtgtgtttaactagaaataaacatttttaaaaatttaaagatcataccagtactttgatttaccaatttaagcttcttaatactataaagtattaacagggaagagccagcaatttctagataatacaacgtaagatggggcactttgtaggtttttggatttttcttgttttgctttcatttttggttttgagaggtagtggggtgaatggaagaatacgggctttggagtcaaatctaagtttgaatccaagctctgccatttatttagactttgggcaggtttcttaacctctctagtttttaaaaaaattgctattacctacttcgttgggttgtataagaattacatgtgctagatttcctcatttccccattccctttggttaagggaaattggtctagtgtggtctaagatcaaagatggtctcgtatggatgacaaaatgtttcacaagaacacactatatccttggaccaggatataccagtaaagatggaggatgtaaataataaattttagaggtctattaactgtttaaaccattaagctatctatttgtacctcacaagatcaaatactagattatgttagtgatttataaatgatattgaacttgaaacttctaagcagtttacatgacaggttgttgattaacaggtttacttttttttttaaatctcagagaacattttaatttagttcagcaaacatttatttgtgccatccagcatctcaatctcaagaggcctcatagaccaaaatatgtctcaaaaggaagaaaggaaaactctatgtatttatcaatttatttatcaaactctggcaaggggggaaaaagtcaggtttaaagttgagtatatgtatatactctgcttttcacttgtactgctattgcctatgtgtgcatctgttaatatcatatatagcaattcatatgaagattttttccagtgagacttagttattctattattgggactctgtattaaataataatttttaaaaaagagtgctctaactaatgttaaggtggaaattctagacccctcaaacaaaaatttccaaataggaccccttatcatttaattgtgaaataaacaactaatgcttttatggtatttatgcttgggaagagaataaaataaatagttttggattttccccatataaattagggcctgctgagtaattagcagttaataagtgaatgcttcctacaagtttaaaggtcatacctgaaatgggtatatgatgatgtatatttttatagttatagattttatatagcccaagaatccttgaagatagtctaaacatcttggtttgatgagcagaactttcaataagggggtaaggggctaatattgtttgagcacttactatgtgccaagcactattctaagatgattacatagattattttatttaatcttcaccacagtcttctgtggtaggtactagtattgcccaattttatagaaaagggcagagagataaggtaacttatatgaagttacacagtcagtaaatgacagagctagaaatcatatccaggttcagttggctcaagaacccatattcttaaccattgcagtaaaaattgttatgctgttttaatctgtagagtcagcatgtagcaataataatataatcattaacatgttacattttgcatatattgaatgctttctaaagaagtagtttattatcagacatattcttagaatcatacccattttatagcaggattgacagtgttataaagagattacgtgatcaacatggggtgagtcaacagaaccaagaagtttctgatccacaattgccttcacttgctaggttcaagtaaggatcatatagtgtttacttacatttgccttagatttttcagtatagcatgatgaaattctaaatgcttatctcagacagtgatgctatctgagcaagacatggacaattgggcattagtgtgaattttaggacactagagcgtaggtacaggttagaaaacttaatcctcatcttgtggaagtcatggcaaagccaaagaggaaaagcctgtcttaaatgcttttccttttccaaggggcagctaaggtgcccagatatctttgccctccagggatgcaggtgtgctgttttttattctttaatcattcacataaattaaagcctattcctttgcattaaaaaaaatgtaaaatgacactctccgtgttttattgccaggcaagagctttgaacttctgtctcattgaagtttgataaactaaggattttcccgtgttgggtggtacccttaaccacagagggagcattagactgataagagctgcaggtgaaggaaaccaccagggcacggcaattagggagagcttcgcacttggctgttggctggtgtaaaactctctgcagggaggaacttttcttcttagcttcttcccttcacccacacgtaaaaagaacaccagggctttctatttctactttgcgaactaggaatggatgggatggttcttttcaagaaactttcaaatttagggacaagttctaacttcacacaaatgctgattggtatgaaggtggggggacaggacagacagacatacacacacataaattcacgtggacccaaatggaccatatctctcaggtgattttactatcaacatacattcctgcctttgtgcactgtgtaaaataaagataatttttacttccataactgattataaagtgttaatggtgaggcaacgtgttaagagaatgggttcttgtatcaggtaaaccttggttcaaatcttggcttctcttcccactagctgtgtaaattaattttgtaagtctcagttctcccacttgtaaaaatagaagtctaagaataactattataggattgtatttggaagaaatagaataaagcatgtgaaacaattagtacagtactatatctgtcacattgttgtttaataaattgtgcaagtactcaaaaatggtagctgttattatttgtaatatgaaactaaatatctgattggtagattaatgttaaacatgcatggtccaatatatttctttctttccttttttatatttttggtataaagtctattttcttgaaaattcctgctttttttttctagaaggacaaaagtactttgatttttactgctctgaaaatatttatcccgtaaaaagctttcacattaactttgagtccctggagctagggaggagaagcagcaggatttgctactaagtagagctctttcatttctaccatcaaaaagaaaaaaaaaaaaaatcctgtgctagccttaggtagagctaagtcataaaaggccatatagcctaaggaaggactctttttataagatcaggataaaccgatagaagaaaggaaggagaacacagaggtgaaaatgcagctgattttaatgtttccctggccattttccctcccaatttaatatacacctaattataattattatattttgaaaacaataccagaaattggcaggtattatctcacagcttcactcttagttttggccgtttcttaaagaaacagttttctagttggatgaactgttgagttgaggcactgattttgttttcacctctttttgggtggggttgggggtgggcagtcagggtttgcagtggtttatagttgttagttttgggaagcactcatttagatagaatgagtcacagaatgtaaacaggtcatccatctggactttaggctgctgggaacgtggtgaaaccttaggtcaccgcgatcattatggtcaaatgaagacttttgggctcaggttggcaggtaaacttacttgttttatgagcttcactagactaccaggacttcagaaatagttttttgaaataccaatatttataaattttaggtaattccatcatattttcctgaggaatgaaactgtgaaagaagtaaatgtctactttggcagcaacttcatagaattgctttttggaaggatattcatcactttggggttttttgttctcactgctccagatgaaagtatttttctgaattttttatggtaaatgtggacactgaattggaagcttctatgtaaagtttgtcaggaaacctctgtcatacctaaggataaaattcagagaaagggaagaagtatttgagtacctgacatctaagaagttctggcctatgttgtttactgagtaaactcccaataatgctttgagacaggcttttaaggaaacatgttatcaatcacgtactatgtaccaaacacatagtggtgttttacctgtattatcttatttatttctcataaccctataatgtaagtaccattattatccccattttaccatgaagaataggcttgaagaataatttgtttatggtcacataactaggaagtggcagagctgagaatggagctctcaactctctgtaatccaaagcccaggttcttaaccagtgattcttaaacttaagagtacataagaagcatcaggagtacttgttaaaaattactgggctgtagtaaaaaatgtaaggtcactaaatctgggacagtgccagactataaatctgcgttttaaacggcatcccaggggattcagatcaagaaattgattgaccatattttgagaaacatagttaaattatattgcttttcacacttgataaagaagaaaacaggtgtagactaagtaactatccaagattaagctaccaagacagagccatgattcaaactcaggtctgtctcactctaatactcatactttttattatacgcccatgattaactcacacatttccaagtcacaacaaatgcagaaaacatgacatctaataaaccaagccagatagatttcatggtcttgttatttaccaaagttaataacttatatatacaccagtacgaaaattttcatggtccttaaacctttccagtgactttttttttttttttctaatttaaattaactgagttttcttttttttctgttctgaaatgaagtctggctctgtcgcccaggctggagtgcaatggcatgatcttggctcactgcaacctccacctcccaggttcaagcaattcccctgccgcagcttcctgagtagctgggattactagctactcaggaagtagccactgcatctggctaatttttgtattattggtagagacaggttttcaccatgttgccaagctggtctcgaactcctgacctcaagtgatccacccgcctcagcctcccaaaatgctgggattacaggcctgagccactgtgcctggccagagttttctttacaatcataccatccatgcttcaagcatggaattactaactccctgggataagtttctgatgcagaaatggaaaagaatagaaggaggtagaaagaaaagaacttccaggtgtatctgctgaatggtgctaaatctcctcttcaacccacccttgtgattgagatgaagaatgaagggttgatgctaatactaacagccagtcaaatggcaattggtcatgttcacatcatctcccaatctatcctttgagactatagctcagttagggtcagcaagtttgctttgcctattccagtccactgatgaagtgtcatcagacagagccaacacctggattgccttacacatgacctcctactaggattgggatcattctttttaaaatctttctctcattttctctttctctcttgctatttgattgcagctcagcgacatgtcctcacctacatggaggatgcagtgtgccagctgctagaaaacagggaagatattagccaatatggaattgccaggttcttcactgaatagtaagtacatgaatgttgtactaatacagtgaacccagaggaggcgcttggaagcaggcaggatacttgaggaacagagcaggacaatgctgattaggtagtggcagtgaatgtttagttttggtaggttggttgtgggccgcccaaacatgttttggagcatgcctttggtgcagctagtttgtccagtgatgtctcatgaatagttttgattacagtagcttaacaactgcttgtttgatctattagatctatttctgtaggtttctcttttaactttctcctttattcaaaatattcactttgatttcctttcgctgatgttcatctagcctgttttttttcatggctggcttttctcatggaatctaggctaatgttcctctgcagttttctttctacaggatgctgtgccaatcacttaatgatttaagtgtatttctaatcagcaaagtgaagagacaacccacagaatgggagaaagtatttgcaaactacccatctgacaagggattaataaccagaatatataaggagctcaaatatctctataggaaaacatccaataatcccatcaaaaaatggacaaaagatgtgcatagacacttctcaaaacaagacatacaaatggcaaacaggcataagcaaaggtgctcaacatcattgatcatcagagaaatgcaaatcaaaactacaatgagataacatctcaccccagttacaatggcttgtatcctaaagacaggcaataacaaatgctggcgaggatgtggagaaagggaacccttctacactgttgatggggatgtaaattagtataaccactgtggagaacagtttggaggttcctcaaaaaactaggaatagggctgccatatgatccagcaattcaactgctgggtatatacccaaaagaaaggaaattagtgtatcgaataaatatcagtactcctatgtttgttacagcactgtttagagtactaagatttggaagcaatctaagtgtccatcaacagatgaatgggtaaagaaaatgtggtacatatacacaatggagtattatttggccctaagaaagaatgagatcctgtcatttgcaacaacatgaatggaactgaagatcattatgttaagtgaaataagccaggcacagaaagacaaacattggatgttctcacttgtttgtgggatgtaaaaatcaaaacaattaaactcatggacaaagagaatagaaggatggttaccagagattgggaagggtagcagggggctgggggaagaggtggggatggttgatggttacaaaaaagaaaaaaaagaatgaaaaagacctgctatttgatagcacaacagggtgactctagtcaatgataacttaattgttcattttaaaataactcaaagggtacatttagattgtttgtaacacaaaggaaaaatgcttgatggggtggataccctattctccatgatatgattagttaacattgcatgtctgtatcaaaacatattatgtgccctaaaaatatatacacctactatgtacccatgaaaattagaacttaaaaaaattttttaaaggaatatttctagagggaggatatctttcatagattatatatttgaaaggtcatacctaggccaggcatggtggctcaaacccgtaatcccagcactttgggaggctgaggtgggcagatcatgaggtcaggagttggagaccagcctgaccaacatgttgaaaccccatctctactaaaaatacaaaaatcagccaggcatggtggcacgcacctgtaatcccagctactagggaggctgaggcaggagaatcgcttgaacccagtaggcagaggtggcagtgagccaagatggtgccactgcactccagcctggccaacagagagagactccgtctcaaaaaaaaaaacaggtcatacttctttataaagtatacttagaatgtgtaaaagtcaaaatgattactaccttttttatttttctgagatagaattttactctgttgttaaggctggagtacagtggcatcatcatggctcattgtagccttgaactcctgggttcaaggaatcctcctgcctcagcctccccagtagctgggactacaggtatgtactatcatgctcagctaaatttaaaatttatcttttgtagagacagggtttcagtatgttgaccaggctggttttgaactgcaggcctcaagtaatcctctcaccttggcctctcaaagtgttgggattgtaggcatgagccaccatgcccaactgattaccactttttgaatatcacagaactgtttttaggctgaatgagataaacactttaaaaacacattaatattctttttcttccaacttttattttagatacagggaatacatgtgcaggtttgttacatgggtacattgcacccaggtagtgagcatagtacccaataggtagtttttgacccattacccctctcccttctcccctctagcagtccacagtgtctgttgctcccatgttcatgtccatgaatgctcaatgtttagctcccacttataagtgagaacatgtggtatttggttttctgtacctacattaattcacttaggattatggcctctagctccatccatgttgctacaaaggacatgatttcattcttttttatggctgcatagtactccatggtatatatgtaccatattttctttatccagttcaccttgatgggcacctaggttgactccatgtctttgctattgtgaatagtgcagcaatgaatgtacgagtgcatggggagaatgatgtattttcctttggcatacccactaatgaatgggactgctgagtcaaattgtagctctgttttaagttctttgagaaatctccaaactcatttccacagtagctgaattaatttacattcccaccaacagtgtataagcatcctcttttctcagcagccttgccagcatctgtgttttttcttttttgactttttaataatagtcattctgactggcatgagatggtatctcactgtggttttgatttgcatttctctgatgatgagtgataatgagcattttttcatatgtttcttggccacttatatatcttcttttgagaaaatgtctgttcatgtcctttgaccatttttaaatggggttatttcgtttttgcttcttaagttccttatagattctggatattagacctttgttggatgcatagtttgtgaatattttttcccattctgtaggttgtctattgatagtttcttttgctgtgcagaagctttttagtttaattaggtcccacttgtcagtttttgtttttgttgcaattgcttttggggacttggccaagaattatttgccaaggctgatgttgagaaggatatttcctaggttttcttctaggatttttatagtttgagatcttacatttaaatctttaatctatcttgaattaatttttgtatatagtgaaaggtaagggtccagtttcattcttctgcatatggctagccagttatcccagcaccatttattaaacagggagtcctttccccagtgcttgtttttgtcagccttgtcaaagataagattgttttaagtgtgtgctttatttttgagttttctgtactttccattggtctatgtttctgtttttgtaccggtaccatgcaaaacgcaatcttcatgaaaggatgtgctagagaaatacatatgccatcacatatttatataatcgtttggattctctttccttttcttctggtttttgggaacattctaagaaaggaagagtaatccttataggcttccatttaagtgaatcttgaactcaagttcatctttcttgaacatagtttttttttttttttttcctttctgttctccagaggctccttggagatcagacagctattcaaatggcctcaccttgggtttctgttaggggaatacttgagattccctagctcttttgctgaactctaaagttcttttcaatgaaatctagattttttatggattggcatttaggttcgttggaaaaagaagctttctgggagtaaagttgttcctttcacccagtcttctaaaggaggatgaagtagagaaaggaattttatttgttctcatgatgtgggctggagcaaatgaggtgggcagggaataaagactgagattgaatagccttgcttgcttttacagaacagacaagtgaactgacaagcctacgggtcaagtttctataccatttaatctgtaccagcactcttgaggctccttgccaagtgaaatatgactcttctgggggtaatgcttcttcctggcttttttcattttactcccctccccatctctgttacaagtcttttccctattacactggttgcttgaaggtaggcatcatttaaatttttttttgaggcagagtctccctctgttgcccaggccggagtgcagtggtgcaatcttggctcactgcaacctccgtctcccgggttcaagagattctcccgcctcagcctcccgagtagctgggattacaggcacccgccaccatacctggctaatttttgtatttttactagagacggggtttcaccgtgttagccaggcttgtcttgaactcctggcctcaagtgatctgcccgccttggcatcccaaagtgttgggattataggtgtgagccatttgtgcccggcctcatttattcttcatctttgcattcctggtacttggcatgatgctttgcatataatagatgttagctaaatatttattgaatcaacagcagtatctatattttaagttattgaatactatctactcttctagattttgttataataaggactactttcttgttttttcctccctttctttttttattttttttatttattattattttttattatactttaagttctagggtatatgtgcacaacatggaggtttgttacatatgtatacatgtgccatgttggtgtgctgcacccattaacttgtcatttacattgggtatatctactaatgctatcccttccccctccccccaccccaagacaggccccagtgtgtgatgtttcccatcctgtgtccaagtgttttcattgttcaatgcccacctatgagtgagaacatgcggtgtttggttttctctccttgtgacagtttgctcagagtgatggtttccagcttcatccatgtccctacaaaggacatgatctcatccttttttatggctgcatagtattccatggtgtatatgtgcccattttcttaacccagtctatcattgatggacatttgggttggttccaagtctttgctatcgtgaatagtgccacaataaacatacatgtgcatgtgtctttatagcagcatgatttataatcctttgggtatatacccagtaatgggatggctgggtcaaatggtatttctagttctagatccttgaggaatcgccacactgtcttccataatggttgaactagtttacagtcccaccaacagtgtaaaaatgttcctatttctccacatcctctccagcacctgttgtttcctgactttttaatgatcaccattctaactggtgtgaaatggtatctcattgtggttttgatttgcgttctctgatggccagtgatgatgagcattttttcatgtgtctgttggctgcataaatgtcttcttttgagaagtatctgttcgtatcctttgcccactttttgatggggttgtttgattttttcttgtaaatttgttgaagttctttgtagattctggatagtagccctttgtcagatgggtagattgcagaaattttctcccattctgtaggttgcctgttcactctgatggtagtttcttttgcagtgcagaagctctttagtttaattataccccatttctcagttttggcttttgttgccattgcttttggtgttttagacgtgaagaagtccttgcccatgcctgtcctgaatggtattgcctaggttttcttttcttttcttttctttttttttttgcctaggttttcttctagggtttttatggttttaggtctgacatttaagtctttaattcatcttgaattaatttttgtataaggtgtaaggaagggatccagtttcagctttctacatatggctagccagttttcccagaaccatttattaaatagggaatcctttccccatttcttgtttttgtcaggtttgtcaaagatcagatggttgtagatgtgtggtattatttctgagggctctgttctgttccattggtctatatctctgttttggtaccagtaccatgctgttttggttactgtagccttgtagtatagtttgaagtcagatagcatgatgtctccagctttgttcttttggcttaggattgtcttggaaatgagggctcttttttggttccatatgtactttaaagtagttttttccagttctgtgaagaaagtcattggtagcttgatggggatggcattgaatctataaattaccttgggcagtatggccattttcacgatattgattcttcccatccatgagcatggaatgttcttccttttgtttgtgtcctcttttatttcgttgagcagtggtttgtaattctccttgaagaggtccttcacatcccttgtaagttggattcctgggtattttattctctttgaagtaattgtgaatgggcgttcactcatgattttgctctcagtttgtctgttattggtgtataggaatgcttgtgatttttgcacattgattttgtatcctgagactttgctgaagttgcttatcagcttaaggagattttgggctgagatgatggggttttctaaatatataatcatgtcatctgcaaagagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagcttttgcccattcagtatgatattggctgtgggattgtcataaatagctcattattttgagatacaccccgtcaatacctgatttattgagagtttttagcaggaagggctgttgaattttgtcaaaggccttttctgcatctgttgagataatcatgtggtttttgtctttggttctgtttatatgatggattacatttattgatttgtgtatgttgaaccagtcttgcatcccagggatgaagcccacttgatcatggtggataagctttttgatgtactgctggattcggtttgccagtattttattgaggatttttgcatcgatgttcatcagggatattggtctaaaattctctttttttgttatgtctctgccaggctttggtatcaggatgatgctggcctcataaaatgagttagggaggattccctctttttctattgattggaatagtttcagaaggaatagtaccagctcctctttgtacctctggtagaattcagctgtgaatccatctggtcctggactttttttggttggtaggctattaattattgccttaatttcagagcctgttattggtctactcagggattcaacttcttcctggtttagtcttgggagagtgtatgtgtccaggaatttatccatttcttctagattttctagtttatttgcgtagaggtgtttatagcattctctgatggtagtttgtatttctgtgggatcagtggtaatatcccctttatcattttttattgcgtctatttgattcttctctcttttcttctttattagtcttgctagtggtctatcaattttgttgatcttttcaaaaaaccagctcctggattcattgattttttgaaagtttttttgtgtctctatctccttcagttctgctctgatcttagttatttcttgccttctgctagcttttgaatttgtttgctcttgcttctttagttcttttaattgtgatgttagggtgtcagttttagatctttcctgctttcccttgtgggcatttagtgctatcaatttccctctacacactgctttaaatgtgtcccagagattctggtatgttgtgtctttgttctcattggtttcaaagaacatctttatttctgccttcatttcattatgtacccagtagtcattcaggagcaagttgttcagtttccatgtagttgattggttttgagagagtttcttcatgctgagttctagtttgattgcactgtggtctgagagacagtttgttataatttctggtgttttacatttgctgaggagtgctttactaccaactatgtggtcaattttggaataagtgcgatgtggtgctgagtagaatgtatattctgttgatatggggtggagagttctgtagatgtctactaggtctgcttggtgcagagctgagttcaattcctggatatccttgttaactttctgtctcgttgatctgtcatatgttgacagtggggtgttaaagtctcccattattattgtgtgggagtctaagtctctttgtaggtctctaaggacttgctttatgaatctgggtgctcctgtattgggtgcgtatatatttaggatagttagctcttcttgttgaattgatccctttaccattatgtaatggccttctttgtctcttttgatctttgttggtttaaagtctgtttaatcaaagactaggattgcaacccctgcttttttttgttttccatttgcatggtagatcttcctccatccctttattttgagcctatgtgtgtctctgcatgtgagatgggtctcctgaatatagcacactgatgggtcttgactctttatccaatttgccagtctgtgtcttttaactggagcatttagcccatttacatttaaggttaatattgttttttattttattttatttttttttttgagacggagtttcgctctgtcgcccaggctggagtgcagtggtgcaatctcgactcactgcaagctccgcctcccgggttcacgccattctcctgcctcagcctcccgtctagctgggactacaggcacgcgccaccatgcccggctaatttttgtatttttagtagagacggggtttcaccatgttagccaggatggtctcgatctcctgacctcgtgatccgcccgtctcggtctcccaaagttaaggttaatattgttaatgtgtgaatttgatcctgtcattatgatgttagctgattattttgctctttagttgatgcagtttcttcctagcattgatggtctttacaatttggcatgtttttgcagtggctggtactggtttttcctttccacgtttagtgcttccttcaggggctcgcctggtggtgataaaatctctcagcatttgcttgtctgtaaaggattttatttctccttcacttatgaagcttagtttgactgggtatgaaattctgggttgaaaattcttttctttaagaatgttgaatattggcccccactctcttctggcttgtagagtttctgccaagagatctgctgttagtctgatgggcttccctttgcgggtaacccgacctttccctctggctgtccttaacattttttccttcatttcagctttgatgaatctgacaattttgtgtcttggagttgctcttctcgaggagtatctttgtggtgttctctgtatttcctgaatttgaatgttggctttcctcgctaggttggggaagttctcctggataatatcctgaagagtgttttccaacttggttctgttctccgcattactttcaggtacaccaatcagatgtagatttggtcttttcacatagtcccatatttcttggaggctttgttcgtttctttttactcttttttctctaaacttctcttcttgcttcatttcattcatttgatcttcaatcactcttacccttttttccagttgatcaaatcggctactgaagcttgtgtgtgtgtcacatagttcttgtgccatggttttcagctccatcaggtcatttaaggtcttttctacactggttattctagttagccattcgtctaatcatttttcaaggtttttagcttctttgcgatggattcggacatcctcctttagctcggagaagtttgttattacctatcgtctgaagccttcttctctcaactcgtcaaagtcgttctccgtccagctttcctctgttgctggcgaggatctgcgtttctttggagaaaaggcactctgatttttagaattttcagcttttctgctctggtttctccccatctttgtggttttatctacctttggtctttgatgatggtgacgtacagatggggttttggtgtggatgccctttctgtttgttagttttccttctaacagacaggaccctcagctgcaggtctgttggagtttgttggaggtccactccagaccctgtttgcctgggtatcaccagcggaggctgcagaaccgcaaatattgcagaggagcaaatgtagttgcctgatcgttcctctggaagctttgtctcagaggggcacccagccgtatgaagtgtcagtcggcccctactgggaggtgcttaccagttaggctactcgggggtcagggacccacttgaggaggcagtctttccattctcagatctcaaactccgtgctgggagatccattaccctcttcaaagctccgttggaaatgcggaaatcacccgtcttctgcgtcgctcacgctgggagctgtagactggagctgttcctattcggccatcttggaacctccccttttcctccctttcttgattctttgtggtaaagctctatattgtgccattttagaagctgtatactgtgcgccttgcactccaaaagtgaattccacttgttctgtgtagccaatgctgagctgtagtgaaccaacagtaaggctgactgtaggcagcttttatctaccaacacactgttgaaaaaaaatcgtaagattttctacagtgctgatagaaatgtacttgccaagcaggctgtttcttgtccccagaaagctgaaatttacataatatacgagtgacacatacctgacacttccataagtctatgacaccagattggcttgaggtaaattattctaagaagtgaaaagtaaaccagctccagaaacttttgggttttctttttttttgaagacctgaaaggtgtggatgtatgacagaatgggaaatagtgtaagtataatttggtagacaaggagacctggatgatggaagctcctgagtttactttgtgaatttgatttagttagtgaaaatccttcactttcaggcttcagtttttttgttttgtttttttttgttttttgagatggagtcttgctctgtcgcccaggctggggtgcagtggcgcgatctcggctcaccgcaagctccgcctctcaggttcacgacattctcccgcctcagcctcccgagtatctgggactacaggtgcccgccacatgcccggctaatttttgttttttgtatttttagtagagagggggcttcaccgtgttagccaggatggtctcgatttcctgaccttgtgatccgcctgcctcggccttccaaagtgctgggattacaggtgtgagccaccgcgcctggcctcaggcttcagttttgtattgattaataagagaaacatagtgaagtggaaagagcactaccctagaaggaaaaagagctgcttattcttctaagtcctcactctataaccctgggcaaatttctgaaatatgggcttcagttgcctcatctatgaagtgggtttaataaagccttacatgataataataataatataataattatatattataatatgcagtttttactaaactaataccatgtctcagctactacaattctttgagatgggtactattattattgttatctctgttttatagaggaggaagtggatgctcagaaagattaaaatagcttcttcaagttcacaagctgttaagtgacagactcaggaatcaagcctcatctgcagtattatagagtccactgttctctactgcctccaagccactttactgcttaatgttgctagagggctaaccagatcatatttggaggtttcttctagctataatttctactatttttgaattctcccttatgaactatactttgcaagcttatcacacagccttagctggtgacctcagtttactgccatttaaatgtttaatatggccttttgggggatgcaactagagctgactataaagagcaggaagcatgattttcaaaaatatgttaacggtatccttccatcttacagtttcgagttcacatcttgagactttcatatatttagccgtgggtgatttacctttaaacagtgataaaagtactccttgaaattgtatttggaaggcttctcttctgattttcttctctgggtctgcttgccctctcacctatgctgtctgtcactccttggttgttggtgttttcaaacaagtccatgactgttccagcaaatctggataaactgtaaaacacaagtggctgaacagtactttgtgtatgtctgcaagaccatgagctctgtagatcatattcctctggacactcttgaaagacggatactaaatcccagaggattttcttttatgttgtatgtaacctctacctctgaatgttgtccttcaaccagtggaaggtaaaagaaattaatatttagaggtgctactctaagaataggccaaatgtcagcactgggtcaggacctctgaagaaatacatccaagaaaatgggcgagagtagctctaacttagaaaccacagcagagtgtgaccagattcttgtggtaaagataaaatgagaaatgtggctttttgagacattggaaaataatgatgagagaaaaacaggatgaaatctgagaatttgtatcagaattgggaaccattcttcacaggctaaattgatagttccaacactatggcatcagggagcttgacttccacatactaatatagaaaagaataatattctgtggtcttggttggtgggcccaggagagctcgcttttatgatcaagtgtcttgttttcgttttttaaaggatgattttagttttttggtgaagtttttatgatgactgttttggttgcaagggaaagaagtacacagactacctttggtttattttaaggatacgtgagaatatgcagcattcatttgtgaattattcattcacaaattacttttgggcacctactctgtgcctgtgtgtactatgcaatgggaatagagcagtgagcaagacaaataaggtacctatctttatgaacctagtgttttaatgagggtaataatcaataaacaagcaaactgatggggatgagaatagctaatagttaataagcactgtgtgctaggcactgttctaagcatataatatccattattttatttaatcttcacagttctatataaacagggtattagtattatcctcattttactcataaggaaattcaggctataaaagtaacattctcatggttacatagctggtaactgtaacaagacaaataacaagaaaacagccagagtaaggtaatatatagtatggacagggaagtcctcttggaagagatgacgattgagagctcatcccatcagagagccaataacttagctcagagggtgatgcaccttttctttgtccaccttgattatctaagtaagcttcctgtgtccaaaaatgatcatttgattgattttatttgttgctactgagaatggagtacccttactaggcagtgttcttaggaccccctcatgggtaactggcctccctcatgctctgctcctatttaaccagtgaaagtaaataaaataattcatcatcaaaagtatttgtgttctacactacatagtataaatatggagatggaaatctttgtcagtttttagaaaaggagcattaataatttcattttgatacatgttaatcatcagaattaattttgattcaaataaatccataaaatatgaacttcattaattcatccttggagaaaaaaagagattccaatagtgcatacccgttttttttttcttttttcttttcttttactttaagttctgggatacatgtgtagaacgtgcaggtttgttacataggtaatagtgcatattcctaaataacttaaaacgtaactctaatgaaaacaatccatgattataaaatatgtatcatttcttgttattttttttttcagacaggtgctttaagccctatgaaaagatgacccacttctttcctacataatctataacaatcagggcataaacattcattctaaaggtgacagattttttaaggatcattcaccatctagagtttaaataatgttgtttggggttcttcttgtgtccatggtaacagaggagcaggtgtgaggcaacaagaagcacatcagaacaaaccaagacttcgctgatttccagcttgtagctctgaatgagagatggacttgagacttctttgggccatttctgctcatgttttctctacttatttacgttaaattgagccaaaatgtggtgtggtaaagtaatggtgactaatcctattatagacttcttcaaaaggggtaatgcttccccctttacccaccccctcccctgacttttttccatagttcagttcttagctgttaaacattgtaacagaaaattacccgtttctcattgtcagcatctggtttcccacagactcagataattgtcaggaagagatttgccttcagttaaagcaaccctatccccactgttactaggccaggcacctctgttagaccatcatagaaccaaatctatagaggattctttctggctcttttctgtattactagaggtatgctatagcaaaaagactacagggagccatggtggtgagttaagagtcaaaatctgttttgaaacttaaaaatccagggtcattgaggatgcaagaagttgcctgtttttgtagaatccatctcacttcttcagtccctttgtattatggttacaggaaactatccagcagcacttgacctggtaatggaggaagctatttcacagcccactggtcccttgactcgtttagaagtcagagtcaaaggttacagaagtaataattgggcccagattctccctgtcaggaaagaccttgttccccccaccccaccccctgccttctacaagttaagagaaacttatctgttataaaaccattcaataagaggaaatgaagaaacaccatccttggctgaagtgttctcaagccccaatgatactatttctgttttcatgggagctgcttttgcagctagctagtataaaatttaggtctgattttttacattaaaatatctccccttagataaataacttgatttatttcaatctataaataatatgaaggatctttatttggtccaagccctgatattccttcacaccaccactctgataattccctgaatacttgtctggcaatcaagtacactcacacgagtcttaattaacaagtgttatgccattagcaatgtaaagtcagtcatcaaaagttaagaaactaggccagattataggctcacacctataatcccagcactttgggaagccaaggtgggaaaatcacttgaggccaggagtttgaggccatcctgggcaacacaatgagacccctgtctctacaagaagaataagaagtttaaaaagctttacttcaccagcaacagaacaatttaaaattttcagtgcttttaatttcttccataatttgctcagaactctagcagatcaatctgtggtgccattggcacaggcttggcactggagtaggaaagaatgacacaatttggcacctttaaccagaagatctttaatgagctggcgtgggggtggaggggacagagaggaaggaaggacagttaggattttggcagtaacacaaaggttcttcttccctgagaaaagtgaaatgaaagtcaaatgaagcttcactctgcttttagaatttgctaagatgtttgtctgtctctcagctcccggcccccttgcaggtgcatcattatagtcagtgacttctccaaaaaacaaattgtctctcaggatccttcaggaggggtcatatctaaccaatttcttgtctgaggacataattgtgattcccttcttcaactatcagatgcaatgctaccagcactgcagaaactgtcttatcagaaagtggcacaaatgtgtacatttcttctaggtcacagttctagtattgctgagttctggggctgcaacaatagataatactacaatgagagatgtttgggaaaagcattgtttcctgggtggccgtagaagcagacttgaaatcatccctttgtcattaaataatatcaacaacaaatgtctttgttgatgtcattgtattgtaattttctaggtctagattattgctagggatgataatacctatcttctagggttgttatgcaaatcacatgaaattacacatgcaagatgtctggctatatataattcatcttcattgtgtgttgttctccttaagctccacttttctgggatttttgtatctctgtggatctggatagtcttccttttctctctctttaaatggcatcagagttgaagatcttgaggactttttagtctctcttttgttttttgttgttgttgttgttactggtttgtttttgtttttgtttttttgtttttgttttttttttttgagatagtgtctcactctgtcacccaggctggagttgtagcacaaacatggctcattgcagccttaacctgggctcaagcaatcctcctgcctcagcttcccatgtagccatgaccacaggtgcgtgccaccatacccagctaacttttttttttcttttttatagagacgggtctcattttattgctcaaactggtcttgaactcctgggctcatgttatgctcctgcctcagcctcccaaaatgctagaattacaggtgtgcgccactgtacctggcctctcttactttctataacacttctttcttgccctgtattttgtgtacgtttttggagactaaaacattcaatgattgcctgcatgactcttaaccacttcactcatcatttagttcattcacagaatagcctaagaaagcttttctatctttgttttctttgcatatgccattttctcacttcctgtctttaccccctttcctctagatacagaattttaaaactcaaggtgtagtgggagacttgagtcagtcaactctatccaacttgtgttgttcccactcttagctctagcagtacagtgatgggctcagggtaatgaaaagcagactttctctgctgaggtcattgctcctcatgctggcagcctgctccaggaagctgtttatctatgcttgcagagccaagctccagcctctgaacagttggaatgtattgagaaaccacagagcccaaagagagaacattacacaggcagttccaggcagggagagtatatttacaccagacaaactgcagcttacatgtgtggggataattgttcatctgcacactctcatactttaccttctatgcaatctatataccctctcaagaaggtttaaccaggagaacttgtactgctatgtccaaattaccctgaacatcccctaaaatgtcataaggaaaaagagatactacagaaaattgatgtaaaaactttttaagatagtggtttttttgtttttctgagtcaaattttatgtttagaatcttagaccatgtaagcctgatcactaaagcattcaaaaacactgtttcttgcatggaaatgtttttcttcatccctttacaaaaatattaagtattgttatagagcttcaaatgtgctctatattaataggaatataagatatggtcacttccctgtaagatgtaatctggttaaagaggtaaaactcattgaataacgaacaattacagagcaatacaagaccttatataatggcattaagttatatggcccagtacactgagaattgagagtaaggaaaaataatggctattagttaagtaaaattagttgagtcttatagaggagtttgtcttaattttggaaaggaaggtagagtttggataaacaaaacagaaaggagacatattttgcaacatgaaagcaccataacatagtggttaagaacatggactttggaatcagataggtctatgttagagggcctgccactttctggtatgagatcttgggcagattgcttacctcatctataaaatagggagactcatatataaaatataaaattccatgttacataattgttggaatgattaaatgagttaatgaaagtaaagtgcttggcatttcacttaagatacaataagtgttgaattaattagtagctactgctactactgttgttcactcattcattcaatatatatttattgagtgcctacgtcttagcgttctagatactagggatatagcagtgaaaaaaacagaccagaaatttcaactcttatggagcttccattctgaaattgttttcattttacctttttagaatgtgtgtgaataattttggacttacataaagtttaaaaaaatctatatatggagttcccacatccatttcatacagcttctactaatgttaacatttcctgtatccataatataactgccaaaatcaagaacttaacattaattcaaaactattaactaatctatacgtcttatttacattttcacctcatttttgaagggcagtttttttcctgagataaattctaggttggcagctgttttaccattccattatcttttggtttctactgactttgttgagaagttgctctcagttttattcttgcttctttgaaaataatctttttttaaatctctggatggtttttggatatttctacttggtctttggtttttgatagttttagtgtaatgtgtctagttttgcttttctttatatttaaactattcggtgttcttagtgcttcttgaacctatagcttgatatcatttatcagtcctggaaaactctcaataattagctcttcaaatttacttctgttctactctctctctgtctctgtctcttttttttttttgaggcaggatctctgtctgtcacccaggttggagtgcagtggtgcagtcatggctcactgcagcctctacctcctgggctcaggcaatcctcttgcctcactcagcctcccaagtggctgggaccacagttgcacgccaccacactcagctaatttttttttttttttttttagagatagggtcttgccatcttgcccagactggtctcaaactcctgggctcaagtgatcctcctgcctcgccctcccaaagtgctgggattacagacatgagccaacacgactggcctctaccctctctttactcctattgggattctaattacacaaacattagaccttttcatagtattctctgtctcttatgctcttttttgcattttctatcattttgtgtggttttttttttttttttttttttgagacagagtctcactctgtcacccaggctggagtgcagtagcactatcttggctcactgcaacccaggtttgcctcccaggttcaacccactctgccttcctggttcaagtgattcttctgcctcagcctcctgagtagctgggattacaggcgcccaccaccgtggctggctaatttgtgtttttagtagagatggggtttcaccatgttgggcaggctggtctcaaactcctgacctcaaatgatctgcctgcctcggcctcccaaagtgctggaattacagtcatgagccaccatgcccagcccatcattttgtagtttatgctttattctggatattttcttctgatctattttccaggtcattaattctctcttcatttctgtgtaatttactattaaacccatctactgagttcttaattctaattattgtatttttttagttcaagtatttttattcagtttttgtttgtttccttgctaaatcttgtctttcatttgcttgaacatagtaaataaagcatggttattacaaagtccataatttattgtctggataccctgtgggtctgtttctgttttctgtcctatccattttttttttactccattatcttatcttgtgttatacttttttttttctctagttgagttatgtaaattgtgtatgagttatgtaaattgaaaaactatacagataatgtgaggcccagaatgatgttatctttcttcggaggggatttatatttgcttttggcagatggcctgggcactagcaatcctggattacctcaatcccatgagggtttgaaaggatttgaatatagatttacatctcagggagggctgattttcagtatagctctgaggagtgccaaaagagctttagggtttaccagagtcccagcccccaacgtgggtgggtcctgaactctattttttttttcttttctttttgagactgagtctcactctgtcgcccaggctggagtgcagtggaatgatcttggctcactgcaacctctgcctcccgggttcaagtgattctcctgcctcagcctcccaagtagctgggattacaggcctgcgccaccatgccaggctaattttttgtttttagtagagacggggtttcaccgtgctggccaggctggtctcgaactcctgacctggtgatctgcccgccttggcctctcaaagtgctgggattacaggtgtgagccaccgcgcccagccaactctgattttttatctgcaagccctaacagtcatttgaaaactcaggaacttaacattaattcaaaattattaactgcttagtgtatcagttgaatcttccagaactggcagaggcccctagagctaccagtgatataataataccttatttctgaagtggtgataagtataaatgatattgtgagatatctggtatgacagtaatgttatatgaaaatatctgaggtttctttttttttattttaaagttttttgtaaagatttggtcttgctatattgcccaggctactctcaaactccagtcctcaagtcatcctcctgcctcagcctcctaaagtgctgggattacaggtgtgaaccactgtgcctagccaatatctgagatttctattattgaaagagtcacaggtactgttaattctgctatgcttatattcataatagaaggaaatgccaaattccagttagaggttagtaaaaataaacataaaaatttccctggctcatgcctcccagcactttgggaggctgagcaagcagatcacaaggtcaggagatcgagaccatcctggctaacacggtgaaaccccgtctctactaaaaatacaaaaaaattagctgggcgtagtggcaggctcctgtagtcccagcttctcaggaggctgaggcaggagaatgccaggaacccaggaggtggaacttgcagtgagccaagatcacaccactgcactccagcctgggcaacagagcaagactccatctaaaaaaaaaaaaaaaaatttccctatccaagtgtgtggatctcttgaatttaatccatggacccttctgtttagaaaccctacacattgggaaaagtggcactaaatgctcagctcacctttctcggttttattctctcataacttggccttgtcattcttcatttgccttggtggctctctgatgacttcagacaattgtctttaataatttatccatttttttctcagccagaagagttagtctgaattacctactctacttttattggaggaagaactcttttaaaacttgcattctgatggaacatattaataattagttgaagtagaaaatatcatacactgcaagggatcataaaggaatctaatttgactcatggaggactagtacaaggtaaaaagcaacaaacagaaaatatataatgaggatagggccagtttgtggaaggctcaattatattgaaataagtagaaaggtaaaatggctgagtgtggtggctcatgcctgtaatcccagcactttgggaggccaaggcgggagcatcagctggggtcaggagctcgagaccagtccggccaacatggtgaaaccccatttctactaaaaatagaaaaattaactgggtgtggtggcaggcgcctgtaatcccagccacttgggaggctgaggcagaagaattgcttgaacctgggaggcagaggttgcagggaggttgcagtgacccaagatcgcactactgcactctagcatgggcaacagagtgacagagtaagactctgtctcaaaaagaaaaaaaaaaggaagaggaagaaaggcaaagacagtacctcataaatgctgagaaactcattgtttggtcttctttcaatttttaaaattcagtaactatttattaaatagttatcatatgccaatcactgtgtgtcagatatggtcctcaagaaattcactgtcatgtaaaaattagatagtgacacaaatacaattaaaatagagcattagaagttctggactagtgagtaaactttgacaggaaaagtgattatttatacggtcaggaaagaattcacagaatagtgacattaatttagttttaaagaatgtgtagataattatcagacagagaagagagaatggaactccgggaagcgaagactacttgggaaaggagtggaaataaaaagtagatcccaagtttagtgtgccttggcaaaaagaggaaagtggatgggaatggagatcatgttgagaaatgaaattcctcaaaagagtgggaccagcttttcttcaaagagtctcactttatacaaattccgtagcagtaaatgttcttggccgaagcaacggaatctgtctctggctatcttaagcaaagagactggagtggaaagatgtgtcagttgcagtagctgcttatggatcagactgttgtggtgagacctttgcctagtttcctgatgctcagcctccaaagctcctttgattcctgtctgtttttcaagtctgatggttcagccacctgtggattttgtgagccactaataatacccttccagcagagcccttttttgcttaagatagtgagacttggtttctgttgcttgcaaccaagaaccctattactgttattaatttttttggtacattcttgagtcatttaggaatgtattagttaccagatgaaactgaattctcataaatgttatttggtagtgacttttactttgtagggaaaaagaggtatgattggactgttattcttatttacaggtaatatttagattttgtttgatgttaacactgtccctggtaaatttttttttcttctctcaagcttcagtgtgattccccaggaaaatcttggaaattgccaatagagaagatgtattactaagtatcagaagttttcttggaaggacatctaataagtttcccaagatgtgattctgcctgttcagtagttgcttgagtgctgatgaaattccccccaaacacttcctaatatattattgaaatatttgagataaaggaaagctgaacatattaaaactaatttttaagtggtgagagaagtggaattgaagtctatttgaggaatttgaaacatttatcacccacggtttttccaaaaatatacatttgtgtcagtctgtcaaactttttatcaaaaaaaactgtgaattatccatttaaaatacatttttattacattttcttctgtatctgagaaatatgccagatggtagaaatttcctagaagtctctgacacttacagattgaaagatgaatgacgagaagacaagaatttgggtatccagattaatagatagaactttacaactattgacttcttatttgctcttgttgagttttgaaaaggaattaggcaaggtagatgaaaatagagattcttctcccttcagtacccatgtgatttaacacagccatagaaggctccaagttttggggtgtgggcacaatttcaaagatatatttctattaagcttcttgagagtgatatgaagaagaaacgaagtatagagtctctcagatgcaaaaatcacttagaggtaggccatgtatccatccttatcacacttcactttttccaagaactacgactggcttgtcttttatggctttttaagaatctaacttcattgtgtaatcagcttatttcctctccattattaatgccctaattggcaggttttctgacccattttcttttctgtgatgctcttctagatgtctaaacttttcatatcacaacatggatttaggtagtttttcagtaataaaagttggtgtgaatatgcagtagtatgtggattaattaacatacatttaacaaatgtttattgaaggcctactgcaccctagacatgtaataaataaataaacaaataaattagtaaggtagcttcagatagtgataaattctattaagaaaatcaggagccggacatgatggctcgtgcctataatctcagcgacttgggaggctgaagcgggaggattgattgaggccaggagttcaagaccaacctgggcaacttagcagtacctcgtttaaaaaaaaaaaaaaaattagccaggcttagtggcacacacctatagtcccagctactcagggggctgaggcaagaggattgcttcagcccagtgaactgtgatcatcccactgcactccaacctgggcaacagagtgagactgtgtctccaaaaaaaggaaataaaggagggctttgggatactgaatgactgggagatggaaatctactttcaatagtgtagtcagagaaggcctcactgaggctttctattgccattgctattttagatacttgcttaaagaaagagaggtggtcttttaaaaagtatattcttgattaagataatggagagagaagaggaagaaaaaagggatattacaacctgtagctgtataggggaaaggaagagaaaaaagataggggataggggatagcaaagcaaactttatttgctttgtagatagctgtataggggaaaggaagagaaaaaagaaaaagagaagcttgaactttattatttgctttgtaaataatttgtgaccattgacttccatttcaaggatataataatgataggaattggctggcaggtacgactggattcacgatgggagccctttctttaaattatgccactaggtcttctctgaggtgccttctatataaatcaggattcataatctccctgattttacaggagccaggaactgagtcttcttttctttctatctctcataggaataaaagggggaaatgaacatttttttatactaccgaggtcaggtatccttgggtctaatgttaaacttaaaacagaaatttctgagagagcccttttatcctttgttatttagaaaatacttgaccctcctgtgcccttgctgtattggtgcgagacagaatggttatatatatattttattatataaataataactatatataataatatgttattatataaataataacatatatattttattatataaataacatataatcatatattattatataaataacatatataatcatatagcatatataaccatatgtagttatatataaatggttattatatataacatatataaccatatgtagttatatataaatggttatatatatatatttatttatttattgttgttgttttgttttgttttaagttccagggtacatgtacaggatatgcaggtttgttacatagataaacatgtgtgccatggtgatttgctgcatctctcaacccatcacctaggtattaagcccagcatgcaatagctatttttcctaatattctccctcctgcacccctcctaacagaccccagtgtatgttgttcccatccccatgtccatgttttctcactgttcatctcccacttgtaagtgagaacatgcagtgtttggttttctgtttctgtgttagtttgctgaggataatggcttccagctccatccatgtccctgcaaaggacatgacctcattcctttttatggctgcatagtattctatggtgtatatgtaccacattttctttatgcagtctatcattgatgggcatttgggttgattctatgtctttgctattgtgaatgaacatatgcatgcatgtatctttacaatagaataatttatattcctttgggtgtatacccggtaatgggattgctgagtcaaatggtatttctggttctaggtctttgaggaatcatcacactatcttccacaatggttgaactaatttacattcccaccaacagtgtaaaagtgttcatatttcttcacagccttgccagcatctgttgttttttgactttgtaataatagccaggtgcagtagctcacacccataatcctaacactttgggaggccaaggtgggtggattgtttgagcccaggagtttgagaccagcctgggcaacatgacaaaaccccatctctacaaaaaaatacaacaaaattagccatgcatggcagtgcacacctgtagtcccagctacttggtatggcttgagcccagaaggtcaaggctgcaattagccatgagtatgccattgtactccagcctgagtgacacagtgagacccccatgaaaagaaagagagaaagagaaaaagaaaggaaaaagaaagaaggaaggaaggaagaaaggaaggaaggagagaaagaaagagaaaagaaaggaaggagggaggaagaaagagagaagagaaagaaagagtaaaagagagaaagaaacagaaaagaaagagaaaggaaggaagaaagaaaaaaagaaagaaaaagaaaaaaaaaagagagaaaggaaagaaagaaagcctggcgcggtggctcatgcttgtaatcccagcactttgggagactgaggtgggtggatcaccgatcacctaagttgggaatttgagatcagcctgaccaacgcggaaaaaccccatctctactaaaaatacaaaattagccaggcgtggtggtgcatgactataatcccagctattcgggaggctgaggcaggagaatcacacttggacccgggaggcagaggttgtggtgagcagagatcacaccattgcactccagcctgggcaacgagcgaaactctgtctcaaagaaagagaaagagagagaaagaaagagagagagaaggaaaggaaggaagggagggagggaaggaaggaaggagggagggagggagggaaagagaaagaaattagaaaaagaagagcaatttaaaagttaggggggaaggggatggaaagagtaaagattagagtagaaatcaatgaaatagataccagaaaaacagtagagaaaattagtgaagccaagcaggttctttgagaagataaataaaatcggaaaatcatgagccagactgatcacaacaaaagagagaaaagacacaaattaccaatatcaggaacgagagagatacatcattacagattctataggtattaagagataataaggaaatattatcaattttataccaataaattcaatgacttagaccaaacggacaaagacacaaaggacattcaagaataaatagataacttgaagaaacagaatttgtagttaaaaataatctcacaggctgggcacggtggctcacgcctataatcccagcaatccaaggcagggggatcgcgaggtcaggagactgagaccatcctggccaacatggtgaaaccccgtctctactaaaaaaaaaaaatacaaaaattagccaggcatggtggtgcgcgcctgtaatcccagctactcaggaggctgaggcaggagaatcacttgaactcgggaggaggaggctgcagtgagccaaggtcatgccactgcactccagcctggcaacagagcaagactccgtctcaaaaacaaacaaacaaacaaacaaaaaatatatatatgtatatatgtatatatatcagaaactccaggcccaggtggcttcactggtgaattctaccaagcatattaggaagaaagaacaccagttctacacaaatgcttccagaaaattgaaaagaagtacttctgaactcaatctaggagactagcattattctaatacccaaacaaaacaaagacatttccagaaaagaaaactgcaaaccaatattccttgtcacaaaaattcttaaaattttagtaaattgaatccaacaatatataaaaaccatgtgggatttattccaggaatgcatgtggtggtttcacatttaaaaatcaatgtaaacttaaaaattctggaaaaagaaatgcgtaacccaccatataaaaagaaaaaaaaagatcatttcaataaatagagaaaaagcattttataaaatcgagcattcattcctgattcaaaaaaacaaaaatcaagactgttcatgctgtctctcacctgtaatcccagcactttgggaggctgaagcaggaggattgcttgagccccagaggtggaggttgcagtgagctgagatcatgccactgtactccagcctgggcaatagagccagaccttgcctcaaacaacaacaaagaccacctagcaaagcaggaatagaagggaattttttcaccaagtgaagggcatctacgaaaaacctatcaaacttaatggtgaaagacagaagactttcctgctaaaatcaggaacagggcaacgatttccattctcaccatttttgttcaacattgtcctggaggttctagccagtggataaggcaagaaaacttgaaaaaaaacaagtttgttcacataggacatgattgtctatatagaaaagcctatggaatctacaaaaaacaaaaaacaaaaaacaaaaaaaaaacgctactagaactaataagtgaatttatcaaggctgtatatcaatatataaaaattgtatttttgtattccagcaaagaacaattggaaatttaaattttaaaagcagtgtcatttacaatagcatcaaaaaatacaaaatacttagaaataattctgacaaaaggtttacactgaaaattacaaaacattgctgagaggaattaaagactatagtgactgattaatatatggtaacaaagtatatcagttgtggacaggaggtcacaggcagacaggagggaggaattccaaatagggtcaaaggaaactttgggaggtaatggatatgttcattatcttgattgtggtgatggtttcttgggtatacacatatataaaaacttaccaaattatatgtgtactttttcatttagtactttttttttttttttttttttgagatggagtctcgctctgtcgcccaggctggagtgcagtggcccaatctcggctcactgcaggctccgcctcccaggttcacgccattctcctgcctcagcctcccgagtagctggaactacaggcgcccaccaccacgcctggctaatttttttttttttttgtatttttagtagagatgagttttcaccgtgttagccaggatggtctcgatctcctgatctcatgatctgcccgcctcagcctcttaaagtgctgggattacaggtgtgagccaccatgcccagccactttttcatttaattctatgaatttttttttttttttttttgagatggagtctcactctgttccccaggctggagtgcagtggcgcaatcttggctcactgcaacctccacttcccaggttcaagcggttctcccacctcaatcacccgagtagctgggactacaggtgcatgccaccacgcccagctaatttttgtatttttagtagagatggggtttcaccatattggtcaggctgatcttgaactgctgacctcgtgatcttcccgccttggcctcccaaagtgctgggattacaggcgtgagccacagtgcccgaccagttctatgaatttttaacacatgtatatatacagaacaatttcatcaccacaaaaaactccatactatccctttataatcacaccctcttctgtctcccaacgcaaacccctgacaaccactgatttgttctccatcactatagttttgtcttttcaacaatgtcatatccatggacttatacaatatataaacttttttttttttttttttgagacagagtctcactctgttgcccaggctggggtgcagtggcacgatcttggctcactgaaacctccccttcttgggttcaggcaattctcatgcctcagcctcccaagtagctgggattataagcagacatcaccatgcctggctaatttttgtgttattagtagagatgggatttcaccatgctggccaggctggtctcgaactcctggcctcaagtgatctgcccaccttggcctcccaaagtgttggtattacaggcgtgagccactgtgcccagctttatacagtatataacgttttgagattagcttttttcactctgcataatgctttgagagctttgagattcctccaggttgtggcatgtgtcagtactttgcttctttttattgctgagtagtattgtattgtatatatgtaccacaatttgtttatccattcacccttggaaggatatttgggtttcccccaattggcaattatgaatagagttgctataaatactcatgtactcatttctgtgtgaacatacattttcttttctctgaattgtgtacccaagaataagattgctcactcaatcacatggtatgtttagctttttttttttttttttttttttttgagatggagtcttactctgtcacccaggctggaatgcagtggtgcaatgttggctcactgcaacctctgctgcctgggttcaagtgattctcctgcatcagcctcctgagtacctgggattacaggcacctgccactgcgcctggctaatttttgtagttttagtagttacggggtttcaccatcttggccaggctggtcttgaactcctgacctcgtgatccacctgcctctgcctcccaaagtgctgggattacaggcatgagccactacgcccagccatgtttagctttttaagaaaatgccacagtgttgtccagagtggctgtaccagttagtatttctaccagcaatatatgaatgattgggttgttctatatccttgtcagcacttggcactgtcagtatttttaattttaactattctaataggtatctcattgtggtcttgatttgcatttctcaagtggctaatgatgttgaaaaacttcttatttgccattcacatatcctctttggtgaagtgtctgttcaaacttttgcccatttttaaattgggttgtttgttttcctactattgagttttgagagttgtttatatattctggatacaagtcctttgtaatctgcaaatattttctactagcatttagcttgtattttcattctcttctcagtgttatatacagagcaaaagtttattttttttttttgagacggagttttgctcttgttgcccaagctggaatgcaatggtgcaatctcagctcactacaacctctgcctcccaggttcaagcaattcttgttcctcagcctccctagtagctgggattacaggcgtgagccatcatgcctgcctaatttttttgtatttttagtagagacggggtttcaccatgttggccaggctggtttcaaactcctggcctcatgtaatctgctcgcctcggccttaccaaagtgctaggattatagacatgagccaccgcacctggcctggaatgtcctttaaatttctttcaagaactttttctttgcattcacaacttggctaactgttttgtgtaagaggcctagctttcggcctatcttggcttttgacatgctctcttcactaagcttaataatttctagcttttaatttaaagtaagagactcttcctttcacttgaacacttagaggccattgtagggttattagttgacctaatttcaataccattgtagctcagggaatagagagcaccaaggaaagagagggagaaagaggaatggctggtcggtggaggagtcagaacataacgacatttattgattaagttcaccctcctatatggatgtggtttgtggcaccccaaaataattacaataataacatcaaagatcagtgatcacagaccatgataacagatatacaaataatgaaaaagtttgaaatattgtgagaattaccaaaatgtgaagcagagatatgaagtgagcacatgctgttggcacccatagacttgcttgacacagaattaccaaaatccttcaattttcaaaaaatgcaatatctacaaagtacaataaaatgaagcataataaaacaaggtatgcctgtaaatggtgcactacacatgctattctgtataatgaatttttttctgaatacataggctatatatattttaagattattaaataatatgacatttaaacatagccaatcatataagcaaagttgttcagctgtttctcacacctgaaagtgccccccacaccaaataaaacatttttagattatgtgtcccaatttggacttctgaaagtatggtcaccatatgccaaggcatgaaggcattaactggggaatgagtatggagtttgatgcctttcatctcctttgctcatctgtccctatccacatgatggctgcatttgaaatgaaataaagtctacatactggagaatagtttataaatcaatattttatgaaaacagttatatctaataattttttataaaataatgtatttatttgagtcttaagcttagtgatgtaattaaaagcctatttggttttttcttaggaatccaaatcctctctttaatatttaaaccctttaatttgctaaagataagttttgtgccctgttgaccacctaatggaacaagcaagtgttgaagatctcttgtggttttttttttagttgcaaattctaccaagctaacccatttattgcagtggataggagctggagagctgttcattcggcaataataggcaaagggtggtggagggaagaaaactatctttccaatatttttgcttaggaatttggggattcagaatttagtcataaacaactagattaatgtgtttaaatactttgaatcagttctaaatcattccttgttttgtaacatacaagatcttagagataactaaaacagtggttgaaaaattctgttgtggattgaagatcctccagaagcataattcactaataggcacagtgtttggggtgatgggtaaacaaacatctgtgtcctgtggttgcctctctgcataggaggagatatatagttttcaggcaagagatttctttggagagtccactgtctctgttttgcaagttatttatttatttttaatcccagagataacgaaaccatgtagtggcagtagatggtattattcatcaggagtttaggatgttaccatgttaggccatttaaaataagacagaaaggattactttttgccagctgcatcatttctggcaagagcttactactttgcttattgcggtcattgttgtggttgttgttaacccatcagagaaactaaccactacattggttttagccaaatccttgtcatcattggccttacattcttttggggaccaaagagcacctggtcattctgaaagcttccatccccagtgattgatgctcatctctgcaggctcctgcaggctctctcaagcttgcctcccatttttcctgaagcacctttaagcatttctgcatggctactcactctcttctattatacctcctcctcctgccttactgaatgctgaatttcccagctcacaactctaagaaggagctttatttcagagtagaaaggggcccccatatgtggcctattatatccatatcaacttgcttacccttttcaaacagctattgtcttttaatagggtcctgcctggcagggggagtccttaattcctgccatataagaatgggcagcttgagttacagctagctgcagtttggtgctctgatcaaaaggcctctgttgttttttagggtttttccccctccttctctctctctttctatatcctgtgctaataattcagcacagcaaggtcattacaggctttgaattgggagctgagagtgttaaattactgacctagaataaaagagatctggggggctctcaagaaagataaagtgattccggctagtaaaatgcaagcccagcaacctcacttcttaacaatattattattttttaatcccctctgtctctaaaagtcttttctgggacaaggagagatcccctgccagagaattaggttagaaacccaatgacatcttctgagagttgtggcccaggtgctggcagcttatgggcgcctgtgcagttgtcctttttgtctccctaccttgtcaatatttcactctgttctaccttggtctctcagccacatatatggtttttttttttttttatcacgtaagtcatatatgtttatgacatttcagctgaaaggtaatatcccatgaagggatttcagacatgtggaaagcataccacttagcccccaaaatatcttaaacatgacatcatcttattaaaagccactttcattccatttatgttttgtaaataatattagtctggtcctcccatactttaacaaaaaaaaagtcccattgtaaatgaatttgatgtctccactctattctacattgtatcttctgaagaaagtcatttccatttcttcatactattttctttcatatctttcatatgtccttttttttttttttttttttttttttttggagacagagtcttgccctgtcacccagactggagtacagtggtgtgatctcggttcactgcaacctctgcctcctgggttcaggagattctcctgcctcagcctcccaagtagctgggactacaggcgtgcgccaccacacctggctaatttttggatttttagtagaggcagggtttcaccatgttggccaggctggtctcaaactcctgacctcaggtgatccgcctgccttggcctcccaaagtgctgggattatagatgtgagccactgcacccagccactacagttatctcttaaagccatacactatccatatcctctggaaaatattgattttctaagactaatatttttagaaaagttcctaaaatcaactttcacagattttctgcacagcagagtaataataataagatagtccccgaatgtgccaagcattttacagaatgcattattaacacatttaacctttggcaaccttatgtaataagcattcctgtaatcactagtttacagagaaaaataattgcaatacaaagtcatacagccaggaagatttgtcccagactagtgcttcttgaactttttcatgtttgtgtgaatcacctagggatcttgttaaaatgcagaatcagattttgtaggtctgggttggggcctcagattctgatttttaacaggcttctaagtgatgctagtgctgctgtccttggttcacattttcagtagcaaagccatagtcattttttcttgagaactactcaaaaagtttttggttataacttccagtttttcattccatcaggcaattctatgaatatacatagtggatatttcacacctatatcttactttttaaaaaatatgataaaacatagcacttaacccacaaaatatcttaaatgttagaaaatatttaagatattttgcctcctattggccctgcagaagctggacctcctgaactgtgtgacctacttcagtggtacctcaggttctacatggtgagtatcctggggactggaagagtggagatgatcagggcccataggggacctggttaaaattgactattttaactatttttaagtgtacagttctgtggcattaaatacattcacattgttctgcaaccatcactgtcatccacctccataacttttctatcttcctaaactaaaactctgtactcactaaatactgacttgccaacttcccattccttctgaccccctagctcctggcaatcaccatgctactttctgtatctaggaatttgactactctaggtacctcaagtaagtgaactcatacaatatttgtcttttttgattggtttatttcatttagagtaaggtcttcaaagttcattcatgttgtaccatgtatcagatttccttccttcttaagactgaataatagtccgttgtatgtatgtatcacattttgcttatctgtcattagacactagggtggcttccaccttttgactgttgtgagtaatattgctgtgaacatgggtgtatatatcatatatttgtccaagtccctgctttcatttcttttgactatatacccagaagtggaattactgaattatatggtaattccaccaatatcttactttctaagaaaccagtttatgtttaagttattgtgttccttttttttttttctaagtgagacagggtctcactttgttacccaggctggagtgctggaatgcagtggcatgaacatagctcactggccttgacctcttgggctcaagagatcctcttgcctcagtctcccaagtagctgagaccacaggtgtgtgccatcacacctggcaaatgtttaaagatatttttcatagagacgggacctcaccatgttacccaggctggtctcaaactcctgggctcaagcaatcctcttgccttatagcctcccaaagtgctgggattacaagtgtgagccacttcacccaatcttctctctctctttttttttttttaaacattccttacataaagtaaatctttaaaggtttggcaggaagagtgagttttcagtacagattttcattaaagtctattgtctgtagctactttgtaattttcaatcaatcacaaaagaatattgagaaatgtcctttgatccttagaaggttggtaattggttaaatggcaccaagtagagaattagagagagagtgctcatgttctgaaataaaccaatactaagaaggtttatatcacagagaaagttttatataaatgaatttaagacctcacctgacaaacaggtagtcaaggaacaggtgaaccccttgttaaatttatgctctcctttaaagattttctggaacaactatcccaggatcttcaaaaattttgtggtacctctttctctgtggtctttaataatacattaaattctcgtttgtttataagagtttggtgcaagattctgcctgctacctagaggtctttccttatgtatctttagaaatgaaattctctattggaaataggaaaagaaataaactgatattgaaacctaatgagttaacagaacatttgaagggagttttaaaaaggtatcaggaagaaactgatttttttcctgtggtataatactgaatcattaagatagtaactttaatcatttgtgcctatagtgcccttattttaggagttcctagttactacaatggacttgaacttggaaaggtaaaacaatacaaaatagcttttaactaaagttgggaatatgagtgcttaaaaaatatacatggatttaccagtagctttagaaggtaaatatacatgactactgaaataaactacaattattttctaaaaagtgagaccaactttggagataaaacaaataaaagaatgaacagaaggcgactctggaaataacggtagtaaagttatataggacatgttgagatgataaccatgaagaggagaatcgaatcattatctgcaagtttcatgtggatggctctaaaagaacaaaccctgcatcctaaacccccttcaattttattattttgaattataatcaagtccaaggagacttggcctattattaacaactttgtatgaagtatttttttcaaccaaattcatatcatcttgaataagaacaaaggattatggtttgagaattattatacttgctggactttgaaccaacagagttgatatatttaatacttccacttcttagatgaggtggtactgaggaaggggtttgtaacatctaagggggcccataaaaatagtgtttagttttcagtgaaatctacaggtgatgctaaaatgggaacatttttaaagggatcctagtgagaacaaaaagacaacaaaaaagaacctaaaggctatagctgcaggcagaaaatagaataaaatttaccttaaaatgttgtctagtgcaatgccaagcatagatatacagtggatgagcaaaatcttgtaagaaattagaattgagtttaaaaagttataaaagaaaacagacaagaaattagatgaaactatggtatgtgatctggcagtaaaacagacaaaagctgttttaaggtctggagatagagaggaggggaaggaatggcaggatctgcagatgactgagggaggcctcacctgtgactaaactcagcttcagtagcagaagaaaatagtacagacagggtgaaccagttgacaaaagagatacagaggttggaacatagagctgaagagaaagaaataacagatgacaggtttagaaaccacataaagaatgtgagatgtaatatgtagcagaaggtgagatgtaacagaaatactgtaaagagaaacagtctgtccagaaactcttcctaggggataaggctaggggatatttccccagagaaaccatgaaaacacaattattctggatttcaagtgaaattaggcaagctcctggaagctctgttataaagagctctgcttagaggccttgttgaaagaactgaaggatcttgtaggaacaagacaaattagagatttacggtaattgttgttatttttttttaattgacataacattacacaatatttggaagacaggaagaaatcaataataagccaaaaccctaatccagtgaataaatacaattcatatcttttaaatttttaatcactttccttattcagacctactttaaagtagctaaaattggctgggcacggtggctcatgcctgtaatcccagctctttgggaggccgaggtgggtggatcacttgaggccaggagttcaagaccagcctggccaacctggcgaaaccccatctctactaaaaatacaaaaattagctggccatagtagcatatgcctgtagtcccagctactcgggtggctgaggcatgagaatcacttgaactcaggaggcagaggttgcaataagttgagatcgcagcaccacactccagcctggatgacagaggaagaccctgtctcaaaaaaacaaaacataaataaatgaagtagctaaaattatcatgtacacacaattttgtttccttttttgtttgtttgtttcttcttttattctcagtaccttcctcaggatcctccttaaatataacatatgaatcatgtttttataatttaaatttctaacatgctataaagagtatgtatgtgtgcagtaaccttttcccagtgctcggcgcattgattttccatcctgtatttccctgtttctactggcctggagtaaccagccttataaaaaaagatattccttcatacttaaagctgcaaggggtaagcagatgtgaattaatcatcttatatcagccggtaagaagctgatgtgttagggatggcacctgcgagtttaccatagcatgccaggccttcaggaatgagttttgaagtttgagggcttcaaaggggagtttgaaacattttaaaaccctgacagggttttacctgaattatatgcaaagatccaatggggggaagagtttacttcagagaagcagcaactgaaaaccaggtcctttgcgtagccttcctggaaagaaccgtctttcttccttagcagcagcccccagggtaggaccagtgctctatttcacggctattttaagaaagttctttatggatttgggtaacagaaaagcacttggtgaagtgatcaaggaaagaaactaactctgctactgaggattacttaggcagaaaaaaaatcttgttatgaaacaccaatgtttaagtccttagagtgaactgataagctgatttggggcttttttgctgttgcagaaattataaatcctatccactacaatggcagctcagttctcacagatgggttcacctatccttagacagtaacttaagattgatagtccctgttggatttcttcctaaattgttttttaaagaagccaaagatcttggattctaattctaatggagccactgctgacaagaagaagatgaagaagattgttagtgctcacttgcagtgtggcacatctctattttcttttttttttcttttttttttttttgagacggagtcttgctctgttgcccaggctggagtgcagtggcacgatctcggctcactgcaagctccacctcctgggttcacgccattctcctgcctcagcctcccaagtagctgggactacaggcgcccgccaccatgcctggctaattttttgtatttttagtagagacggggtttcaccatgttagccatgatggtctcgatctcccgaccttgtgatccgcccgcctcggcctcccaaagtgctgggattacaggcgtgagccatcacgcccggccacatctctattttctatagcatttacaattatttctttgtagccaacagaaaagttgcactcaatgaacctatcaattcatgatgcatatccgtggggagaagctcattccgaatacatcatatgttaaatttatccttggattcaggatcatattgttcacttactttttcctgtagtcagcatgttgtaattttgaacaatagaataatagataacaacagcctactagagaattagaaatactgtagttctaagaactgtagtaattagaaatactgtagttctaagaactgtagttcttagaaatactgcattcaacttttgtaaagaaacttttttgtatcactatataagaaagaagctggtgtgtaaggcaacttctgtgcaaatatgttgtctaaactgctttggggttctgtaacatagactagctgacttgcctcactgatttctcttatcaagttagcattgccaaattctatagctgataggcaatgggaagaaaacatttcagggctttaggcttcctctgaatttcacaaggaaacaaagaacaaatccagggattgttaggtcaggagacaaaatcatgccataggaatatatatctttttttttcttctttttttttgagacaaggtctggctgtgtcatccaggctggagtgcagtgatgtaatcttggctcactgtaacctctccctcccgggctcaagccgtcttcccatctcagcctcccaagtagctgggactacaggcgcaggccaccatgcccagctaattttcatattttttttttttggtagagacgggatttcactatgttgcccaagctgatctcaaactcctaggcacaagcaattcatctgcctcgggctcccaaaatgctgggattacaagtgtgagccactgcacccagccacagaaatatatctttagagcctggtgactttgtgcaaaacaaaactgcagttagccaacctgttagtggaaaatatgccccaaaagtcttctcctcccagcttgcccctttccaactcagaatatattttttccttctgtttatagaagcaacacaaggttactttaaatcataattttggccaggcatggtggctcactcctgtaatcccagcactttgggaggctgaggtgggcagatcacctgaggtcaggagtttgagaccagtctagccaacatggtgaaaccccgtctctactaaaaatacaaaaaaattagccgggcatggtggtgggcacctgtagtcccagctacttaagaagctgaggcagcagaatctcttgaacctgagaggtggaagttgcagtgagccaagatacaagattgtgccactgcgctccagcctgggcgacagagtgagactctatctcaaaaaaaaaaaaaaatcataatttcataatttttcccaagatgttttggatctttggtcttatatattctgtggaggccaattcatatgctgtgtttgaatcaccttagtgtggccagtttgtgctgcatagttggatgtgatctgctctcctgttttacttcttggcagatatatttaggattccttgaaaaaaaaaaaggctgggcacagtggctcacacctataatcctagcactttgggaggccaaaacaggaggatcgcttgagcccaggagttcaagaccagcctgggcaacatagtgaggcctcgtctctactggaaaaaaaaaaaaaaagaaagaaaggaagaaagaaagaaaattagccgggcatggtggtgcacacctgtagtcccagctacacaggcggctgaggcaggaggattgcttgaaactaggaatttgaagctgcagtgagctatgatcgtactactgtactccagccttggtaacagaataagaccctgcctcaaaacaaaacaaaacaaaacaaaaaaaacctatcagaagacaagttcaattccaattctaacagaagataatccactctaatgagctggcctggttttagaaagaaaaaaaggagacaggagaatggcctaggaagactcaactgccatcatccagttaaacagtgcaggtcaagattcactggccgttttcagtttgagtgagaacaaggagcacctggaggacatagagtgctgttggagttttgaagttttgcctctttgcacattaagaatgagctggaatattttaatttggtcctcttgcccatgtctttattacttctatatgtggaatgtgaatagctatttatatatagatccagtatggttacagttatttatttatttacttatttatttttaacttttaagttcaggggtacttgtgcaggtttgttacataggtaaacttgtgttgtgggggtttgtggtacagattatttcatcactcaggtattaagcctagtacccattagttgttttccctgatcttttccctcttcccatcctccaccctccaataggccccagtgtgtgttgttcccctctatgcatccgtgtgttctcatcatttagctcccacttataagtgagaacatgcagaatttggctttctcttcctgcattagtttgctaaggataatggcctccagctacatgaatgttcctgcagaggacatgatctcattcttttctatggctgcagactattccatagtgtgtatgtaccacattttcttcatcccgtctatcactgatgggacagtgtgaggaatcctcaaagatctaaagtcagaaataccattcgacccagcaatcccattactgagtatatacccaaaggaatataaatcattctattataaagatgtgtggttacatttatatttaattctttcttggtagtccctgagctattgcccacttcaccagaataatttaaatcaattcttgctttttgctagttaatagccaaaattaagatgtttatgtggaattgacatcatacataaattcttagaatttgtatctagtttttcaggagaaaatagataccacttaatagaattctgtatgactttttctgtgcaaacagcgtttgttactagaagagaacatgaaattgtatcaagaactcccattagcttaacatgtttacaaatgtctgattataaaattattaatttttaacacagctcctgctgtgttttcttaatatattactggagaaaactgccctagagctgggcatggtggctcacgtctgtaatcccaatgctttgagatgctgaggtgggaggattgctttagctcaggagtttgagaccagcctgggcaacataacgagactctgtctttacaaaaaataaaataaacaaaattagccaggcatggtagcgcatgtctgagtcccagctacttgggaggctgaggcagggggatcgcttcagcccaggagtttgaggctacagtgagctatgatcgtgccactgcactccagcctgagcaacagagaaaaaccccatctctttttttttttttttttttaaaagagatctcttaaaaaaaaattgccctgaagttaaatattgtattagggttctctagagggatggaactaatggaatagatttatatatataaaggggagtttactaagtattaactcacacaatcacaaggtcccacaataggccatctgcaagctgaggagcaaggatagccagtaaactgaagaacttggagtccaatgttttagggcaggaagcatccagcatgggagaaagatgtagcctggaagggtaggccagtctctcttttcacatttttctgcctgcattttattctagctggctagactggcagctaattagattgtgctcactcagattaagggtaggtctgcctttcccagcccaccgactcaaagttaatctcctttggcaacaccctcaccgacacacccaggatcaatactttgtatccttcaatcagtttgacactcaatattaacatgacaaatattaagctaataaaataggaaaactatggaatttattttattgtcaaaactaaattaagagagatttgtactcagcccatttcattttttttactttagaattttttaatttccagtgaaaccaaattttactactgttgtgaacacagccttcacatttgatgcaaatgggagggcttaattataatcacttagtgacagtattgtagacaaagccaatagtgtatggcacatagatgattatatcttctggagagagttgactttacaattaatacaaacatatttgactaaagaaaatggaagcatcttcagaccatttcatcttaattatatcttgtaaggttaaaaatatataactcacaaataaattttaatttaaaaaatttttttaactttcatgtcacagccaagtccaaaaaattttaattttgatgtttctggttctcttgtggctagataatccatagagatttcctgaacttcttattcatgatagcttaaaaagaaacattcagatccctgtgaattggacaaaaggatatctattttatgctactttttgtagcataaggaagaagaggaaataaaaacacaatgggcccttgaacaacatgagggttacaggtgccgacctctcctcttcacttagtctaaaatccacatataattttggactcaccaagaacttaactactgatagtctactattgaccttaccaatagcattaaaacagttgattaacacataccttgtatatgtattttatactgtattcctacaacaaagtaagctagagaaaagaaaatgttattaagaaaatcaaaaggaaaatatatttactattcattaagttaaagtggatcatgataaagacctccatctttttcttcttgatgttaagtggctgaggaagagaaagaggaggaggagttggtcttgctgtcttaagcgtggcagggaagaagaggtggagattgtagaaggggaggcaggcacactcggtgtagctttatgaaaacacatggtgatttctgattttttttgccttttcatgtctttaaaaatgtttctatatggtaccaatttttcttccatttgctttagtttcagtgcctgtatcactgaagagttcatgtcataaaagaagtcaaaagcagtcttgaatagttggaactcttctgccagatggtctaatgtcagtttgttttctggccctgcttctgtgtcttcttccccttctattccttcttttctggcactggttcagaagcactcaccttcatcaagttgtcttctgttaattcctctggtgtgatgtctgttagctcttgaatttctccaagatccatatcttgggacccttcccccaccttctttgccatatccacaatctctttcatgatctccttgattggctctgtcgtaaatcctgtgaagtcatgcacaacatctggatgcagttttctccagcaggaatctattgtttggggctcaatggctttttccataacaacagtggcatcttcaatggtgtaatcctcccagactttcttgatgttctatcaggattctcttccatagcgttgacagtcctttccaacagagtactatgtgtaatgggccttaaaggtccttataaccccctgacttaggggctgaattagaaacattgtgtttgggggcaagtattacagaccattttgatacctttggtgttgaactcatgggttctgggtggccagggacattgtccaattcaaaagaactttaaaaggcagtccatgttggtgtgctgcacccattaattcatcatttacgttaggtatatctcctaacatggcacatgtatagatatgtaacaaacctgcacgttgtgcgcatgtaccctagaacttaaagtataataaaaatatatatatataaaaataaaaaaataaaaataaaaggcagtccattaccagcaaggtacatcctgacttcaggaagaatgttgatgaaacccagtccagaaaaaatggttctcattatccagggcttcttgtacaacacccaaaactggcaactggtatttatcttttcccttcaaagctcaggggttaccagctttatagataagggcagtcctaatcataaacctgactgtgtttgcacaaaatagtagagttagcccatcccttcctgccctaaatcctggtgcttgcatctcttccttactaataagtgtcctttgtggcatttttccccttagcatctgcattaaaaaactgctcaggaagatatcctttttcctcaatgatttttaaaagcttctttttttttttttttagagcagggtctcactgtgttgcccaggctggagtccagtggcatgattataattcacaccacctcgaattcctgtgctcgagtgagtttcatgcttcagcctctttagtagctgggactacaggcttgtgccaccacagtcggctaatttttatttttggtagagatggggtttttccatgttgcccaagctggtttcaaactcctgggctcaagcaatcctcccacctcagccttccaaagtgctgggattacaggcatgagccactgcacctggttgcctcaataattttcttaatggcatctggaaacttgtttgctgcctcttggttggcagatgctacttcccctgatatcctgatattttttaagccaaaactttttctaaaattatcaaaccatcctttactggcattaaattctccagctttagacccttcacctttcttctgctttaagttgtcatataatgacttcactttttctcagatcatattagggtcatatgcctttcttatagaaatcctgcactcctataaaagctgtgttttcaagacaagttaaaaaagtatttcaccaaaagtgcaatgtttttatgcctgctgatgtagctgcagcaactgcttcatgaatttcctttgtttataattgtccttaccttagattcatttatcttgaaatgaaggccaaaccacagctgcagatctcaatctatgatgtatgtcaagcaattcaactttatcttgtaacgtcatgaattttctctgtttcttgggagcacttccggcatcactagtgacacttcgtatgggtccgatagtgttatttgaggtttatggttttgtactgaacacgatgaaaaatacatgagaaccatgagagatcactttttactgtgatacacaatttactggagaaatgaactgcccatgcagagatgattagcatcacatggtgttttaagcagatacttgcaacacttgtgctcactgcaatagcaacaggagttggctatgaatgaaattattatagtagtacagtatgagctacagttaattttatacagttatgatttaatactgtatgtttgcttacatttctctccactatgaatggcaccatgtatggtctgtgtgtgtgtcagttttgctaaatgttaactttttataacagatttgtgtatattttaatgtagtaaatgataaaatggactagtgtctacatattttatgcattcaggacatacttttaaaaatttttccaatatgtgtaggatgcacagttggtctgtgagttttttttaaattgctgaaatccctccaaaatttctaatatatttattgaaaaaaaatccatgtataagtagacccacacagttcaaatccatgctgttcaaaggtcaactgtatatacatgtatctgctcatctgagaaaaaaatatgcacacaggaagaataaaccagagatgaatgagattcattatctctaagatgttagtgaaatggagtgaaaagatatatatatatatatatatattatatatatataatatataaattatatatattatattatatattatatattatatataatgtatattataatatacaatataatatataatatattatatataatgcatattataatatataaatatatatttatattatatattatatattatattaatatataatatatataatatattatatttatatattatatattatataatatatatattatatattatatttatatattcaacaagattgggggagactctaaaattgaaaacaaacaagtgaagcaaattgtatttcaaatgaataatataccgtactgcagggggttggagaaactaatctaaggaacataatatttggactatataccctcaggctaaaacaactctaaacaagtattaaactctaattagtaggcttctttttcacagaggaatgggttagctagctcagtacattttaggattaagcaaataagtaaatatgttatagataataggagcctttttctcactttagaaaaaggacatttcagatatggaaagggaagatgatagaatgtaacctgtagtgttgaactggaattgaatcagtgtgagctcatagatttgttttgttttgttttgttttgttttgtttgagacgcagtctcttctctgtcacccaggctggagtgcagtggcacaaccttggctcactgcaacctctgcctcccgggttcaatcaattctcctccctcagcctcccgagtagctgggattacaggcgagtgccaccacgcccagctaattttttttatttttcttagaggggtggagttttgccatgttggccaggctggtctcgaactcctgacctctggtgatccgcccacctcggcctcccaaagtgctgggattacaggagtgagccaccacgcccagcctattctttactaaaaacaactgggcttcttggataaatggctggctccagggtgaagtagggaaagaacaagatgatcctggaacatcttattctatcaaaaaaggaaggaagtgatcagagaattatgtagatgtgtcaaaaggacatagaagtcagcttgaagggcttccatggcaaaatatgggatcatttgaacataaaaatatataatgatagtaaaggattataacctattgaataaagaatccatgagtccacaatgatataaataaataagaagggaaagctcttccttattgtagaaggtcgacttaaaaacgtagatgaaacgacgtagttggaaaaagatcaccatttggcaaaaccttcatattcattgttggttctggcaacaattattattattattattttttttttttaattgatcattcttgggtgtttctcgcagagggggatttggcagggtcacaggacaatagtggagggaaggtcagcagataaacaagtgaacaaaggtctctggttttcctaggcagaggaccctgcggccttctgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtgcagaacaaaatgaaaagtctcccacgtctacctctttctacacagacacggcaaccatccgatttctcaatcttttccccacccttcccccctttctattccacaaaaccgccattgtcatcatggccccttctcaatgagctgttgggtacacctcccagatggggtggtggccgggcagaggggctcctcacttcccagtaggggcggccgggcagagggctgaccccccccacctccctcctggacggggcggctggccgggcagaggggctcctcacttcccagtaggggcggccgggcagaggcgcccctcacctcccggatggggcggctggccgggcggggggctgacccccccacctccctcccggatggggcggctggcccgggcggggggcggacccccccacctccctcccagacggggcggctggccgggcagagggactcctcacttcccagtaggggcggccggccagaggcgcccctcacttcccggatggggcggctggccgggcggggggctgacccccccacctccctcccggacggggcggctggccgggcggggggctgaccccccacctccctcctggacggagtggctggccggacagaggggctcctcacttcccagtaggggcggccgggcagaggcgcccctcacctcccggatggggcggctggccgggcggggggctgacccccccacctccctcccggacggggcggccggccaggcagaggggctcctcacttcccagtaggggcggccgggcagaggcgcccctcacctcccggacggggcggctggccgggcggggggctgatccccccacctccctcccggactgggaggctggccgggcgggggtctgacccccccacctctctcccggacggggtggctggccgggcggggggctgacccccccacctccctgccggacgaggtggctcccgggcagagacgctcctcacttcccagacggggtggctgctgggcggaggggctcctcacttctcagatggggcggttgccgggcggaggggctcctcacttctcagacggggcggttgccaggcagagggtctcctcacttctcagacggggcggctgggcagagacgctcctcacatcccggacggggcggcagggcagaggtgctccccacatctcagaggatgggccgccgggcagagacgctcctcacttcccagatgggatggcggccgggaagaggcgctcctcacttcctagatgggatggcggccgggcagagacgctcctcactttccagactgggcagccaggcagagacgctcctcacttcccagacggggtggcggccgggcagaggctgcaatctcggcactttgggaggccaaggcaggctgctgggaggtgaaggttgtagcgagccgaggtcacgccactgcactccagcctgggcaccattgagcacggagtgaatgagactccgtctgcaatcccggcacctcaggatgccgaggctggcggatcactcgcggttaggagctggagaccagcccagccaacacagcgaaaccccgtctccaccaaaaaaatacgaaaaccagtcaggcgtggcggcgcgcgcccaggcagttggcaggctgaggcaggagaatcaggcagcagtaccgtccagcttcagctccgcatcagagggagaccgtggagagagggagagggagaccgtggggagagggagagggagagggagctctggtactttcttatagccacacgaacagataaagactgtacctatctgttggctgggcgcagtggctcacgtctgtaatcccagcacttcgggaggcttagacaagcggatcacgaggtcaggagatcgagaccatcctggctaacatgatgaaaccccgtctctactaaaaatacaaaaaatttagctgggcgcggtggcgggcgcctgtagtcccagctactcaggaggctgaggcacgagaatggcatgaacccgggaggcggagcttgcagtgagccgagatcgtgccactgcagtccgtcctgggcgaaagagcgagactccgtctcaaaaaaacaaacaaacaagaggtccagagtgtgacaacatggccttgcaaccttgtgctcagggaccctggaggcagtccttcataggtctgctggaactcgccaacaattattaatagatactaaaatttgtgaatgaaagtttgaagagtaactatatatttccacagactcaaaatgtcttcccacaggatacttatccattacaaaggctaactttatagtggcaaaacctggcagatgctgctctaactaaagaatcaaagttaacatccccagtaattagactaatcagcaagtgcccccagatgtgatgcactgagaggaactcagcatcacctttgtgataatcctgccaaaggggcataacctgaattgaattatgagggggcatcagacacacccaaattcaagaacattctacaaagtaacctgtacaacaggttttcaaataactttgtttcatttaacatcattttcattgtaactattttgtggtttaagatcattttatgaagagcaagaggcagggagagatggcagggaggacaactagagcacttctacacccaccaggagaatagactccctccctgcttcctgttgtgctggacccctattgacttcagtagggatggcaccatgtttgcgaggctgaaaaagagacatggagccagcaaatgaaacataaggttttttgaggggatttacatacagggcagtccaggggcagcatgctgaacaggagaactgctaccacttataaaaaagcatgcagtttatacagcattttcacttagcccctcgaccccggcaatctccacctggcaaccttcatccaacccaaaacaaagggcctcgaacccctgtatggcctgtgatccatgggatggatcagatggttcagatgttcctcatagataaagaatgaatctctgggttggccattcccaaattccttcactcagaactctgaacacacattcatcttagaccacagggtcattctcagggtatgcttcaattatttatgacaggtgcatctaccatacacctgctccccaagtggctcccttgtactatggcagcggtggtggggagggatttgtgtaaactctgccctggagggtggggaaggtgaaggttggatgtaaaatggcagcagctggggctggcagtggtgctgctgggtgctacagggcttgtagggttccataaagagggctgagaaggtgttgactttgtctgccccctgcacctcatggggaaacagtggcagtttcacagtgcaaaagtctttataagtgttctccgtctggttcagatacttggcctggatcttgtgtcaggcctcacatatctttcaggattttcagggttggggaagagaagctgggtgatgatgatgttgtatgtgtcaatcttgtacttggccagctcctggatcagtcactctgtctcatacagggatagaactcagggatatattcgcagatgatacaggtaatctactcagggcccttgaactgtttgctgacaaagtagatgatggacagtgtctacttcagcatggaggacagcacgtctgtgttcatgtccccaagacctagaacgttgcatgtctgtaagataaaggggctgatctggttcttgatctgctgagtgtcatgtcaaccaccaccactgagaagttcatgcccttcaccagcctcatgacctcagcatagctcatggcctcattgatgccgggaaaggcgctcatggcttcctgcatcaacttcttgctcatgctcagcatgttttccttctcaaagaactcactgggcagctatgctgcaccctggctggggtcaatttccacagtgaagaggttgtcagagcctttgaccttggtaggcacctttgagaacttctggtcaaaaccatctgagatgttgtgggctaggtctgtggagatgatcagaatactttcatgcccttttgatagctggatggccaggctgcaactgcaagtggtctttcccatgccacctttgcgccagcaaggatccacttaacttaaggctgcatttctcaatgatgttgctaaacctaggctccagtggctcttggaggctgactttgggagactgaggtggaaggatcacttgaagccaggagtttgagatcggcctggaagtgagaccccatctctacaaaaaaaaatttttttaaatagacaagcatgattgtgtgtgcttgtagtcccagctactcaggaggctgaggtgggaggatcacttgagctcaggagttcaaggctacagtgagctatgattgcatcactgcattccagcctgggcaacagagcaagtccctgtccaaaaaaataaaaaataaaataaagaaagagaggaaggaaggaaggatggatggatggaagaaagatttcattatttttagggaatatttttaggaattccttatttcctaatttttatttatcttgctcagcactttgacttctgttttttttttttttttgaaatactgtaggagtaaacaagcgtcacgtctataacttactcttaaatagttccaaaaaatgataatatgtatatacatatgtacttatatgtctgtgtgtgtgtgtgagagagagagagagaaaagagagtgagtgagagtaaatgtagcaaaatattcacatttgagtaatccaggtaaaggatattcaggaattctttgtgctattataactttttggtaaatttgaaattacaatatgtcaaaatttttaaaaattaaaatcttcaaggaaaaacttcaacaacttaaagaataaaaaaaattgctcaatgaaatttgaatactcgttttggcaaaatctgtttatggcagacatatggtgtacttctgtatggcctttaagatatttttaggaacttttttgttttactttagaggaaagattaatgtctattaaagaactttgtagtttagtcaaatacaatgaaaaattagtgcaaatatgcatttttaagcttggtaggtcaaatgtttgttttggatttctggtcatgatggcttgcagtgttcatgacttgggcctcttattcatttcatacacatggtaatgatacataaaattttctaagatttttaaggacatagccatgtataaaattaatataaattcatctgactaggaactcactaaaccacaatgcagtaagtgggactgtaaccacatgcctcctgtgctctggattcagaaggcgtaggtaactgaaagctcatttcttgaatggtggagactcaaaatgttatacacacagtgcaggagactggagctagccccttttgcctccaccactttaagaaagactcaaaaaaagttatgactgctacctgagaaatggcttacataaaacctggaggtttagccaggtgcggtggtgcacacctgtagccccagctgtttggaaagctgaggcaggagaatcccttgagccaggagtttgagaccagcctgggcaacatagtgagaccccgtctattaaaaaaacaaaaaccttgaggtgtgggaggaagcagacagccttacagccaggtcttagtggtccaacctccttaggggtacagtgacaatctgtatgatatccctaatatcaggaatggagccataagccatccaatacaagacctggttctggactagggtctgtccacaagagagagtagaaacctcccacttcacatgaacttatacgctgaaattctaaaatacatgaggaacactgatgttgagaaagatagtcaataaacccaataaacataaatttactccagagaaaacaaaaatagttgaacatttaaaactgactttgaggccaggttgaggtggctcacacctgtaatcctggcattttcagaggccaaagtgggtggatcacttgagcccaggagtttgagaccagcctgggcaacatggcgaaaccctgtctctacaatcctgtctctagatataaaaaggcatggtggcatgcgcctgtagattcagctacttgggaggcacttattatctttaaattattcattctctattctgtctggtcagcctgaataatgcaggttctacaatgtatctaccatgtaggtttatttttatttatttatttatttttgagatggagtctcgctctgtcacccaggctggagtgtagtggcgtgatctcggctcactgcaacctctgcctcccaggttcaaccaattctcctgcctcagcctcccaagtagctgggattacaggcatgcaccatcacgcctggctaatttttttgtgtttttagtagagacagggtttcaccatattggccaggctggtcacaaattcctgaccttgtgacccacccgcctcgacctcccaaaatgctgggattacaggtgtgagccaccgctcctggacagtttatttttatttatcttactcagcactttgacttctgttttgttttttgttgttgttgttagttctggaaaattctcagccaatatatatacatgtgtatttcttgagataggatctcacattattgcccaggctggagcgcagtcacgtgaatcttgcagaattgtagaatctgcattacttaggctgaacagacagaatagagaatgaataatttaaaagataataacataaagagataaaaaactatgaagacaggtaagaggcattaaaaagctacaatgtatatctaataggaaacagaagaaaatgatatagggaatggcaaagaagcaatattttaaaaagaattggggggtgcagtgactcacatctataattctagtactttgggaggctgaggcaggaggattgcttgaggaccagcctgagcaacatagcgagctcccatctctacaaaaaaattaagtttagccaggcatggttgtgtgcacctgtagtcccagctactcaggaagctgaggtgggaggatcacttgaacccaggagttcaagcttctagtgagctatggtcatgctactgcactccagcctgggcaacaaagtgagatcctgtctcaaaaaatgtatatgtgggctgagaattttcctgaactgacaaaaaacagaagtcagtttaaagtactgagcaagataaataaaaataaacctacatggtagatacattgtagaatctgcattaatgataaagaaaattgtttatatgaattataagaatgattaactccaaaggaatggcaggagtttgacagcagtttgcttgatatcagtgataggtgcgaggtgacaactgggtggtatctttaaagtgctgagagaagataagtaacaaccagaattctccactgaattaaatttcactccagaaggtaaaataaagatattttgaggtagatgaaaactgagagcatttaccactcacaggcttttgctgaaagaactacaggtttatgtatattaataaatttcacaattcaaaaaaagctttgaaaacctgaagttgtcctttggtaagttttcagcaacctcatttgtggggcaaacttgacctaaactagttcatgggctaattttggtctttgtttatcccacttagtgtgaatacttatatgtttcactgtggagactttaatatgtttgaatccatggggtgctatcccaaccctgctgaaggtgttatatcacatctggtttgtgcaacctttataaaatctcaaaatttgtcacttccaaaccagaaaggtcccaggatttcagataagtgattatggatcttattaaaggattatggatcttatttctttagcaagaaataattgaaccaagagtgaaggagcagaatgtgggaaacagtagtgagcatgaaaattgatttgataaatgtaggtaaacttaattaattattgatttttttaaagtagtcatttttttcttttttctcttttttttctttttgagatggagtctcactctgatgcccaggctggagtgcagtggtgccatctaggctcactgcaacctccgtcccccgggtttaagcaattctcctgcctcagcctcccgagtagctgggattacaggcacctgccaccacacctgggtaatttttgtatttttagtagagacggggtttcaccatgttggccaggctggtcttgtactcctgacttcatgatgcacccgcctcagcctcccaaagtgctgggattacaggcgtgagccaccactcccagcctaaagtggtaatttttacatttaaaaaggtatattgtcctgtaggtatgggggtgaattttttaaaaaaggaaaaaaaaggaaaaggtagatatcaaaagaaataaatgacatccaaattggaaagtaaaaggtaaaactatattcacaggttacatggtcctatgcataaaaagcatcctaaagaatccaccaaaagaaaaaaaaaaaaaaaaaacttctagagcttataaatgaattcagcaaagttgcaggggacaagagcaacacataaaaatcagttgtttctatataccatcaatgaacaatctaaaaaggaaattaagaaaagcaattctgtttaaaagagcatccaaaagatttagtctattaggaataagtctaactgaggaggtgaaagacttgcacactgaaaactataaaacattgctgaatgaaattaaagaagagctaaataaatagaaagacaccctgagtacatggataggatgatgtaacactgttaacatgtcagttctacccaaagcaatctactgattcaacacaattttcttttcttttcttttatcttcttttcttttttttttttttttttttttttgagacagagtctcactctgccacccaggctggagtgcagtggcgtgatctcggctcactgcaacctccacctcccaggttcaagtgattctcctgctcagaatcctgagtagctgggattacaggcatccaccaccatgcccgactaatttttgtatttttagtagagatggggtttcaccatgttggtcaggctggttgattgaacacaatttcttttcttttttttttttttgagatggagtctcactctgtctcccaggctggagtgcagtggctcaatctcagctcactacaacctccacctcccgggttcaagcggttcttctgcctcagcctccagaaaagctgggattacaggtgcccgccaccacacctggctaatttttgtatttttagtagatacagggtttcaccatgttggccaggctggtcttgaactcctgacctcaggtgatctgcccgcgtcaacctcccaaagtgctaggattacagacgtgagccaccgcacctggcgattcaacaaaatttctatcaaaataaataggctttttcactgagagaagaagctaatcctcaaaatcatatggaatagccaggacaatcttgaaaaaagaatataaaattggaaagttcaaacttcccaactataaaactagctatgaagccacagtaattcaagtattatggtcctggcataaggacaaacatatagaccactggaatagattaggaagcccagaaataaatctttacatatatggtcatttgatttcctgcaaaggtgcaattcaatagggaaaggacagtcttttcaaccaatggtgctgggaaaactggatatccacgtgtgaaagaatgaaattggactacaacactcttagaagaaaacaggggacagttttcataacattaaatttagcaattatttcatggatataacaccaaaagcataaggaacaaaaaatatagataaattggacttcatcaaaattaagaacttttgtgcatcaaaggatactatcatgaaagtgaaaggacaacctacacaatagaagaaaatatttgcaaatcatatatccaataaggaattaatatccagaatatgtaaagaactcctgcaactcaacaacaacaaaacaacccaatttaaaaatgggcaaaggacttgaagagacatttctccaaagaagatatccaaatggccaacacatgaaaagatgctcaacatcattagtcattggtaaaatgcaaatcaaaacaacaataagatgccacttcacatcttctaggttggctgttttttaaaaaggaaaatagcatgtgttgctgaggaggtggacaaattggagcccttgtgcattgctagtgagaatgtaaaatagtacagctgctctggaaaacagttcggttgtttctcaaaaggttaaacctataactaccatatgacccagcaattgcacttgtaggtatacatctaaaagaattaaagaaggaactgaaacagatacttgtatacaaatcatagcagcattattcacaatagccaaaaggtggaagtaacccaagggtccatcaacagatcaatggataaacaatagatggtacatacatacaaaggaatattattctgctttaaaaagaaaataaatttatggccctgcagtggcttacacctgtaatcccaacactttgggaaggtacggttgaaggatcatttaaggccaggagttcaaggcttgagaccagcctgggcaacatagggagaccctgtctctattatttaaaaattatgaaggaaggaaagaaggaaggagggaaagaaagaaagaaattttgatacatgctacatgtacggcccttgaagacattattcttagtgaaataggccagaacgacagatattacatgattccacttatatgaggtacttagaataggcaaatatatagagatagaaagtagaatagaggttatgagggtctggggggtgggcagaagggggtgttgttgtttaattgatgtagagtttttgttggggatgatgaaaaagttttgggtattgatagtgttcatggttgcacagcattgtgaatatatttaatgacactgaattgtacagttgcaaatggttaaatgataaatattatgtatagtttaccacattaaaaaagttttccaatttaaaaagagatagattctagtcacattctaaaaaataatatcagaagatgagaagactgcacataagttatagaaagtgtgctttgggctttgtcttgttttatttttatttttgttttgtttgtttatttattttgagacagggtcttgctctgtcacccaggctggagtgcagtggtgcgatcacagctcactgcagccttgacctcctaggctccagcagtcctcccacctcagcctctcaagtagctgggaccaaaggcatgcaccaccatgcccagctaatttttgtaatgtttcataaaatcaaggtttcactatgttgcccaggctggtctcaaactgctgagctcaagcagcccacccacctcagccttccaaagtgctgggattataggcataagccaccatgcctggcccattgtcttgttttggagagttataaagataatgagtattttcagacattttcaaaaatatgtagataggccaggcgcggtggctcatgccagtaatcccaacactttgggaggctgagatgggtggatcacttgaactcaggagtttgagaccagtcagggcaacatggtaagaccccatctctactaaaaatccaaaaaaatagctgagtgtgatgatgcctgcctttggtcccagctaattgggaggctgaggtgggaggatcagtgcttgagcctggagggcagaggttgcagtgagccaagatggggccactgcactccagactgggtgacagtgggagacaatgtctggggaaaaacaatgtagataaatattatgttaatgttttaagatggggtctcaccatattgcccaggctggactcaaactgctgggctcaagcgatcctccatcctcagcctctgagtagaactacaggcatgcaccaccatgcctggctgattatgttaaattttaatactgaaagattatagattttgtctatagcttccaaactaacagggagggtagaaaagaattaaaacaaaactttactaacacaatagaaggtgggaaaagaaggtggggaaagggaaagaagaatggataatgggaaagacaaaataagatatcaggtcagaaattaatcagatacactgaaaagctactcgttaacatatagtgactgtaaggttgggtagagaagcagaatctagccatatgctatttacaagagatatacataaacaaaatgacctagaagggttattaaaggcacagaaacagatacaccaggaaaataccaatcaaaataaagctggtattgcaatattataataaaaatatcagactcaaagcctggaatttagaaaaattagtaagatatagactttcaatatttcctgtgtggctagcttcaaagatacattctacctggcatcacttacctgtctttcttatctttctaaatcaatttccacaaatatttatgagtaactatcagttaggtaatgagtcaggtaatatagtagaggcaaagatgagtacagcctaagtgcttactccatagaactgacagtctaataggagaaagtccagtaactttaaaacaaagtagcaaattgtgagcactgttagagagttttaagtgagatacgatggaaattgggcatgggagataaaatcaggaaaagactttacacaaaattggcatttgagatggtctttaaaagctataccaaagctataatttcactagaccatgacctagacatcagctttttcccccttagaatatgaagcacaatttgggactacttctttgctggacagtttcataaatttaggctacagtattatcatttcagacttcatttgctggaaatgtagcctactgcatttacctataacagctcatttgctgtattttttattttcctttccttaagacaatagcactgcgtggttaggttaacactttcattgcttttgaaagcccctcttctaacctaatcttttgccaggtgatgtccgcatacttcctcagggtgtcttagaagtagatttctatgctagctctccatgaaaggagaagagtatataatttgctttttcatacagtgctgttactattaggaaggaactaactttattctaaatgaaaacacactctatattaaagacaagttagatactttcccatgaagttggtctaggagaagggaaacggaatagatgcctcctgaaattttttcctgttccattcagagtcagatttttccccccctttatatggtcaacaaatgaaaactggcatttggaattaccatcgttccccccattgcttgccatcttcaaatttaatgtctgcctctccacaaagattaacatgtttccactcctgatttacttgtcagggaatttagaagttttctggaacctaaagttcactctggtagggatgattactggataattgcctattcttcggtggaatttccacttttagattacaccaggctctacagcctttatttctttggcaggaaaacccaaaggcaatggagtatatttttttcccttccctggcccagcttaaacaatgactcacttgggccctggggctttgcttcatactctcatttaggggccactttatacccttgtttctattttcctttcttgttctgtttggaccctttatatcctttggcacatgggatttgtctctggggttattgtcagagagatatataaaaccaccccaaactggaacagccactccagttatgtccccatagccatgtcatccttatggcagctggtataggccagggagagtacagaaataatatcttttttcttttttttttttttttttgagactgagtctcactctgttgatcaggctggagtgcagtggcatgatctcggctcactgcaacctccacctcccaggttcaagtgattctcctgcctcagcctcccgagtagctggaatgactggtgcacgccaccatgcccagctaatttttgtatttttagtagagacagggtttcaccatgttggccaggctggtctccaactcctgacctcaagtgatccacccgccttggcctcccaaagtgctgggattacaggcgtgacccactgcgcccagcccagaaataatatctttaaggaaacctaattccaaatgcagtagagggaaaagtattctccaaaaagaaagatatgagtgccagtgtcatccagttagaggctaaaaggctttcctccatatgcgttgctcgaatgactgattcagatgtcctctgtgtgtacctgtggaaggtgggaagcactcagaggaactggcctccaagagttttcggaaaggtatggttatatgaagagacttccccatagaaggactaggtctaatctagagttcagagttttgttggggagaaaaattccccgtttttggcagtggttctctctggtctcaatttttcattctgattccagccttctggattccatctaacaatgacttcttgacttttctctttgcagttttaacagtgtatgccagggaacacacattctctttcgagaattcagcttcgtccaagccaccccccacaatagggtatcatttttacgggccttctggagatgcttccgaactgtgggcaaaaatggcggtaagtcttcccaaattctttttccttccttccttccttccttcctttcttccttccttccttcctctctctctctttctttctctctctcttttcctctctttctctttcaaactttttcttttgttcctataaatattgtttgaatgcatgctattcaaggcatttagaatacctcacttttgaggagttgtctggtttatgtcaaagatattactattaccactaccatcactaatggtacctattaagagccaagtgtagctctttacatgtagtaactcatttatctttacaagggctctctgtggtagataccataatccccattttgtaactaatgaaactgaggatcagagaggttaagtaacttggcaaggttacatagtaaattctgggcccagatttatacccaggcagtctgacttcacagcccttgctcttggcagatattaaaatgccatgcagtaaatacaaggaataatgtgaatatgaagaaagaaactcctgaatgggggtgggatggggatactgttgttagagaagggagagaaaagtggagtagagaaggttctccttagaactgactgtttgatctaagctgggaaggaagagtaggaatcattcacatggataaaggagagaagggcatcctaggtagaacatatgctgaagcacaaaagaacctagaatacttacataacagatcaggatgtctagagtttgtgtggagtttatgaaggaggttaggggagatgagactgtaaaggaataatggagctgctgaaagatcattttttagccataaaaaagaaattgggccaggcacagtggctcagcctgtaatcccagcactttgggatgccaaggcaggtggatcacttgaggtcaggggtttgaaaccagcctgtccaacatggtgaaaccccgtctctactaaaaatacaaaaattagccaggtgtggtggcgcactcctataatcccagctattcaggaggctgaggaacgaaaatcgtttgaaccctgggggacagaggttgccgtgagccgagatcgtgccactgctctccagcctggacgacagagcaagactctgcctcaaaaaaaaaaaaaaagaaaaaagaaaagaaaagaaattggggctggatgtggtggctcacacctgtaatcccagcattttgggagcccaaggtgggaggatcacttgagcccaggagtttgagaccaacctggacaacatactgagacttcgtctctacaaaaaaataaacaaaattagccaggtgtggtggcacatacctgtactcacagctacttgggaggctgaggtgggaggatcacttgagctgagggaggttgaggctacagtgagtcatgattatgccactgactctagcctaggtgacagcgagatcctgcttcaaaaaaacaaacaaacaaacaaaaaagttaaattttattctctgggtattatttgaaggcttttttttttttaaagaccctgttgcagccgggcacggtgactcatgcctgtaatctcagcactttgggaggccgaggcgggcagatcacaaggtcaggagatcgagaccatcctggctaacatggtgaaaccccatctctactaaaaaatacaaaaaaattagccgggtgtggtggcgggtgcctgtagtcccagctacccgggaggctgaggcaggagaatggtgtgaacccaggaggtggagcttgcagtgatccaagatcgcgctactgcactccagcctgggtgacagagcaatactccgtctcaaaaaaaaaaaaaaaaaaaaaaagaccctgttgcccaggctggagtgcagtggcatgatcatatgatcatagttcactataaccttgagcttccaggctcaagtgatcttcctaactcagcctcccaactagctaggactacaggtacatgcctaccatacctagctaattttaaatttttttgtagagacggggttttgctgtgtggcccaggctggtctcaaactcctgggctcaaggcctcagcctcccaaagcactgggattacagatgtgagccaccatgccccatcttatttgaaggcttttagataggagagtggtgtggtgatatctgagctctagaaagatcattcaaaaggcagtgtagaagatggcctagactagagacaaggaacatagaagtctggtagtagttgagtgagagattagacccaacactaaggcagtatggagacagaaggggcactttcagagatagaatccataggatttggtgattggatttggcattaagatgagagagaagaccgtggtaatttccaagtttttggcttgggccactgggtaagaatattttttaaaagccttcaagtaatagccacagaataaatttcaatttttttttttttttttttttttttttttggagacagggttttactctgtcacccaggcaggaatacaatgacacaatctcagctcactgcagcctcgaccttccaagctcaggtgatcctcccacctcaagtagctgggaatatatttgtgcactaccatgtgtggctaatttttctattttttatagagttggggtttcgctatgttatccaggctggtctcaaactcctgggctcaagccactcgtccacctcagcctcccaaagtgctggggttataggcgtgggctaccatgcctggtctcctactttcatattatgtgttttcataaatacctttaagacaatttcttgcttgcttgcttttctttttctttcttctttcttgccttccttccttcgttccttccttccttcccctccctccctcccctcccttccttccttcccctcccctccccactgaggttatagtcagtgaataggtagtctccctgcttttgaatttatgagattccccaccatgctctaatcaatgctactgctacgaaactgtaacttttctaaatagctactaaatatatagctattaaacttttatatgtagttactaaatcttttctaaaacttttccacccaatatcttattagttccactgccctaagaaataggtaaagtgggtattattgtgcccattttgtaaataatgaaattgtgtaacttgcagaaagatttcatggtgaattagtagcaaagctagaaattgaacccagatttactaatatgctgatgtgctatttctactatttttacttcaatcattgcctctttgacatataactctggagatcatgcatctccattacagtattatgaaagaagtacttagtgtactgaggatcgtatcatttcccttacagaataaatgcactaataggcaaaaaccaatgtggactcaattttaagttaagtaattcagaaaaactattccattggtctctatgtaaacaaaactgggaactgtgagtatataggtaaagctcgtgctatgttatcagaggttatctttcccagtccctcactcagtcagcaaatatttgttttagaccacctagtacagtcgtctctcagtctatgcagggattggttccaggacccctgtttataccaaaatccacgcataatcaaggcctacattagtcctgtggaactctcatatgtgaaaagtcaatcttccgtatacagggcttcatatccctagaatagtgtattttcgatccatatttggttgaaaaaaatccacctaaaagtgtggacctgcacagctgaaacctgtgttgttcaagggtcagctgcatgttgaagaatatggctagagctagtttctgtgatagaacatatggagataactatggaaaacagtcttcagatagccttaacttttttcctgatatagaagtggggcctcttcaagaatgtatttactatcacgagggattcatatagcatttggactcttagcagatgtgggtttctttatctttctaatagcagctgccagtgactcatccagctgctaagaataagcagctccaaattcccccagtttctccttgtgccataaacaagacctagattttatgctggctgtttattgttatccttcttaatcagacagcctcagatttcttagactaaatgcaacatctgtgtctaggtgttcctaaaataattggttaagtagctttaatgtattctcagctttttctaggaaactccagaacatctttctaaaccagaatgtgtcaatctccaattttaatccggaattagtgaaaactcttggcggcaaggttctaaaggaaaggatttattaagccccattttatcaattataatgccaggtacctacctactcagtggaactcctactgcattattcttctgcagataacttccttagaatgtcatgtgcatactttagcattatcaagtggaaagtaactcttctgggaggtagcaaaacaagagcataacatatctaaaaatgaagccacctgtagaactctaaggacctggtcccttttgacaaaaaatattttattccagtttttagcaagtacaggatatgatatcttttctgcatgactgagtactgatgctaattatcttgtccaaattttagataatctcatgaagactgtaacaaacctcttggtatctaagcaactttagactcttggaagcaaaagttatattagaattttaaaagcctttaaaattacacttctcactttgctaattttttctgtataggaatattaatctgaattttctaagtctggcaaagattgatattctcttaatgtaaatctttacttctgtttagggatatcggctcaaaagtgccttctccaagtttattttcaattagaatttaattttcaatatatacatatatacacatacatacatatatatatttcatttgataaaataatgataggtacttcctcttctatctgtgaagaagtatctactaagggaattgccctcttgccactaacaatgagaaaatcagcatatctgaaacaacagttttcagacattgggcaataggcagtgggggctgtggattctgagagccagtttccaagcaacagtatagggagagagattgtcaaagagcttagcagtgttattgagttgaggaggcagagactggggtttagggaggctggagcagccagtatttacaggtcagaatccaagagaggaagaagttgttcagtgagctccagaatctttggctacaaattctgcatatgtgtgggctggaaaaagaaccaccagaaaacagtgggccaaacaatttctggagtatacaaggggctaaggataattcaaacttctaccagccatagggaagagacctcaaaacacaccgggcactgggtagagttctcaacagtttaaaagcaaaaaggattaaatcgatccgcaagtaatttaatgctatataagaacaaaattcaataatctttaaaggaatttaacaaaatccagcattcagcaatgcaaaattcacaaagtctgacatccaattcaaaattaccagacaggccaggcatggtggctcatgcctacaatcccaggactttgggaggccaaggcaagtggatcacttgagcccaggagttcatgaccagcttgggcaacagagcaaaaccctgtctctacaaaaaatttaaaaaattagccaggtgtgacacctgtggtcccagctactctaatggctgaggcgggaggattgcttgagcctggaaagttgaggctgcagtgagctgtgatcgcaccactgcactcaagcctgggcaatagagtaagaccctgtctcaaaaacaaaacaaaacaaaataaaattaccagacattaaaagaagcaggaaaatacagcccataaccaggagaaaaattaatcaatagaaacacagatccagaaatgacagagatgatggaattaactaacaaggaccttaaaatagttattttaaatcatataaatatgcttaagtatgtaaagaaaacatgaatatgattaggagattagtggaagatattaaaaagatccaaatggaatttctagacatgaaaaatacaatatagtgaaaatgataataatagcaattaacatttattaagtgcttctatgtagattatctcatttttcttcacaacaaccctatgtgttaggtagatgctattatttcctttgcatagaaaatgaaacagatttagaatgttaaataacttgctgtaggtcacacacccagtcaatgaaaaagccaatgccaggagaagccatgaagtctgactccaggctgtattattgcttcagcgtgttatgcatcaacactgcatgacaggctggaaatacaaatgagtaagtgacaatacttgccctcaaggagctcttattctaggagaagaaacagtagcataggaaccaacccaaatgcccatcaatgatagactggataaagaaaatatggaacatatacaccacagaatactatgcagccataaaaaggaacgagatcgtgtcctttgcagggacatggatgaagctggaagccatcatcctcagcaaactaacacaggaacagaaaaccaaacactgcatgttctcactcataagtgggagttgaacaatgagaacacgatggacacagggaggagaacatcacacaccaggtcctgttggggggctggggggtgaaggaagggaagttagagggcaggtcaatagttgcagcaaaccaccatggtacacgtatacctatgtaacaagcctgcacattctgtacatctatcccgttttttttagaagaaataaaataaactagattcttaattcaaccccaccccctctctgccaaaaaaaacctgagtggtgtagaaatagtctccatagagtacaggtgatttttagagccacacataagattccataatagcacaagggagaaaatagtcaattctatagaagcgggtgaaggctataaaggtgcaaagacagttgggatggatcttggagcagtagaaagctgttaagcaaataaggaatacgttctaaaaacagggaacacgatttctgaaagtatgataacatgaaacaacatggttcctttggaaagtggtaagaagtcattgtggccagtatttaacacataataaggaaacactaccacagtcaataggagataatgcggaatgcttttatgtgccatacactgagcaaaatgtttacatgtattcattcatttaatccacacaataaacatatgagttgatatgattactatcctgttttatatgttaagacacagagtccgctgggcgcggtgactcatgcctgtaatcccagcactttgagagcccgaggcaggtggatccttgaggtcagaagtttgcgaccagcctggccaacatggtgaaatcccttctttactaaaaatacaaaaattagctgggtgtggtggtgcatgcctgtagtcccagctactcaggaggctaaagcaggagaattgcttgagtctgggaggtggaggttgcagtgagccaagatcatgccactgcactccagcctaggcaacagagcgagactctgtctcgaaaaaaaaaaaaaagaaaagaaaaagaatcgaaactgagagtcagaggattaagtaactcacacaaggccacagcgcttataagtagcacagctcatattccaacctacgtcttcacaaagttcacattttcacattctttctcttttcttttcttttttttttttttttttttgtttgagactgagtctcactctgttgcccactcactgcaacctctgcctcccgggcccaagcaatcctcccacctcagcctccctagtagctgggaatacaagcacataccaccacacccagctaatttttgtattttttgtagagatggggtttcaccatgttgcctaggctggtctcaaactcctgggctcaagcagtccacccgcctcagcctcccaaagtgctgattacaggtgtgagccaccactctcaagcccacaaagtccacattcttaacaactctgctgtgcctgctaccccaggttatgaagggctttgtgtgcactaaaaagcataagaatgatacaatggactttggggacccggggaaaggatgggttgggggtgagggataaaggactacaaattgggttcattgttactgcttgggtaatgggtgcaacaaaatctcacaaatcgccactaaagaacctactcatgtaaaccagataccactggttcccccaaaaccctatgaaaataaaaaatttctcctgaagttagtagaatcttctccatttgtgtggtattttcacatgtaacacagacaaaagcatggaaaatgtaaggcaggtaaaagtgaaagcatagacccgttaggagactactacaatataacagaaatgaccatgaaaatgaagagctatttaagaagttggtttgacaggatttgctgattcattgtgtgagggatgtggcagagaaagagtcaagaatgaatgccagaatgtaaagtatggccagttttatccctctcttgcttttttcctttccttttttttctttcatcttttatgtttcactctgaattcacagtggttttgtgttcatatttattcattcgacaaacatttatgtatcagttcttggtgataaagcagtgactgggacagacagaaatttttattcttgtcaactttgctgtatgatcagaaaattgacaaaaatccctgcttttatagagcttacattctaggaatcagggaattgcagtgggtctatctgagtatgtgataaaaatctgttagtttttctaaaatatctattgtttatggtggacaaagtgatgtcaagggaaaatgcagacactttaggctgaaatgaagatgttggtctgacttctttttgtaattgccttgaacttcacttgattttgcttgtcactaatccttatcttcaccagtaaaaatcattcagtgaggattaatagcgctttactacaggagtgggtggctgtctttgaattattaaagagcaattgttgcttctgtaatgttttaaacaaacaagaactgttccatgtggtctcttcagtgatgtgggccccaccagccaattatcttcacctgctccagccagtgcatctcctcttctcattttctcccagaaaccagatgtagacaatcaacaagaatttcagtgcctgtttcctagctcccgttttgtttatttctcctgagttcctaattttccctttgtttttcatgtttatttccttcttcaaaatcttttctccagggagaaaattgacaattgatggcccctcaaatcattcacctctgtacctccaataactttaatctttccccctatttaatgttctcttttttttcaatgttggttatttggggctcttacgcaagcattcctggaatgcttttgtcactatcttctctcccacctgaagctcctcaaccctccatacataatacctgtaggttttagttttaaaggtcaggtccttaaagaagccttctctgtgactcccttccttatctgaattgggtccttccattataatttttcagattatcctctgatttttatcatatcatttattacagtttctgactcagtatttacttgaatgacttttaatgtccatctcccttattaaaattataaactttatgagtacaggaaccttgtttgttttgccagtaattatatccctagcacctaatacaggtgaatgatttttttgttatataatatgaaggcttaccttttcccagtaatgatacagaagatagattattgaatggattatattatcattcattttatcagaggataggttagtttttaaaatctgctttacactaacttttctatattgtataggaacttctgatttaaattaataatagctaccccttattgagcaaatgctatatgccaggtactaaagttcatgtttaaagtgttccactaaaaaccagcctaatcaaagctatactatactaaataacacctaattaaaataatattcagtattccaaaataaggatttgaaagatttagatcatgatctgtaatcaaactttaaacactggtgaatagtacatccgttccttcttttgtattctgggtttttgccttcactccatgaaaggtatcacaaactagtagtcggctaactacacatgccttggcctacagatgtgtcttctttgactttcagtgttaaaaatacttagattcaattagatgccaatgtttcacataaaagtctcaatttcagtttcacttgaagaatggaaaatcctcccagcaccatgcccacattcctgcagggagacagttcaccagggcagagatgcagctgctccctttagacagggcatgtggtctcagatttaccaccaacccaagctgccctgcttcacctgctgacattccctgcgcgtctgtaggcattggagtttgctaccattgctagagcttcttggtccatttataatcactaaaaggtaaagtttcactcttaattcagtcaggagctttttcctcaactattaatagattctctttctcttttctccttgatatctccatgatatcacataaaattttagaattagaagggaccttagaaattatttcatcttgaaactaggtcttaaatatatatatatggtttttcttattattgtggtaaaatatataacaaaatttaccatttaccactttttaatttgagaaatcttttttatggcaataaaacctatataacaaaacttaccactttaaccatttttaagtgtacagttccgtggcattaagtacattcacagtgttgtgcaaccattattaccctccatctccaaaactctttatcttgcaaaaccgaaactcagtagccattaaacaatgactcccatttctctcctcctccagtccctagaaaccaccattctactttctgtatctatgtatttgactattctagatacatcagataagtgtgtacaatatctgtccttttgtgtctcacttatgtaacttagcatgatgttttcaaagtgcatccatgttgtaatatgtatctgaatttcattcctttttatggctgaataatattccattgtgtgtatataccacattttgtttattcattcacctgttgatggccacttgggttgtttctacattttcgctgttgtaagtaatgctgctatgaatgtaagtgtacaaatatctttctagtccctgctttccattactttgggcacataactagaagtgggattactgtaccatacagtaattttatgtttaattttttgaggaactgctgtaaagttttctacagcaggtgtatcattttacattctcaccagcaatgcataagggttccagtttctccacatccccaataatgcttgttgctattttctatttttctgataatagccatcctaaagaatgtgaagtggtatctcatggttttgatttgcatttccttaatgacaaatgatgttgagtgtcttttaatatgcttattagccattttatatcttctctagaggagtatctattcaagccctttgccctttttgaatcaggctgttttgtcgttgagttgtaggagttcttcatgtattctggatattcattccttatcaggtatatgatttgcaaattttttttctgttctgtaggtcatcttttcactttttttttatcatatcctctgatgtacaaaagttcttaatttcaatgaagtccaatttatctgtttttcttttgtcctctgtgtttttggtgttatatctaggaaatcatttacaaatccagtgtcatggagatttcccctatgttttcttctaagaaatttctagttttagctcataaatttaggtatttgatcaattttgagttaatttttatgtaaggtattaggtaagggtccaacttcattcttttgcacgtgcatattcagttttcccaacaccatttattgaaaagactgtcctttctccccttgaatggtaccctttgcacccttgtcaaaagtcaaatgaccatatatatgaggatttttgtttctgggatttacattctcttttgttggtttgcctgtccttatgattactgtggctttgtaataagttggggtttttttgttttgtttgtttgtttgtttggtttgtttgttttgagatagagtctcactctgttgcccaggctggagtgcagtggcacgatctcagctcaccgcaacctccacctcctgggttcaagcgattctcctgcttcagcctcctgtgtagctgggattacaggcacatgctaccacacccgctaatttttgtatttttagtagagacggggtttcatcattttggtcaggctagtcttgaactcctgaccttgtgatccacctgcttcggcctcccaaagtgctgggatgataggcttcagccaccacacccagccttgtaataagttttaaaatcaagaaatgtgagtcatccaactttgttcttcttcaaggttgttttgggtattcttggtccttttaaagatattttatgaatggttttttctattaaaaaataccattggaataccattggaattttgataggattgcagtgaatctatagatcactttcggtggtagtatcaccttgacaatattaagtcatttaatctatgaacataggatgtgtttccatttatttaggtcatcttcagtttctttcagcaattttttttttaagagaaagtgtcttgctctgttgccctggctggagtgcagtggcacaatcatagctaattgtagccttgaactcctgggctcaagcaatcctcccacctctgccatcaagcccagctaattttttatttcttttagagatgaggtctcactctgttgcccagactggtctcaaactcctggcctcaagcaatcttcctgcctctgccttccaaagcagaggggttgcaggcatgagctaccacgcccagcctctttcagcgatgttttgtagttttcaagtatacaagtctgtcacctccttggttaaatttattcctaagtattttattcttttcatgctattgtaaatggaattgtttttcttagtttccttttcatatttttcattgttaatttataaaaatataattgattattattattattatttttttgagacaaagtctcactctgtcgcccaggctagagtgtagtggcgtgatctcggttcactgcaacctccgccacccgggttcgagcaattcacctgcttcagcctcccaaatagctgagattacagggacatgccaccaccccagcatgtaattgatttttgtatcttgattttgtatgctgcatctttgctgaattcatttattaggtctaacagttgtgtgtgtgtgtgtgtgtgtgtgtaaaatctttagggctttctgcatataagatcatatcatctgtgaacagaggttattttatttctttctttctaatttggatgccttgtgggttttttttttttttttttttttttgtttgtttgttttttccttaattgctctggctagaacttcctgtactatgatgaatagaagtagtgaaagcaggcatctttgtctttttcctgatcttaggggaaaagtttttcagtacagcaggtcctcaaataacataattgcattataacattgatgaggaaaaaaaaaattgattcccagctggggccactgtgtgaaatttgcacattctccccatgtctgcatggattttctctgggtactccagttttctaccacagatgtatgtgttgggttcattggtgtgactaaatggtcccagtgtgagtgaatgttggtgtgtgtgtgtgctccccgagatggaatgagatgtcctgtacagggctatccaccttgtgtcccaggcttccaggataggctctggccacctgcaaccctaagctagaataagcaggttggaaaatgaatgaatacaaattattattgaatacaaattattatcaaatacaaatttataaagtagatgataatcatacaactgcacaacaataagcgatgaggtatgaaagcgttcagctagcccaccatatttgtgattgttttttaattcatggtcggaggaggtgctccttaaatttttctatttgcaaatatctattcccttatttaatccaccaccactacaactgtcgtcattcagcgattcaccaaaaattgggtaatcttacttgttgttattaacctttcttaaatgtatgtatagcccacatttatttcaatgtttaatattagaggtgtgtagggtctttatttagaagttgggtgattatttgtgaccagaaacatgccataggaacttaactcttgtttatgtcgattagcctatgatgaaattggttttattataccttgtttcacttaaagtcagtttccaagaacctattgatgaggttgaggacttttatttggttttaaggtaaaagtgtgccaaaaaattgagattcatacagataagtagcttcaaatactaatagatttgtttttaacattttgactgatctttttttagctttactaatgttcagaaagggagtaatagtaaatttgtgtttcaaagctgagttgctcacattcctaattaatgagtaatcactctggagaaatcaacaaattttctcagctagtttaaaaattttattgtttggagaaaaataaatgtatattataacatcatatataagttgttcaatggtattattttttgaaaagatcagatgactcaaaggctagtatgactgaactgtgtctgccccccccaaattcccatgttgaagccatacctccaatgtgactatatttgaagaaattcctcctgtaaggaggaaattaaggttaagagaggtgataagggtagggcttcatcagataggaaggattagtatccttgcaagaagagacaccggaactggtgtccctgtaagaggagataccagagagctgcccatgcccctccacgtgaggacacagtgagaaggcagctgtctgcaaaccaaggagagagcctttaccagacaccaactctgctggcaccttgatctcagacttccagtccccagaactgtgagaaaattaatttctgctgtttaagtcactcagtctatggtatttgttacggcagcccggacagactaacacagaggtcttctttttaactcacagtttcagcacagaaagattcattttattttgcatgttgactccaaaacctgttttgatttatcattaacattttatctgaagttgtgagtatggccgtgttgtgaccctgcgttatcaaattgagccatctaatttatttccacattgataaacttatattcaatggattttagtttaaggtagaaataatggtaattactttttttttttaactgtagtcctcatacctgccttatgtcaatcaggaaactttagtataaaagaataaattttgatacaactgcttatatccctgcaaataactcagaaagatctgcagcttaaagactttgtcctaataaaactgacagcctgtatcaatctgtatgttatccaatgtaatattttttaaaatgtaaatgttaattttgaaaactgcatgtgtaattttggccaggcacagtggcttatgcctgtaatcccagtactttgagaggctgaggtgggcagatcatttgaggccaggagttcaagaccaacctggccaacatggtgaaaccctgtctctattaaaaacacaaaaattagtgaagcacggtggcgcgcgcctgtaattgcagctactcaggaggctgaggtgggagaattgtttgaacctaggaggcagaggttgcagtgagccaagatcatgccactgcactccaatatgggtgacagagcaagactccatctcaaaaaaaagaaaagaaaacttcttgtataattttaactgctagtgcttatctacacaatatttttggctgccttctcttttatgtgatcctctactccttgaatttttttctgccattgcctttccagtcaccgtacaaatatgactaccttatactactttgttagtatcttaacacttaaagacttccattttataattatcaagcattttataaaataataaatttactttgcatttgcttctataccagatcatataagtaaaaggagagcttgacaacatctgtcttctcatccagtataaagattttatgtaatctcagctttcatgccaatatagtcctggattaaaaagaaaataaaaagaccagagcagataataatttcctaatcagtggcacatttacagttgcaaatatatatatatatttgtggagtaggagaaattccacaaatgagttaacctatgagcacaggttgatagtgtgtgtatattaaaatttactgtgtaacatatttagtgtacattttgtttttcttatagactttaaataaaagtatgtttttaataagaattgaaattaaacttttatagaaacttctaagtgcctctgcaaatttctaagcttctgtggaacatggtttgaaaactactgatctacttcaacccttccccattgtgtaaatataaaaatcaaagccaaggtctcctagtcacttggtaggacctgtaaaaccaagactaaattcaggtcttctggttgtcagtcaaatgttctagccattatcatgctctgctgctaaatgaacatatacattttgtgtcatttagtctctgagatgaatgtatgattttgtagcccaaaacgtaattgtagtagttaaggcataagaatgcattgcccatgtgattttatttcttctttcattgttttacagatgaaggtaaagtagctacaagttctttaattttaagttccattttacctatcttcaagagaaaaaatagttactccacctggtttaaaatttaaaaataataattcttattagagagggacgtataatacttgtttattggatatttcatgctttgaaggacataataagcagattttggaagttctttgaaaatacaagagttttattgttgttgttgttgctgtttattttattattattattttttttttgagacagagtctcactctgtagcccaggttggagtgcagtggcacgatctcactcactgctacctcctcctcctgggtcctggttccagcaattctcctgcctcagcctcccaaatagctgggattaccggcatgtgccaccatgcccagctaatttttgtgtttttagtagagacgggggtttcaccatgttggccaggctggtcttgaactcctgacctcatgatccacccgccttggcctcccaaagtgctgggattacaggcatgagccaccgcacccggccgttgttgctttttaattttaaagttaggctgaagtgagactgtaacacacaacgttattaaacgcattctctaaagtagatctaccaagccaggcacagtgcacatgccggtaatctcacttgagcccaggagcccaggagttggagaacataagtgcactatgaatgtgcctgtaaatacccactgatctgcagcctgggcaacagagtgagacaccatctcaaacagggtgggtggatggatggagagagggggagagagagagagagagagagctggaagtatgtaaaagcaaatataaataatgttgaaaatttaatattttccagttttattttgcttggcataacctgctcttgattcccactgataccgcctgaccctaatttagaaacctaattagacaccttggggaggttgtcaaaaagacagattccttgatcccacctcaaacgtactcgaccacagccagcaggcaaggggcctgggaattaattttaacaagcatttcaggtgattcttaggatcactcaagtttgggaaacattaagcggtttcaaccctgcttgcatattaggatcagctagggtgcttttaaaaaatactgttgcctaggtccctccccagaccactttaatcagaatctttttggttgggacccaggcattttaaatgctctgcaggtggttctcatacacactgaagcttgagaactcctgcaagacagttggaaatgtaattctctgaagcacagccctggtcttgtcactgctgctgagaacctcaatggttctgtattgcctactaatgaaatatgaatttatgactatcataaggctactcatgacccaacaccagctttccaaccactactctcctacttatagactatactctggccacacagaaacactttccccaaacactccttgtgctttccccctttcacacctctgtttttgctttcccaccatgtagaactttcccccatgtctgtctgtcacagtcctgcccatcctcaaatagacccagctcaagtagattcccatttcctcctgtccttgccctcccctgcctccattcaaaagcgacctcttagggcatttgtcctatcataccttatatttagttattggcagatacatagtctctttcataaaatgccatgtggaattaagaataagtggatttttatctttcctttttccccatctagattgtaaatttgtaatatcaactatctgtttacttctgtgtgaggcactaaagagaaagactttagagtcaaatggccctaggttcaggtgccttttttattggatatggctgtgtgaccatggtcaggttaatttttccaagccttagttttctcatctataaaatggagaatatactacttcagtgttgtgaaaactagatttgataaccgactggagccttcagtaatcccggtatgtaataactgctctgtcaaagtctgttgcttttatcattgtgataatgatcattgttagctcccttgagggcaaagactgcatattttatctttggatccccattctgaaccttgcttattgtaggtgcttgataaatactgggtgaataaaataatgaatgcctgctgggtcgtgcttacttatatagtccactaccaatcagttcagcctgtcttggaaggagcacttcaaatttcaatttaaccatcagataaagatagaaaataggatttccactacaaactttaaaaactgtattaaaaaggccaaaaccccagttaaactgtaagacagctgctctctttctgctgccaggaaatagagaaaaccctccaaggactatttgctgtttgtttgtgcatcatataataaacatgctgtgacttggggagagcacacacttcccctgcaggcaagcttgggtttgggaagttgcatgtagcagcagtgaggaagaaatcccccactctgtgggagaggttccttcacggactccactaagcccatttgcagttttgctgagttatttactaagatgaagggactgggtgtggctggtctgagattcctcctgggaagtcacttcaagaatctccttaatttcctcacccttcatctttgttctctggctttggtgcaagggtgcagtcagtcgcacccagttggctgctgttcccagcacactgaattatttgaagctggctgtggcagccaaggattccctgttctgttcttttccccttgccctgatttgaaaaacggtctggaaattctcatctggcatgaccagaaggaacttagtaggttgcaagctgtttttctagatgcacaggaccaaacagaacctttaaagctgtaaattaccatttctcaaaaactcaatttgatggattttacatggacaaattatataacgtaggctttaccatcaccactatcgtttaaacaagaggccatccaattgagatgaaaccgatataggaaagtaattatcatcagctttgtcacttgaagaaggaatgtgaggatatattagctaattgaaacctcaggaaagatgtataacaaaacatataaggattaatgagtagtccacaaaagtgtttaccagatgaccaatatcttttaaaatatatagatgtattccagctcttttaattagaaaatatatatatatacacacacacatatatggataaaaaatgaacttataattacaatagatgtgatgacaaaataattcatagtctgaaaaatatataatttcagtgatcagagccttatgtattatgctaattgtccaataatttcttgaaagtatgtttctacttttaaagtaaaattaaattcagaaagcaatgatgagcaaatatgtgataatattctaggcagacactgaacatttatatttattgtgagaacagcatgatggtagagtactatttatataaaattatgtatctttatgtctttatatgtttacatgcatacaaaaatatttggaaggaggtttactgaaatgttgtgaatgattttctcttagtgttgagactacttttttcttcacacatttttatattgtctgagtttttataatgagcatataacatttttataatcatagtaaaaataaagctatttttatagctttcatataggaaaattttgcttgagcatctgctatgtgtccaaagtggtactagaaattatgagatataggaaagaaggctgtggcctggctaccaagatgcttacaatctagctgggaagacaactagggagtgggatcctatagaatgtaatccggtgtcgggatgtatggttcaaaaaggtgctacggagcatcaggaagaggagaggaagctctcaatggaaggaagctttcatcgaaaatgaagattaggctgggtgcagtgactcatgcctgtaatccgagcactttggggggccagggtaggagggttgcttgagcccaggagttcaaaaccaacttgagcaacatagtgagaccctgtatttttttgagaaatattttaaaacttagaaagaaagaaaaggaagcttagattggaccttgaaagatggacaaaaattgaataggagggagagaagaaggcattttaggcagcatgagcgctaaagtgataataataatgctttttgaaaagaaaggaggaaaccagcttgtctagaataaaaagtaaatatgatttgtgatggagaagtttgctttattgctaagtttatttcataagatatctttgatatattacaaactatatttttgtatacttgagcaggtcctagaaaaatattttgtaattattctgaatattgactctaaagtgatgtaaaaactatgactactatgaaaaattcattattttagtgtattgagggtagaagatttcagtacatatgctgtgtaacactgtcatctctgtgcacaagcttgttctcaagtcaaacagtggcttttcatatagtcttttaatttgtggttaatatgttcctacacctttcttcttctattaaaaaaatcaaattagccgaacgtggtggtgcacacctgtaatcccagctacttgggaggctcaggcgggagaatctcttgaactcgggaggcagtggttgcagtgagctgagattgcgccactgcactccagcctgggcaacagtctcaacaacaacaacaacaaatcaaaaagcaccagttgccatggctcatgcctatagtcctagcactttgggaggcaaacatgggaggattgcttgagcccaagaatttgagaccagcctgggcaacacaatgagaccaacatctctacaaaaataagaaaaactcaccaggcatagtggctcacgcctctggcccagctacttgggaggctgaggtgggaagattccttgagctcaggaggttgaggctgcagtgagctgtgatcatgccactgcatttcagcctgggcaacagagcaagatcctgtctcagaaaaaaaaaaaaaaaaaaaacagaaaaaaaaaaatcaaaactaaggttggggaaggggggaaattttcttttaaaaaagacattaagatggagacttttcaaacaatggaatcagaattcacttttagcagttacttagttaacaggactatattctgtttgtagtgtataccctaaatgctgtagccatgtaagtgataattacaatgtatacaagtcttcctgagaaccatatatttgaaattttaagtacaaaatgtcagccataaagttttccttattgaatttgtgtattattaagtgctttcaatgttcaaagctctatgccagatgaaagatatacagggagctccctcattcatcgattcgtttattcaacagtatttttttagtgtgtcctctgtgccaggtattattctaggtgctggtactaaaagaataaggagaatatagttctatttttaaagagttcacagtctcgtctgaaagaaaatggacatgtaaatagttatagaccctctagaaagtgtcaggccaaatacatgtgtttatttgctgtctctgtagagcacactaaaattgtaatacgtcaggtgtggtggcttatgcctgtaatcccaggactttggggaggccaaggcaggaagatcacttgaggtcaggagttcgagaccagcttggccaacatggtgaaaccccatatctactaaaactacaaaaattagccaggtgtgatggcagatgtctgtagtcccagctacttgggacttgaggcaggagaatcggttgaacccaggagacagaggctgcagtgagccgagatcgcagcactgcacttcagcttgggcaacagtgcaagaccttgcctcaaaaaataaataaataaaataaaataaaagtataataaagagggagaaaagatgtaaaggcacaagaacaaaacaaaggaagacatgacaggaaataatagatatccaccaaattttagacggtggacagcagaagcataagtaaaaactgatttggtaaagaaaactgatgtataactacttgcaaaaggaaaaaggtatgtttgtgccatagaggcctaaaagggttcaagaattggaggtgggttcaagaattggaggtgtcggccaggcgtggtggcctcacgcctgtaattccagcactttgggaggcagaggcagacagatcacctgaggtcaggagcttgcgaccagcctggccagggtggttaagccccgtctctacaaaaatacaaaaattagctcagcatgatggcaggtgcctgtaatcccagctactcaggaggctgaggcaggtgaatctcttgaacctgagaggtggaggttgctgggttgctgtgagctgatattgcgccactgtactccaggcctgggtgacagagcgagattcattctcaaaaaaaaaaaaaaaaaaaaaaaaaagaattggaggtgtcaagtactctgaaactgggagtgagaggggagctgaaaataagaggatatattgaaaatcattatgaggagcaattagatccccagatccctcccccaacttcaagcatcaaggtcactacccttcattccatagaagactggagatattaaactagaggagctcttgactcaggagcaccagacacagagcgtaggtgagatgccctagtgaaaaaagattgtcaatgtctatctgctaaatgttgacatttattttccagctcccttcccttgcttagctgtcagaatgctggcttccaaatgaatataccccaggtgggattctggaatattttctggagaaactgaaatagcctcagaggaagtccctacaaatctgacatttaggagttgcacaatgaaatgaccaggtttccgcccattcattctacagtgaagctcaatataaacaagctccaattcattcagataaccagttttttagtacctcgcaccaaataggaatgaacatattcaggtattcaaggatcaccagaaatttgggggaagtctctaatatgatagccagaagccaaaacaaaacaaaatagaggccaggcatggtggctcacacctataatcccagcactttgggaggccgaggagggcagatcacctgaggtcaggagttcaagaccagcctggctaacatggcaaaaccccgtctctactaaaaatataaaaatcagctggccatggtgcctgtaatcccagctactcgggagactgaggcacaagaattgcttgaacccagtaggcagatgttgcagtgagccaagatggtgccactgcactgcagcctgggtgatggagcaagactctgtctccaaaaaaaaaaaaggaacaagaaagagttcttagaaagtaaacattgtaatagctgaaagaaaaattcagtagatgggttgaaagatcaagaaattacccagcaaaggcaaagaagtagaaaacaggaggaaaaaaaaaaaaaaagaaaactgaaggcccagtccaggagtataagacctaaaaatttgaagttctagaaagagaaattggaagaactagaatgccatcaggcttctcaacagcaacatgagaagcttaaaaaaaaaaaaagtgcaatgcttttagaattctaagagaaaattattttcaacctagaattctgtaccaaaccgaactatcaatcaactgtgaggataaagttgtttttttttttttttctttttagacagagtcttgctcttgtcgcccaggctggagttcagtggcccaaactcggctcactgcaacctccgcctcctgggttcaagcgattctcctgcctcagcctcccaagcagctgagattagaggcacccgccaccacacccagctaattttttgtatttttagtagagacgggtttcaccttgttggtcgggctggtctcgaactcctgacctcaggtgatctgcccacctcggcctcccaaagtgctaggattacaggtgtgagccactacacccagccgaggataaagatttttagatgggcagggtttcataaactttaacttttatgcagcctttctcatgaaactactgaagagtatgttttatcaaaaagtgagaataagtttaggaagatgaaattatgagatctagcatcaaggggtgcaacacaggagagaaagaaagagaattcttagaatgataatggaaggtagttgcaggacaacagtttgtgcaagacagctagaaagcaattcagattgaagtagcaggacagaaggctctaggaggaatttctgcaggaaaattaaataatagaattgattatctgttgtgtaaaaaaattgtccaaccttcagttggagaattagggtttaatacttcagttgaagaagcactgattaatacttaaaaacccccacaaaccgagaaagaaataatcattctaagaaaaacaaaaggttgtataagaaagaaaatataataatataccttgtgtttttgctgtgcataatatttacatagtcataaatgagtaaatactgaatattggtaagccaaaattagtatcatgaaaagatggacagatgggaagtatatgtgtgtggtgaaaaagataatttgtcatcttcaactgaaagttaaaagatgtctaacatttaaaaatcaagaaatagcagtataaacatattatttaaagaagcaaagcaaaaaacagaggactcagtgagttttgttaagtatgacaggttagaagaattactacagtagtttggttggggtgaaatgagttataacttccaagagaaccattttagttgagtgacggaagcaacgttgaaggagttactgagtgaatgaatgggtagtaagaaagaggaggtaatgagcatagcatactcctctgagaaatctggctttgaaaacaaagggaggagaaagcggtgttagtgagttgagtctatgaaagattttttagattaagacaccacttagacatgtgtgcatagacagcaaggagttaatggagaaggtaaggtcaacgatgcaagcgtaaaggggatagttggtggagcaaggtcccagaaactgagataacatggactcaagagcatagatggaaagattaattgtaggaagagaagggaaagatttctttctctgaaagaaggaaggaagaggtgcagataagtgaaaatgcagagaaatattaaggtataaaggaaggaaattgagggacttaaaaaggtggcttcagtcttctcaagaaaataagaggttctctgctgagagtttggatttggggcataggattagcttggaaatttgagaatggaaaatatctgaaggcatgtgatgccaagttaaaaggagatgactaaaatgattatccagtagccacgagtgtccagttgaggttagatagcagaaatttgtaataaagccaatcaatatggtttctggacttccctcaagaacgttctatctccaaaagttgtattaatcatcatcttggctaggatggcgtttccttggagtgtcttaagagacattccagggttcaaaaactttagaaaatgcttgctcaaggagagtcagtgctcaagaataccagagagaaggttttcttgtgggacacttcaatctaggtcattcggaggtcttgtgggggatcatgagcaacgaaaaagaaatatacttgagagacttaaatgacacaaaacagtttgatatcaaaaagatctgtagctgcatggacatctggacacaaatctgagggtgagagcgtgttggagaacacctggattcagataaaagaagagcagaagagaagtgacatcattgtgggattagaatatagactacctagccagatggaagaaatagataaagcatttctgatgcagatcgcaaaactggcctgagtcaagagagcttggtgatagggatttcaagcatcagcacataagctcaaagtcaagttcagccaaaagctgcatacttgattaattctttttttcctgtttgtttatgtttttctgatcaaagaaaaacttgctcattgtagaaatgtagtagtacaggaaagtgtaatgaagtagaaaaataatcactcataaatccactcaccattaaaatacttgctaattatttctagtatttttatgcattgttgtctttgcatagtagagattatgctgaatatacatttgtctaaactgttttttaacataaaagacttttctcatatatatttcttatatatctcatatattttcatatatatctgaaattctttttatatgttcatctttcagaaggaagaaatacggccgggcgcggtggctcacgcctgtaatcccagcactttgggaggcggaggcgagtggatcacttgaggtcaggagttcgagaccagcctgaccaacacggtgataccccgtctctattaaaaatacaaaaaaatttagccgggcatggttgcacacacctgtaatcccagctacttgggagggtgaggcaggagaatcacgtgaacccggaggcaaaggttgcagtgagccaaggtcatgccattgtactgcagcctgggaaacatgagtaaaactccatctcaaaaacaaacaaacaaaaaaaaggaagaaatatgagataggagtccaagatatatataattataaaaataatttcagggccgggcgcggtggctcacgcctgtaatcccaacacttggggaggccgaggcaggcggatcatgaggtcaggagatcgagaccatcctggctaacatggtgaaaccctgtctctactaaaaatacaaaaaattagccaggggtggtggcacgcgcctatagtcccagctgctcaggaggctgaggtaggagaattgcttgaacccgggagatggaggttgcagtgagccaagatcgtgccactgcactccagcctgggtgacagagtgaaactccgtctcaaaaaataataatttcactatttactctttgctaacattatttccatttttctgaaaataaccagtcaatgctactgtattaggcaggaaaaagaaataagaggcataaaaattttaaaagagaaggaaaaattacatgattgcaggtgatatgattacttagctggaaagcccaaggtaatcaaattgaaatctattataaacattatgcttcagcaaggtagatggacaaaatatactaaaatcaataatttattttaaaaaataataagggccaggtgcagtggctcacacctgcaatcctagcacgttgggaggccgaggcaggcagattgcttgagcctaggagttcgagaccagcctgggaaacatggtgaaactctgtctctacaaaaaatacaaaaattggccaggcatagtggtgtgtgcctgtagtgctagctactgggaaggctgagatgggaggatcacttgagcctgggagtttaaggatgcagtgagccaagatcagaccactgcactccagcctgggcaatagagcaagaccccatctcaaaaaaaaaaaaaaaagattacatacctaggaagaaatgtaacaagaatatgaagagagctttaaaacactactggaaacaaaaaaaagacttggacatatggaaaggcatggtatgttcttaggaagatttaaaatcataaacctgtcagtgctccttaatttaatctataagttaacatgatctccctaaaaaaaaccaataggactttttgcttatttgcttatttttttgagagaaatgattgtaaagctcatacagaaaaaatatgtagactaaaataaccagaaatatcccgagaaagaaaagaaataatgagataccagcctcgttaatatctataatagatattaaaatctgttataaagctataataattccactataattgctaacaataaacactgtgtgccaggcactgttctaagctctttaaatataacaattcatttaattctcataaaagcccgttgagattaacctactcaaactcacactgccaataagtggcagagctcagatttgaactcaggtgctagctccagaacatgtactctctccatcaccacactcttcatcaccagcacatttgttattgacatattaatagacaggcaatcaatggaccagaatcagaagcttagaaattgactcaaatatagaaataaaattaatctacattggggagagcatttaaattaatgagcacaactggtagccatgttaagaatatgatattggattctttcctcacatcttatatgcaaacaaattctagatggatcaaaaatttcaatataggccagctacagtggctcatacctgtaatcccagcactttgggaggccgaggtgggaggattgcttgaacccaggagttcaagactagcctgggcaatgtaaagaaatctgtctctacaaaaaaaccttttttttttttttttttacagcagggtgtggtggcgcacgcttatattaggttggtgcaaaggtaattgcggcttttgccattcgtagcaatagtctcagctactcgaaaggctgaggtgaggggatcacttgagcccaggagttggaggcttcagtgagccatgatcacaccactgcactcccgcctgggagacggagtgagaccctgtctcaaaaaaaaaaaaaaaaaatacaaaaaacaaaaacacaaacatgaagaaaccacagaaagatgttcttacaatctcacagaagggaagatgtttctaagagagctgataaaaaaaaacctggaagccataaaagaaaagattgatatattttgttgcagaaagaggaaaaatatttgcttgccaacaaatactgtaaacaataacaaaagattaacaacaaacagaaagtatttgcaacttatatcacagatgaagggctaatttccttatatacagagttcctaaaaatcaataataaaaataccaaaaactcagtagaagattgaaggatgaaaatgaacagagtttatagtaaaggattgtataagtggttctttaaaaattatttttaataactagattgagatataatttatataccatacaattcacctatttaaagtgtacaattcagtcgtttttagaatattcagttgtaaaaccatcaccaaaatcagttttagaatattttcatcaagccccctctgccaagaaaaataccccgtacacattagcagtaactcccctttttccccacccacaaactcccagtcctaggcaaccactaacctactttctgtctctgtggatatgcctattctggacatttcatatagattatatatagatagaatcatacaatatatgggcttctgtatttggtttctttcactcaatgttttcttttctttgtttttatttaagttcttggggtacatgtgcaggatgtgcaggtttgttacataggtaaatgtgtgccatagtggtttgctgcacagatcaacccatcacttaggtattaagcccagtatgcattagctattttttctaatgttctccctcccccgacctcaccccccaacaggccccagtatgtgttgttcccctccctgtgtccatgtgttctcattgttcagctcccacttataaatgagaacatgcggtgtttgtttttctgttcctgcgttagtttgctgaggataatggcttccagctccatccttgtccctgcaaaggacatgatctcattcctttttatggctgcatcacttacagttttcaagatttatccatgttgtaacatgtatcagtactttattcctttttgtggccaaataatattccattgtatgattataccacattttgtctatccattcatccattgatagacattggattgtttccactttttggctatcatgaataatgctgctgtggatgtttgtatacacacttttttgtgaacatgttttcagttctcttggatatatacctaggagtggaatattgggtcatatggtaattctgtgtttgaaagaacagccaaactgttttccaaaatgcctgcactctgttacattcccagtaacagtttatgagggttacaatttctccacattcttgccagcatttgatgttacgtgtcttttttattatcgccagcctagaggtgtgaaatggtatctcactatccttttgatttgtattttcctgatgactaatgatgtcgaacatctttttacatgcatattagccatttgtgtatcttttctggagaaatgttcatccacattgtggaatgtatcagcacttcattcctttttactgctatgtagtattccgttgtatgaatatagcacactttgctttttgtttgcttgttaatgtacacttgggttatgtacagtttttgcccattatgaataaatcttctaggaacatttgtctccaggtctttttatggatgtatgttttcatttatcttgggtaaatacctaagggttgaattactgactgctttctaaaacagttgtaccatcttacattcccaccagcaatgtatgagaattccagtttttacaattgcttgttaacatttggtattgtcagtcttttgcattttagccattctagtggttgtgaaatgaaatctcattgtggttttagtttgcatttccctgatgactaatgatgttgaatactttttactgcttgttggtcatttgtatatcttcctttgtgaagtgtctcttcaaatattttgcccaatttttagtgggttgtttgtctttttattatccagtggtaggagttctttacacattctggttacaagttagatatgttcattacaaatattttctccctctgtggcctctttatttatttccttagtgatgtcttttattgagcagaagttttaattttttagcattttttttcttttatggttaatgccttctgggtccagtctaaaaaatctttgcctaccctaaggctgtgacagtgttaccctatatttccttctaaaagcaatagaggtttaacttttatgtttaggcctataattcatcctgaattattttttgttggtagtttaagattgagggtcaaggtttttccccgctcccctcatggatagccagttgagacagtatgatttattgaaaagactttccttctcctacttgttgtggttcctttgttaaaaataaataaataaattgaccatgtattaatatgtgcatatctatctctggattctctattctgttccattgatctaaggtagtgtatgcccttcaactttttctttttcaagattgttttattcattcaaggccctttgcatttccatataaaatttagaataaactggttcatttctacaaaaaaagcctgatgagaattggattgaaattattaagaatcgccgggtgcgatggattacgcctgtaatcccagcactttgggaggccaaggtgggcagatcacctgaggtcaggagtttgagaccagcctgaccaacatgcccctgaccaacatggagaaaccccatctctactaaaaatacaaaaaaaaattagctgggcgtggtggtggacacctgtaatcccagctagtcgggaggctgaggcagaagaattgcttgaacccgagaggcagaggttgcagtgagccaagatcacgccactgcactccagcctggcaacagagcgagactccatctcaaacaaacaaacaaacagtaagacccgaaatattatttttgaaccccaagctcacttttgtatagatatacctactctagaaacaatgacaaaactaggaattgtgacacaatactaaagacaatattaaaaggcttttttaaaaagttacattgggagcaaaaagaacaaggaggcctaggtgggtggtatcatattaatgaatgaaagaaagaaaatagagcattcacctctattttggtttagtcttctctgtcaaagaggatactctttggactggaaaagataaaataaacactggttccagggaatgcagtcaaacgtagttgagattgaaataggtcatgcaactgctttaaatgatttcaagttccttaatcttatatttcaagatactgaggactaggctgggcgcagtggctcatgcatgaaatctcagcactttgggaggctgaggtgggtggatcacctgaggtcaggagttcgagaccagcctggctaacatgacgaaaccccgtctctactaaaaatacaaaaattagctgggtgtggtggcaggcacctgtaatcccaggtactagggaggctaaggctggaaaatcacttgaacccaggaagcagagccaaggtcgcaccattgcactctagtctgggtgacgagtgaaactctgtctcaaaaaaaaaaaagatactgaggactagtggatgagctggctgaagcattgctggcagtctctgagaaagtgtgcatggggagggggaattaggggatgggggtcggggatggatagaaatttcagaagattagagtcaaggaactaatattcaggaggtcacttcagcagacttgacatccatcttaggtaatattcttaaactacttatgaacaagaataagttaagaggcctggcacagtggctcacgcctgaaatcccagcactttgggaggtggagtcgggcggatcacttgaggtcaggagtttgagaccagcctggccaacatgatgaaaccccatctctactaaaaatccaaaaaaaaaaaaaaaaaaaaaaatagctggctgtggtagtacatacctgtaatcccagctacttgagaggctgaggcaggagaatcccttgaacccgggaggcagcggttacagagagccaagattgcgccactgcactccagcctgtgtgatggagtgagactctgtggaaaaaaaattttttaaaaagaataaattaagaaaaggaagttgggatcaccataagcttaccagaatttattgaagatggagacagaaaaggggaggaagtagggggtaaagggggaaaggaagaagggaagagaagataataaaggggaagggaagggacaggaggcgaaggaaaaggaataggaaaagattccaggcttagtgggtaaagaagacttgatttcaaccctggctcttttacttcttagtaaaatgatgttaggcaagttattaattgctataagctagatttccttattggtaaaattgaaataagagaaactacttcatagagtagtcctgatgattaaattaaataatgtgtataaagtgcttatttatcaaaagcagtgataactgtgaagggggtgaatgatggtaatgacaataatactgacggagaaggaacgggagtagacaatgtaaacttactccctttttgaagagattattacattggtaagttgacagaaatctgtacagtatagctatatttagtatagctatatttagtatatttgtttagctaaattggatttctacaagactttgacaacatctccatgacatccttgcgaacaaggagaaggaatataggctggatgatataggctggttgaatagtcatacttaaagtgtgctgattaatgggttcctgtcatgctgaaattctccaggagtgtaaatctggactatgtacttagccaagcttttttaaaaaatcattatttgcataagagcattgatagcaggctaattaaatttgggaacaatagctaataagctgactgaaaaaaacagaacctaaaaagaaatggtataatacagagcaaagaatatggccttaatgtcatggatctatcactactagctgtgtggctttgagtaaattgcttaaccacctgagccttttgttcctcatttgcatggagataatactacatattccatgtggttgtgagaacataaaagataatatatgtgtattatcacacctgtaatcccagcactttgggaggcccagggtgggcagatcacaaggtcaggagatcgaggccatcctgaccaatatggtgaaaccccatctctactaaaaatacaaaaattagctgggcatggtggtgcgggcctgtaatcccagctactcaggaggctgaggcaggagaatcacttgaaccagggagtcggaggttgcagtgagccgagatcgcaccactgcactccagcctggcaacatggcgagactcaaatatatatgtgtatgtcaaatgtatgtgtgtgtgtgtgtgtgtgaattagttatctatttctgtgttataaatctcccccaaaaaacctgggggcctaaaacaatacacatttattatttcacacaggttctaaaggctgggaatccaagagcagcttactggggtggttctggctcagagtctcttctaaggttgaaatcaagattttgattgggactgcagtcatctaaaggcttgaatggatctggagggcctgcttctaagctcagtcatgtgggaggcctcagatctttagcacatgatcctcgtgatatgaggaactggcttccccagagcaagtggtcttagaagaagagagcaagcaggaagccacagtgcctttatcacttggcctctgacatcacattctgtcgcttttgttttattttctccattagaagcgtgttgctaagtttagctcatattcaaggggaaaagaattaggatccacctcttgaagtgggggagtatcatagaattttgtgggcatatcttaaaactgcaacaatctaaaaagtactcagtacagtgcctagcacataagtgctccataaatggcagttgttattctactattaatagtctacacttaatatacatatacaattaatatacatggtccctactatgaaaccggtgtgggtaggacaagataaactcatgatttcttagattcctggaaaacacagaaaaagaagtaccacatatgactacattaattacatctgttttgtacaccaaaatgaatggattatttttgcactgcatgtaatgcactaagaacaggactagtaaaaataaattttagtaatatttatttatttatttattttgagacagcgtctctctcttgcccaggctggagtgcaatggcacgatctcagctcactgcaacctccacctcctgggttcaagcgattctcctgcctcagcctcccaagtagctgggactacacgcatgcaccacaacactggctaatttttgtatttttaatagagatggggtttcaccatattgtccaggctggtctcgaactcctgacctcaagtgatccacctgcctcggcctcccaaagtgctgagattacagatgtgagccactgtgcccggccaaattttagtaatatttaataggcatacataaaatgtatagtctgtaaatatgagtgatatgaaaaattcgaatgacaacctaaaagtgatattatatggttttgttaaagagttttatatgtacatttaaatataagtattgatcatctgagaactcatcaaagcttaactgaataatgtatcaacttgtctttctgagtgtccttttctcatttccatttaaaaatgtgccacagctaagactgacaggccccagtctgcagcaaagatggggaagacttggtagttcacacgcctcccctgagggcaaggagtaattctggggggatgtaaactaacaaacataaaagtattatatcggcaaaggggtcgattaagtaaaagagttgatgttgacagtaaaaatttagaagcaataattaatgtggctgaatcactagataatttcctctttatgtatacatttatatgtgtatatatatatttatatatgggtccataatgcccatcattagcctcaaagattgtctaatgttcattggaaacaaaaacataagaactctcccacccgggtggacagagtaatttactgagccactttggtaagataagaacattagattgaaggtaatgtcacaccttaaacttgttaatttattggtgttttgatttgcattaaacattagacagatcctcaggctagcggctgacatggtagaactctccttagtatctcaccaaaatagcagtcaaacttctaagatgttcaaaacatagttactaatttgaaagtaagtagaaatggttgctgaggagccaggatttacagaggttatatgcatcattgtaggtgaggcaggaagtctcctaagatttcacagggagcctcctgacttataaatgcataaatcacagtattgatcaggtcagcagtgacagataaaaagtagtgacgtgggttttaactgttgctagccttagccacacactgacagttgtgataaatggtaacagaaaagggagttattatagatccaaacagtgaagagaaaatatatatttaaaaaccaacattttaagtaagataggtagtaatttactgtgtagaggacaaataaatggctttatacgtctttttgttctttttttgtttgaacggagtttcgcttttgttgcctaagctggagtgcaatggtgggatctcagctcaccacaacctctgcctcccaggttcaagcgattctcctgcctcagcctccggagtagctgggattacaggcatgtgccaccatgcccagctaattttttgtgtgtttttagtagagacggggtttctccacgttgctcaggctggtctcgaactcccgacctcaggtgatccgcccgccttggcctcccaaagtgctaggattacaggcgtgagccactgcacctggcatgtctttttgttctttaagggtatctactatggtccaagaaaatgagcagtatgcacaatgttgaaacagagttgataaacaaaaggtgactgatgttcactatcatcttttttaggaagtcaagtaagtttgtgatatagtttacagatacttctatcaaatattaaaatgtcttaagatggaaaaaaaaacagttttgacactcaagtaggttttacatattaacatatatagaatgcacatagaagaaagggtcagagaggtccctggaaatgccgtgtactgattcagcatcatgggggctgcacagcctgcactgtgagtaataactataataatagctatcatttaatgagcatttaccatgtgccaggaattaggttaaatctttacatgaattatagtattgagcccttttatccatgccttgagtaggtattattatatctattttaaagataaggaaattgagggccgggcacggaggctcacgcctgtaatcccagcactttgggaggccgaggtgggcggagcacaaggtcaggagatcgagaccatcctggctaacacggtgaaaccccatctctactaaaaatacaaaaaattagccaggcgcggtggcgggcgcctgtggtcccagctactcgggaggctgaggcaggagaatggcatgaacctgggaggcagagtttgcagtgagccgagatcacacaactgcactccagcccgggcaacagagcgagacagcgagactccatctcaaaaaaaaaaaaaaaaaaagataaggaaattgagacatagtggttaaaaatttacctaacattggctgggggcggtggctcacacctgtaatcccagcactttgggaggccaaggcaggcggatcaggaggtcaggagatcgagaccatcctagctaacacggtgaaaccccatctctactaaaaatacaaaaaaattagctgggcacatccagctactcgggaggctgaggcaggagaatcacctgaacccaggaggcagaggttgcagtgagccgaggtcacaccactgcactccagcctgggtgacagagcgagactccatctcaaaaaaaaaaaaaattttacctaacattgttcatgtggttaagtggcagagcccagaatcaaagtgaagtctgagtacctccatccaggtttactatctcagtctacgtgttttatggaaatgaggcatgccctttctgagaaggaatgatgttattatacctccttatatattttcattaagaatgagtgaggatctcctcctttattatttattcatgtgaccctttcttttccctcaccctgtgggaggctgaataatggccctaaagatattcaggccctaatccaggattatccaggtgaaccctaaatgtaatcacaagtgtccttttaagagggagtcagatagagatttgatgacgggagaggaagaagacaatgtgacacaagaagtgggtgtgtttggagcagggaagtgacatgacatggggccacaagccaaggaatgaggataacctctagaaactggaaaaagataggaaactgattctcccctagaacctccaggaggaaccagcctgctgacaccttgattttagtcccataagactcattttggacttctggcatccagaactctaagagaataaatttctgttgttttaagctaccaaattgtagtaatattttatagcaaccataggaattgaatacatatcccatattactggcttcaggacttatttgcattatactttctccttgtatttttcctacattttgtaactgtttattacttccagaatgcaactgtagagtgtgtaaataacatattcgtaaaagcattgtttcagataaagtctaaaaaagaggtattttattttaaaataatatccaatcctatggctatcccatatcccagcctttccaatggctgtaaaagggaaaattatgggacgaatgttgtcaagtatataatgaaaggaaatcttttcaatatgaatgatcaataaacttgtagaaaaatgtccaccataacgagagtcacaccagttaatcataacccacatctctgactaggaatgcagtaggtttcccccattcccaccactctttatttggagatttgttgaaacctataagagaattatgagaatagtatgaaggcacttgtctgcccttcaccaaatgctaactaatatgtcaccatatttgtgaacaacagatagataacttgaaactaagttatgggaatcatgacatcttacccctcacatccctcatctcctaagagtaaggactttctcctcttctcctgcataactccaatgtcatttgagaaaataacactaattttataacatcacctaacatccagtccagtgcaaattacaatttccccaattgttcctaaacattattaatagctgtttgttttctgacccagcatccagtcagggtttacacattgcacttggtaatgtctctttagtttcttttaatctggaacagaccccttacaattttgttttcatgatactgacttctttgtgttttcctgaccctcccacactagaatgtacattttacaggggcagggattttcgtctctgttaattgccatgtccttagcattgagaatgctgcctagcactttgtaaatatttgtttaataactagatgaatgaataagtaatacaagtacaatgagtgtcatgaaaggtgatttagaggatgccaagggtcctgagaatctaatctgttgttgtttgtgtgtaactcttacctctgcattacacgtattgtgttacacatatacgtgtttcaggcttgagcaaagggctcattttacaaatcagtggggagatataagtgtaataaatataaataagaattgagttttaaaaaatacctaagttggtcaagattaaaaggcatgatagcaggcactttaacagcaaaactgcaagagacttaagctgagtttgggcaactgtgatgtgactggcaagatgctaaattagctttagacttaatacaataagaacagaggctataatgaagaaggtgattgtcttgctctatttattcattctttcattcaacaaatatttattgagtaccttgtgtgccaggcactgttttggtgctggatatttagaattgagcaccacaaagtcttcggccacatggagcttacattccatgatgaacaaacaatacttaagtaagttttttgagggtaggggctctgtgctttcacaagagaggcaacatagcgtaatggtcaagagcagtggtttttgagccaccagacataggtttgagtcccagtttgtatacttttttgctgcttggtcttgggtaagttccttaagctctcagagcctgagtttccccagtagtaaggtcatggcaaataacagtacagcctcataggttgggaagggacttaagcgagataatgcatgagaattgtctcacatggtgcctggcacttaatagcttcttgataaatgttagttgttgttttcatcattattaacattgactaactaaaacatgtcttactagaaaagggatttgaaaccaaatgatgaagaacagttgaaggaaccagggatgttaaactcatagaaaagtaaatggaatacatgcttactggtttcaaatacttgatgatgtagcatgtgacctgagcttacttattctgtgtggtcccagaaaacagaattaggtccagccggtggaagttaccaggaagacaattttcacaatgtaagaagaaatgttcttaacaattagaattatctataaatagaaagagctgcttgggaggaaatggattttctgtcattagagataataaagcaggtactagacatgtgctctccaatatgtagccactagcctcctatggctatttaaatttaaagtaattaaaattaaatacagttataaaggcagaggataggatggtggtttccagggattggggaagggagaaactgggtattgttgttcaattggtgtaaagttacagttatgcaagatgaatcaattctaaagacctgctctatagcataatgcttataactaacaaaattaggaacctaacaatttattaagagggtagatctcatgtcaatcattcttaccacacacagagagagagagagagagagagaaacttttgaggatgtggatatgcctgttatcttgatggtagcggtgatttcaccattttatgcatatatccaagctcatcaaattgtacatattaaatatgtatagttttttgtatgtcagttaaacctcaataaagctaatttttaagaaattaaatacaaatacaattcagttatttagtcacattagtcacgtttcaaagtgctcacaagccacatatggctagtggctgctgccatattagtgcagaataacaaacattgccatcatcacagaaagttctgttgtatagtgctgttctggacaatgaacaaagatgtttaagaagaaatggaggcacaagatgagaaagaagagctgaattaattaggtaacttgtaaagtccattctaagcctcagttttatagattatgaaaggtcatcttttaaccatttcattttggaataaaggaagagttattctcacagaaataaaactgttgtgttatttggagatatttttattttactgatttgacttaaaaattgcttcttttcagctcatcactctagttagagaaataaatttctgaggggaaatggcctagcaatggcatggcccaggagaagtacagtaatcattgcatctttttcctgaaagaactttccatgattttttagttcagcctgaagagccatttgtgacgcttaaaaatcaatgaaggggaaaaatgggactgagctgggccagttttcaaaggacatgaggggtgagtcttgtttcagttgctagtattagacaggatttcatttatgaactttgttctcttgtccaactccagttcctacaggtttcctttttcctttgctctccagtcaaaaggaaaaatactcacatgattattagaaatactggagcaataaattgtttgagggacttgaaacaccctttttttctttcccttcaaagccttaaatgatagttgcttcattgaagcttacagatcattaaaagcagtcctgccagggtgttgtaatatatgttttagcttccaattgaaggaaaatctctaccaaactaacctttgagtcatacagaattttttattttctatttttgatgtcttgggtgttccagcactttttcatcacctgccatatacaaaattcccatatcttatttgagccaaaaatgaagcctggtatcacctctaacaagtacaaattcctagcgcttttcaactatgttattatttgcctattttatttattgcagaacagttcccaaggagtaatgtcctggagaaacagaaataacactgtagaagagcagtagtgttatggacattgagagtaccattgcaaaacctgattttttttgcattttcatggcttcagtttcgagtaattgtagatggacagaggccaagctgttttcaatttgacccttggttaagctaaaaaactacataacaactaagggtaccctatctcctgttacagagatagatacataaaagggccagactaacaagaaaccaaatagccagtctggggtatggccagagaatctgtaactctaataagcacaccaagggattctggtgaacagactaatttggggaactgcttaggtccacattattttgtaaaggaatgattgaagaacctttttctgaatttttaaaaataagacaccaatttttttattgtagtaaaatatatgtaatatagaacttaccattttcaccatttttaaatatacaattcaatggtattaagtacaaccatcaccacgcatttccagaactttttcatcatcctaaactgaaaccgtacccattaaacaataactcctcattccctgctcctttccctcccaggccctggtaacctctataacactttctgtccctctgaatttgcctgttctaggtccctcatataagtgaagagataattgatttttaacaaaagcttaattgctttcttgcctggaggcatgggtcggagtgaaggggagcaaacattaattggtgtcttgacctgacaagtcaaggtcacattcggatttactggatttatctcaagcaatagaaaactgtgtttttaaactttggttccatggaatcatacagactccttttattctaattgtttttatcatgacctgtgtgttcacctatgaaattattcatttgaaattgttactgactagttggtgatattcaatctgattttctcatgaaaattaataagtatgtttctgaaaatctcctctcaattatgtcattctaaacaatttctgcaatgttaaggcccagcagaaaaaaaaaaaaaaaagttactatcaaaatgtttccaaagttcaaaagcagaagaattagcactttttagtttctttttataaaatgcatctacttcaagccatagcaaatttgaagtttcagatcctctgtccacaagattgagtacttaacgatagcccttttggctccttccagatctcctaataaagcagggagctcctctcagcccggccagccaccccgtccgggagggagatggggggtcagcccccccacccggccagccgccccgtccgggagggaggtaggggggtcagccccccgcctggccagccgccccgtccgggagggaggtgggggtgtcagccctccgcccggccagccgccccgtctgggaggtgaggggcgcctctgcccagccgcccctactgggaagtgaggagcccctctgcccggccagccgccccgtccgggagggaggtgggggggtcagccccccgcccagccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggggtcggcccccctgcccggccagccgccccgtccgggaggtgaggggcgcctctgcccggccgcccctactgggaagtgaggagcccctctgcccggccagccgccccgtccgggagggaggtgggggggtcagccctccgcccggccagccgccccgtccgggagggaggtgggggggtcggccccccgcccggccagccgccccgtccgggagggaggtgggggggggtcggcccccctgcctggccagccgccccgtccgggaggtgaggggcgcctctgcccggccgcccctactgggaagtgaggagcccctctgcccggccaccaccccgtctgggaggtgtacccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaataaataaataaaaaataaaaaaaaataaagcagggagctccttcagtgtccagcatactactctggggagaaggcctcttcatcttgtctagagcagggcttcagatatctgtgccagaggcttaggaaagacctaccacttggaatgtagaacaaaagaaatgattgttttcttttttctttttttttttttttggagatggagtttcgctctgttgcccagggtggagtgcagtggcgggatctcggcacactgcagcctctgcctcttgggttcaagtgattctcctgcctcagcctcctgcgtagctgggattacaggtgtctgctaccacagctaatttttgtatttttagtagagatgaggtttcaccatattggccaggctggtctctaactcctgacctcaggtgctctgcccgcctcagcttgttttgttcattttaaacaattttccataaatttataaagccattctccatgacatgcttaccactttcacggtctgtgtaaatctgatccatcagtaatatagtatggcagcacctaattatgtgttttgtgaaaagctatggaacaaaaagtaccacctgttacttaactccctaattgtaaaattgtgttttatttctgtgccctgaggttggaccacagtattgtgataaaccatgggactgacgggtcttgctacccattcctgttctccattaaaaaaaaaagtaatcagatttcttctaactctcaaacctctaaaagcgcttctgaaaacttagatctaactgtttaaagttgacccctggattctataaccctctctgtcacaaatctgctttgtaactttgagcgaattatttatcttaaacacttaactttccatacaactattcattgagcataaaacctaaataatgatactacctctggaaaaaaggattcatgactcagtgggtctgtttccctacttaaatctggaagggaaaatgccttcttactcttccttctgaattttcccatttagtccctggcacaaatgaagactcgctcttcttggcagcatccatggctgctaagagaaactttgccccactgcctttgatgtggtgaaacaaagcctttaccagagtggttggaggatctgtcaccctggagactcctagggacccccacccacaacctctttgggaagttcttttcctaaagttgtattcagatttataccaatatgcagaggagacgtctttcttataaaaagcttgcttttcctctcaaagctgtgaagaagctagtgaaggggaagttgaactgggtataatattgacaaatgttttgagcacttcagataaaaatgtttgataagtgcagtcctgtttgtattgccttattacactgctcattggagaaagtgttttctttggtcacctgccaatgaaaaagattagccttttcctgtatttaggattgtttctttgactagttatgttggtagaacaagatagacaaatgctgctgaaattagcaaatcagtattggaacacagtgatactcatttctcctcactgccctttccaattcattgacagttgccgcaagcagtatgaatgggttttttataggactctctttctctccttacctattccaatttgtattttcactttagttcccttgctctgatgttcaagactttaaaggatttgccactgcccaccacaccatgctttcctattttataggatccaataagaaacattttttcatttaaatgcctcttctataacatgagtcaccttttagatttctataccttgtatcttctagtttctattttagtacagaaaaattatagtttcatcttctttgaggcaagatatgaagatttttttttgccctccctcaaatttattccctgtttacagcaaaggaagccactggctgcttttctaacatttctctatcagaagctagttgagctaaatgtatatacttttatattccccttaatatgtttagattgatctggggtacatcttttggatctggacattatgaaacaaagttaagccctttaacccatcatcagcctacatctgtctcttcagacaaaaaggaaatgaacttccattgctgtaggaaaaatttatgtcacacataagggcaaatttgttagcaataatgttattcaagccaggtgtggtggcgcatgcctgtaatcctagcactttgggaggccgaggcagtggattgcttgagaccaggagttcaagaccagcctgaccaacgtggcaaaaccctatttctactaaaaatacaaaaattagcctggcatggtggcatatgcctgtagtcccagctccttgggaggctgaggcacaagaatcgcttaaacccagaggcagatgttgcagtgagccgacattgtgccactgtactccagcatgggcgacagagggagaccctgtctcaaaaaacaaacaaaagagatagtgttattcagtactgggttcctaagcagtattacagtataaccttctctgaaattctttgcttttgtttttaatagaatagattttcataaggaatggattaggtgcagaccttcttgacagcatgagataacaagttatttcttgaagtcactctttagaataaataagtcgtattttattctgagggaatttttttttttttttagacagagtcttgctctgtcacccaggtaggagtgcagtggtataatcttggctcgctgcaacttccaccttctgggttcaagcaattcttctacctcagccttctgaatagctgggattacaggtgcctgccaccacaccggctaatttttttttttttttttttttttttattttatttttagtagagatggggtttcaccatgttggtcaggctggtcttgaactcctgaactcaggtgatccgcccacctcagcctctattccaagggaattttaacattgatttaattgagagaatcaaaagagcctgagggtagtttacagagaagagcccttttaggtagtattttttatttgacttgccaacctctaattctcactgacttatggtgagtttcaagtatggatagttttaagatgtggttagttcccatgactacaaaataaaatatgaatttcccatgttacttgaagactgtttgtgggaggtcttcatttaggtctttgcatcttctcaggagcatatcataatttaatagcctgtcatcggaaccctgcaaagatagtgatattcatcttagaaaaaaaaaaaacttgcatacctcctatacagcattctttgctgccacctaaagccatttgctcatgaaacagtaacctttagaacaatagcccgagttctcttcctatcagtcaattcttagagactctattagcaccttcctttgcttttgtcctgtcagatggagagacggggttggcagaagcaaaacagcctttataaatttttcttagaggtccgtgatcctagattaaagtaggaatcagaagacatcaggtctagaaatcctcagagtgaccttttttgacagagaagatatttatatgaagaaacatcagtgccaatgacctaaatttagctatctaacctctcaatatgatcatttctctgcttgtaaaaggggaatagtgacaccaatcactaccgtcctctggagtttgagagatacttaatgaaataatgaacgtaattctcctcttgcaagggaatatattgttgacttttaggagaatgatttgggggtccctaaggggcttaacaatctattacctctctggcactcaaataggattattgtaaaaagctaatctactgccaaaaagtaagccatttattctgtggatagatcaggtccagtgtgaaaaaaaggattttgatctcttttttggaataactattactaactagataggcacaaagatgtcttttttttctttctttctttaaaaaaaaaattagaacagaagtgtaattgtgtttgatggttcactttgggagaatgttaggttcaatcctgaacacagtaaatcagatgatatacttcttttaaaaagcctctagaatatgccttctcaattgaggcaatattgcctccaagggggcaaaaattggttctttgggaggcaaaaaaaaaaattagatattataatggtttgtgacccttaaaaaatatatagatagataatatgttcatgatatcaaaatttcatggggagtggacaaatagaaaaaaggtctaaaaagctagggggtgataatgaaaaaaagactgagaaacttttctcaagtctagaatgtgcatataactgtcaattactctttcagctgtgtttgtccctaagcatgggcaagctgcacattgtcaggtcgaaacagcttgctattgattattccttcagtctgagaggaactgagttcatagaaaacttgaacgaaatgaaatgtataccctaaggggtaatgatttcagacaaacaaacgtaacaaacatctacttgttagaaccaatactttgcactttaaaatgtggttaagcctttaaggtaagaggtttcttttttctcttgcctctttagccttacagaaaggcacatcaagggtaggaatgatcttcaaagtgcctcacagaaaaaaaaaaaaaaaaaagccagattgggagaaagtgtggccccaaaggcatactttggagagagtgtggccccaaaggcaggaagggaataattgactaaatagtaatgtaaagtgtacagcatcggcagggtgtggtggcttatgcctataatcccagcactttgggaggccaaggtgggaggatcgcttgagccctggagttcaagaccagcctgggcaacatagtgagacctcatctctacaaaaaatacaaaaaaattatcctggtgtggtggcacatacctgtagttccagctactctggaggctgaggtgggaggattgcttgagcctgggaggtgggggttgcagtgagctgagatcatgccactgcactctggcctgggcaacaaagcaagaccctgtctcaaaaaaaaaaaaaaatgtacagaatcaaagtcaagaaaattgatgggaattgacactgaagtacttaagaaattttaagtttgctcttgctgctggtattaataaactttcatatatccaacatattcttccttccacctttctcatatgtcttattagttctttcaaacactcagaatggatggaatgatccaaaattgacttgctacatactggggaatttggaagggacctgtgttttgcttagcagccctgaaacaatagaatggccttttttttttttttttttttttttgagacagggtctcactcttgcctaggctggagtaaagtggtgctatctcagctcactgtaacctctgcctcctgagttcatgcgattcttgtgcttcagcctcctgagtagctgggaccacaggtatgtgttaccacgccctgctaattttttttttaattaatggggtctcactatgttgcccaggatctcaaactgctgagctcaagtgatcctccctccttggcctcccaaagtgctgggattacaggcatgagcgactgtgcctgataatggccatatttaaagatatattttttcctcagtctctgactcttccttgcttaatcatcctattctttaatatacaaacctataactttgaggaaagagaatcagagattatttctccctacttacccatttcatggtgcgacaatgagcactcttctccaagccaagcatttgataagcattcattgctatgggtattttactgccttaaagaaatccaccccaattccctgccgattgatttcttaagatcacagaagaaagtggaatgaatcctagagaggccttcaagctccctgacacccatggggcccactcatctccacccccaatactccaatttcaaaatctaacacattgtccttttcttagttcctcagttccccgcccttcagcttctctttgttagccactgggtgggtgtaaccaaacctcagtcacactgtggccccagcagctgggcttctctctcccccattacattgcagacattcttttcacatcattttgtcctctctgctgcattccctacatttggcttcattccctctgtgcaaacttctgtttcaagggacagcagtttgccaaggagatgctggcagagagggtccagttctttcctttctatctgaagagcccagtgtcattcattagcatatgagaagaatggttgtaaataaacatcaaatgaggttaacgagctgcagctcatcaatattaatgaagtccacctcacagccttggtatgaggtaccaatggctctaatcacaagaagcagtttcataaggccccagttacagggcaggaagggttagatccagcgtgttgaaatgtttgtcattttatgaccccaggaatgctgcagggtaaggcagtctgataccagatctgtgcttgcaaacccctcttgtgttcagtttacatctgtttgtctcaacaggtggaagcctaggaaaaggctatatctgctaagccagaatctggggtgggaattctccaggtcaacctgcagttcccaaatcaaaatgaagttccagagtaccagggtttgatctctcattgcccttccatcagttaccccagataacccaaacacttgtttccagtgtagtgaaggatggtttgaggatctaagcccagcttggtaaggaatgaagaaactcccatttcatgtagctcatgtgcctgccagccaccagttaagtccctgtgcctattatttagaggattcaaagagtaacaagggccaggcatggtggctcatgcctgtaatccctacactttgggaagcagatgtgaggggatcacttaaagtgaggggttccagactagcctgggcaatatagggagacctctctcaaaaacaataaataaataaaaattttaaaagtagttgggcgtggtagcctgtattcccagctactcaggaggctgaggtgggaggatcacgtgagcctaggagtttgaggccacggtgagccatgatcatacaactgtactccagcatgggcaacagacagagactctgtctctgaaaaaaaaatttttttttaattaaaagaaacagtaagtacagctatcatttattgaacacttactgtgtcctaggcatggtactaaacatttttgttatataatcctcacaataatcccatgaaggtattcccattttacagatgaggaagttgaaactcactgatttgatgtcatgggtctaagatcacacatcagcaagtggcagaagaggagctcagatttcgatctgtctaactgcagagcccatgctcttacttcctaccctctgtggtatcatctcagagccaagcacataaaatgcaagcttttgtgctgctccttttcgtcaaagatgtgtgtcctccagtttcaagggactaaacacaaagtagttccctggaagtagaatcagaaggctttagaattaatttttttaagtcaaagtgcctctttgaaattatttttagaaaggaaactttcattaaatatgttttccttgatatataaatttggggtcagagggattaggctttgagaatatgtgtgtgtatgcatgacccagtctgtgttgatagccatgatactgatttatccaccttgtcacactagttccttttatgattaagcacacaccttgcatgaggtcagtgaccatggaacacagggaaaccgctcccatggctgatttgagcctatgatcttagcctcaattacattgtttcaacaactgaacgcctggtttattacttaaagtactatcattgtactttgtcttaggggtgggaaggagaaccgatcaaattgttgttatcacaaaagctacacctgattgtttgtaaagaaggacttctagtgaaaggatgaaagtgaaacagctatttctctttcttctatttttctccttgaaaattcagggacctaggccaagacaggcggatcacttgaggccaggagttcaagacctgcctggctaacatggcaaaaccccgtctctactaaaaatacaaaaattagccaggcgtggtgacacgcacctgtagtcccaggtacacgggaagctgagacacaaaaattgcttgaacccaggagggagaggttgcagtgagccaagatcacaccactgcactccagcctgggtgatagagcaagaccctatctcaaaaaaaaaaaagaaaagaaaagaacatgaaagaaagaaagaaaactcagggaccttacttggtaatttttacctaggcaaaatgcccaggaatgtttccacagaatggtacccaaagcccacccatgcaggagcccttcctgccaccaaggtaaccaagactaggaagcaattgaaactgggccttcctttcccaggcctgtggctgtcaacttggctcagaaagaggcagactgatgactttgtctccttacccactcacactaccacacagttctcatttgagcctggtcacatggctgtgccttcttatggccaaacaaggatacgctgtttcccgttctttgcaccctgggtttggcctgagcatccttagatgaaaccatcaggacccccaaaccttgaagcttttccaggggcaaattgcatgcaggggaaggaggggctgagctgtgtagtggagcagcggatggtgtgcagtcgggatgtttgcaagagccaaggggttagttcattgctgctttgtatactcaggcacaccagaaaactcagattaataggctgtttattcttcagcatgttccttgaatcaaaggctctggatggtattattaaagagtgtttgtgagagcgccctggaacactcctcctgggctccgctcactgaagaggaacgattgagtcctttcatttcctgggcagcatccctctcactcattgctcactgtagtataaaggtctgtagaacctttgttagaaacaggatcttttgttctgtccttatgaggtcccattacctacagcaccttgatctgttggagtctaattatttaatgttcttgtcttttgagctacctgaacctaatgaatgcagtccactctatctcagggagttgttttgctttggttttttgcctctatttggcaccagtttcctgtttggacagtattgccttttattttcatggttttttttcaaggagtttgtccaggagagaaggagacatccacctgaaacctactctgtgaagcaaatgaatatgttttttctattagaagattctcctaaaatgttctgaagtttgttcatatctgggaattgaagcacattgaattaagaaagaattacttcctccacctccacccctgcaatagagatttatactggacaaggtggcaaaaaaaaattagggggaaactgctcggtacaattcccccccagttcccttggggcagcagcgtgctgcacatgaggaatcactgtaccttgttcccctggcagtgatacttctctgtggccaggcaaatacagtagtccaggccttccacaacttctgcatgtgcgcatgtgcgcacacacacacagacgctcaaaaccatacccctcctgggcatccccttaatagaggcatccagtatattgcaaaggtactcatcactatacacagtgcaaatactcagcactcgtttatagcaaacccagtatgaataattagcaatagtttgggatctggcacaacccttaattaccacaactagaggccagaaaatgaaatcagggtcatatatctgaggttagaactctagaatctgtctggcatcctatagcccaaagcaccacagggaggtacaccttggagcaatgggagcactgtcatccaggagacactgtcccctcactttcctccaaaaccagcacagctgtttgcacgagggctatctgccgtatatacagtgagactaagatatatatacacaccctggcgcttcgcctgatttcttctgtgaagtccatctgtttatccagttccagatcccaaaaggcagtcaccaaaaactaaatagtgagaagggacaggcttttttttttcttttttgataaacatgttacagtgaacaaaacagattttgcaaacacattccatctagtaaatcttacctcacagctgtgtgagaagagcttggaggagagaaggatggggagcaggagggtctcaggacttgattggagaattagaaagttcagaaacccacaagggtgggacagttcagtactatctacttttttttttttttttttttgagatggagtctcactgcgtcgcccaggctggagtacagtggcacaatctcagctcactgcaacctcggcctcttgggttcaagcgattctcttacctcagcctcctgagtaactgggattacaggcgccggccaccatgcctgactaatttttgtatttttagtagagacagggtttcaccatgttggtcaggcttgtcttgaactcctgacctcaagtgattcgcccacctcaccctcccaaagtgctgggattacaggcgtgagccaccgcccctagcctatctacttcttatagggtgataattggccttttcccttcattctagcccctcatcctaaacctggaatctgtgatgggctcaccaaaaatgaagatctggctgcagactttggcttctttcactgaaaagctgatctagccagactttatcttcaaaagacaggccctgcacttctgatgttccctgagcctctcccactgagcctactctcgtccactgtagccatgatgctctctggattcagacaatggtgtgttgtcccagaacactgtatctggcctgtctgtgcttcacatctacccctttggctaggaaaatgagggacagagctcacatcagtaacttggattctgaggaccgaggacaagcagaagaaattgaccttttgcctcagaggtggctggatgtttgtgtgtctctcttcgatgtcaaattggctcactgaaccactcaagagttgttttttaaaaatgttctgctcactcctcatttgcgggtcagatgctttggataatccagtggaattctctctgcttcactgctggttgctgccagacacagagtgctaaatcctgtcagtcggtgacttgaaatgatgatgtgtgaaacagtgctgcgatttggacatcctgcactcatttgcatggactcctttgccagttaaccacagtagtgaaatggggcagcctggggcagcttccacagcccttgccttatctttcctcagtgtccccaccctcccccatggcagtatgtagctccagtaattggtaaggcttggaattctgtttcatttaatattattcccttcctaggcatcatagagcaatttctttaacatgctagattgcaacatgccagagacagagaaatagcatttgtgtgcagaatggagaggcgggaagcaaaacactcttgttgctgattcccatctcccggtctttgcccttccttctttccctagattgcatggctggctgattctcatctggtgagttctcagctcaaatggtacgttctcaaagatgagcctggcacagccatctcatgtggtcccaccctcagtcactgtgtatcacaccaccctgcctgatttatgtcattgctctcctcacttcctaaaagtatttctttctttgttactttttattctctgtctccccaaccactgcctccacacatacacactagaatgtaagtaccatgaaaatagggatttttatctgtcttatcccttgctgtttccccagaatctagcacagtccctggcatacctttgacacttagtatattgactaaataagtagctaagaatgtagcaattaagaacttctaaagcaaatatccatggttactatcaggaaatagtaaaggcagacagacagagagtttgaggaatggaatgagaagacatgatttcttatactgattttaataatggtcttaattacaaattgaatacgttaagtcaaagatcacaatatcgagtcgctcttcatttcttctgactcagactaaactgccccttattgagtaggttaggtcagggtcatagagaccaagtactacaaacttcctggccaaactggcataattgatgccacaaagtatgcccacttccagatttccactgggtggtgcctggctttgctttccttagggcagttgccagaagaaactggcacaatttaaagcagtttaaagcccagcctgggtatcttcatctagcctttattatattcttgcctgcctccagttcccaaaaagactgcattcctgtctgcaactccagggccctgaagccccttcagtcatgaaagccatggaggtgggttagccctgatccacccagcgtgagacagtatgaccaagagaacacatctttttttttttttttttgagacagagtctagctctgccgcccaggctggagtgcagtggcgcaatcacggctcactgcaagctccgcctcccgggttcacgccattctcctgcctcagcctcccgagtagctgggactacaggcgcccgtcaccactcctggctaatttttttgtatttttttagtagagacggggttttactgtgttagccaggatggtctcgatctcctgacctcgtgatctgtccgcctcggcctgagaacacatctttagtccagcagatacatggcactcatctcctcaagagtccttcacccaaacgagaattattagcttctcagaagttatcctttgtcttgttggggcaagatctgtgcctagtgtcaagagagagatgttaaagattaaagagcctccaccaggaaagggaatggttttgcctgaatctcttaatttgtttttccccgctacgagtgcattcatgttgctgggctccctggcttactccccggtggtttgtagtcattttcatcatgactttgcggttgcattgatatcagaatgagtttcgactgctgtacgtgatgcttccatgctccattgctttctctcttatgttgctaacgactctcctgttggcttcagcccttagccaagcccaccccactccacaccccactccttccctgtcttttattgatgctatgttgactttgcatgcctcagttagttcagttttctgagcacctgcagagaattaaccatctctgcttgctgctgcggatcacctaggcctttgatctgtttgatttctgtacttctaaaaatgttgaaggactctctaaccccaccaaagtacataaatggtgctacagttcctgtagcctgacctcctccagactagctctgcttagggaacagaagatcttcatgtaaatacagatgtagataccatttattaaatgttttctatgtacgattttactgttctaagcacttaatgtgaatatttcatttaatctttgcttatagagctaaaaggccatatacatgaactggcccattatttctctaacctcatctcttcttcctttccctcttattcttttggctcctgccatgttggtttccatgctgttcctcttacccaataggcacactccctccttaagactgtaatggctattccctctgcctggaatgctcttccctcagatgtctgtatcagttactccttaaccccttcaaatcttcacttgagtgttaccttctccattaaacctacctagaccactctagagagaattgaaccaccagtaccacctcatattccctatctctgacttgctgtattctctttttttccattatatttatcactgaatctcttaatttgcctcagttaactttctatatagcttatttgtttgtttgtttgtttgttttttgagactgagtcttgatctgtcacccaggctggagtccagtggcacaatctcagctcactgcagcctctgcctcctgggttcaagcgattctcctgcctcagcctcctgagtagctgggattacaggcatgcaccaccatgcccggctaatttttgtattttttgtagagacgggttttcaccatgttggccaggctggtctcaaattcttgacctcaagtgatccgcctgccttggcctcccaaactgtcaggactacaggcgtgagctgctgcgcccagcctatttgtttattttctttatcattcattatctgtcttccccactgcaagataagctccatgaaggcaaagagcttgtctatttcttctctaatgtatcctaagcacctaaaaagtaacatgtgacacataatagatgctacataatatctattaagtcagtgaactttgtcccctaaaaacccatgctgtaggttcttctgttatccccattttgtttatttatttatttttattatattttaagttctagggtacatgtgcacaatctgcaggtttggtacataggtgtacatgtgccatgttggtttgctgcacccgtcaactcatcatttacattaggcaaatctcctaatactatctctccccactcccccaaccccacgacaggacccggtgtgtgatgttccccgccctgtgtccaagtgatctcattgttcaattcccacctatgagtgagaacatgtggtgtttggttttctgtccttgtgacagttttctgagaatgatggtttctagcttcatctatgtccctgcaaaggacatgaactcatccttttttatggctgcatagtattccatggtgtatatgtgccacattttcttaatccagtctatcattgttggacatttgggttggttccaagtctttgctattgtgaatagtgccacaataaacatacgtatgcatgtgtctttatagcagcatgatttataatcctttgagtatatacctagtaatgggatggctgggatggctgggtcaaatggtatttctagttctagatccctgaggaatcaccacactgacttccacaatggttgaattagtttacagtcccaccaacagtgtaaaagtgttcctattcctccacctcctctccagcatctattgtttcctgactttttaatgactgtcattctaactggcgtgagatggtatttcattatggttttgatttgcatttctctgatgaccagtgatgatgagcattttttcacatgtctgttggctgcatagatgtcttcttttgagaagtgtctgttcatatcctttgcccactttttgatggggttgttttttttcttgtaaatttgtttgagttctttgtagattctggatattagccctttgtcagatgggtagattgcaaaaattttctcccattctttaggttgcctgttcactctgatggtagtttcttttgccatgcatcagctctttagtttaattcgatcccatttgtctattttggcttttgttgccattgcttttggtgttttagtcatgaagtccttgcccatgcctatgtcctgaatagtattgcctaggttttcttctaaggtttttatggttttaggtcgaacatttaagtctttaatccatcttgaattaatttttgtataagatgtaaggaagggatccaatttcagctttctacatatggctagccagttttcccagcaccatttattaaatagggaatcctttccccatttcttgattttgtcaggtttgtcaaagatcagatggttgtagatgtgtggcattatttctgaggcctctgttctgttccattggtcaatatatctgttttggtaccagtaccaggctgttttggttattgtagccttgtagtatagtttgaagtcaggtagcatgaagcctccagctttgtcctttttgcttaggattgttttggcaatgcgggctcttttttggttccatatgaactttaaagtaattttttctaattctgtgaagaaagtcattggtagcttgatggggatggcagtgaatctacaaattactttgggcagtatcaccattttctatccatgagcatggaatattcttccatttgtttgtgtcctcttttatttcgttgagcagtggtttgtagttctccttgaagaggtccttcacatcccttgtaagttggattcctaggtattttattctctttgtagcaattgtgaatgggagttcactcatgatttggctctctgtttgtctgttattggtgtataagaatgcttgtgatttttgcacattgattttgtatcctgagactttgctgcagttgctgatcagcttaaagagattttgggctgcgacaatgggttttctaaatatacaatcatgtcatctgcaaacagggacaatttgacttccttatatcctaattgaataccctttatttctttctcttgcctgattgccctggccagaacttccaacagtatgttgaataggagtggtgagagagggcatccttgtcttgtgccggttttcaaagggaatgcttccagcttttgcccattcagtgtgatattggctgtgggtttgtcataagtagctcttattattttgagatacgttccatcaatacctagtttattgagagtttttagcatgaagggctgttgaattttgtcaaggccttttctgcatctattgagataatcaagtggtttttgtctttggttctgtttatatgatggattacatttattgatttgcgtatgttgagccagccttgcatcccagggatgaaactaacttgatcgtggtggataaggtttttgatgtgctgctggatttggtttgccagtattttattgaggatttttgcattgaagttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaatccatctggtcctggacttcttttggttggtaggctattaattatttccttaatttcagagcctgtctattcagacattcaacttcttcctggtttagtcttgggagagtgtatatgtccaggaatttatccatttcttctagattttctagtttatttgcgtaaatgtgtttatagtattctctgatggtagtttgtatttctgtgggatcggtgatgatatcccctttaacattttttattgcatctatttgattcttctctcttttcttctttattcatcttgctagcggtctatcaattttgttgatctttaaaaaaaaaaaaaccagctcctggattcattgatttttttgtagggttttttgtgtctctatctctttcagttctgctctgatcttagttatttcttgccttctgctagcttttgaatttgtttgctcttgcttctctagttcttttaattgtgatgttagggtgtcgattttagatctttcctgctttctcttgtgggcatttaatgctataaatttccctctacacactgctttaaatgtgtcagagattctggtacgttgtgtctttgttctcactggtttcaaagaacatctttatttctgccttcatttagttattaacccagtagtcattcaggagcaagttgttcagtttccatgtagttgtgcagttttgcgtgaatttcttaatcctgagttctaatttgatggcattgtggtctgagagacagtttgttgtgatttctgttcttttacatttgctgaggagtgctttacttccaattatgtggtcaattttagaataagcgtgatgtgatgctgagaagaatgtatattctgttgatttggggtggaaagttctgtagatgtctattaggtctgcttgttgcagagctgagttcaggtcctggatatccttgttaaccttatgtcttgttgaactgtctaatattgacagtggggtgttaaagtctcccattattattgtgtgggagtctaagtctctttgtaggtctctaaggacttgctatatgaatctgggtggtcatgtattgggggtgcatatatatttaggatagttagctcttcttgttgaattgatccctttaccattatgtaatggccttctttgtctcttttgatctttgttggtttaaagcctgttttatcagagactaggattgcaatccctgcttttttttgctttccatttgcttggtaggttttttttttttttttttttttgagacggagtcttgctctgtcacgcaggctggagtgcactggtgccatctcagctcactgcaagctccgcctcccgggttcacgccattctcctgcctcagcctcccgagtagctgggactacaggcgcctgccaccacgcctggctaattttctttgtatttttagtagagacggggtttcaccatgttagctaggatggcctcgatctcctgacctcgtgatctgcccacctcagcctcccaaagtgctgggattataggcgtgagccaccgcacctggcctgtttggtagatctttctccatccctttattttcagcctatgtgtgtctttgcacgtgagatgggtctcctgaatacagtacactgataggtcttgcctctttttccaatttgccagtctgtgtcttttaattggggcatttagcccatttacatttaaggttaatatttttgtgtgtgaatttgatcctgtcattaagatgttcgctggttattttgcctgttaattgatgcagtttcttcaaagcatcgatggtctttacaatttggcatgtttttgcagtggctggtaccagttgtttctttccatgtttagtgcttccttcaggaactcttgtaaggcaggcctggtggtgacaaaatctctcagcatttgcttgtctgtaaaggattttatttctccttcatttatgaagtttagtttggctggatatgaaattctgggttgaaaattctttaagaatgttgaatattggcccccactctcttctggcttgtagggtttctgccgagagatccactgttagtctgatgggcttccctttgtgggtaactcaacctttctctctggcttcccttaacactttttccttcatttcaaccttggggaatctgataattatgtgtcttggggttgctcttctcaaagagtatctttgtggtggtgtctgtatttcctgaatttgaatgttggcctgccttgctaggttggggaagttctcctggataacatcctgcagagtgttttccaactttgttctattctccccatcactttcaggtccaccaatcaaacatagatttggtcttttcacatagtcccatatttcttggaggcttagttcatttctttttagtcttttttctctaaccttgtcttctcgctgtatttcttttcttttttttttttttttttttttgagacagtctcactgtgtcgcccaggctagagtgcaatggcacgatcttggctcactgcaacctccgcctcccaggttcaagcaattctcctgcctcagcctcttgagtagctgggattacaggtgcctgccaccacgcccagctaatttttgtatttttagtagagacggggtttcaccatgttggtcaagctggtctcaaacccccgacctcgtgatccacctgcctcggcctcccaaagtgctgggattacaggtgtgagccaccgcgcctggcctcttgctgtatttcattaatttgatcttcaatcactgacaccctttcttccacttgatcgaatcagctattgaagcttgtgcatgcgtcacgaagttcttgtgccatggttttcagctccatcaggtcatttaaggtcttctctacactgtttattctagttagccatttgactaatcttttttcaaggtttttagcttccttgcgatgggttcgaaaattcttctttagctcggagaagtttgttattaccaaccttctgacgcctacttctgtcaactcttcaaagtcattctctgtccagctttgctctgttgctggtgaggagctgcgatcctttggaggagaagaggtgctctgatttttagaattttcagcttttctgctctggtttctccccatctttgtggttttatctacctttggtctttgatgttcatgacctacagatggggttttggtgtagatgaccttttggttgatgttgatgctattcctttctgtttgttagttttccttctaacagtcaggtccctcagctgcaggtctgttggagtttgctggagttccactacagaccctgtttgcctgggtatcaccagcggaggctgcagaacagcaaatattgctgcctgatccttcctctggaagcttcgtcccagagggcagccacctatatatgaggtgtctgtcggcccctactgggaggtgtctcccaattaggcttcatgggagtcagggatccacttgaggaggcagtctgtcctttctcagagctcaaacgctgtgctgggagaaccactgctctcctcagagctgtcagacagggacgtttaagtctgcagaagttgtctgctgccttttgttcagctatgccctgcccacagaggtggagttagaggcagtaggccttgtagagctgcggtgggctccgcccagtttgagcttcccagccgctctgtttacctactcaagcctcaccaaaggcagatgcccctcccccagccaggctgccgcctcgcagatcaatctcagactgctgcgctagcagtgagcaaggttctgtgggcgtgggacctgccaagcttggcacaggagagaatcaccttgtctgccagttgctaagaccttgggaaaagcacagtatttgggcggagagtgtcccgtttttccaggtagtctgtcacggctccccttggctaggaaagggaactccccgaccccttgtgcttcctgggtgaggcgacgccccaccctgcttcagctcgccctccatgggctgcacccactgtccaatgagtcccagtgagatgaaccaggtacctcagttggaaatgcagaaatcacccatcttcggcataggtcatgctgggagctacagaacggagctgttcctattcagccatcttggaacactgcccacttcttttttttttttttttttttttttttgagatggagtttcactcttgttgcccaggctggagtgcaatggtgcgagctcggctcaccacaacctccacctcccgggttcaagcaattctcctgcctcagcctcccgagtagctgggattacaggcatgcaccaccacgcccagctaattttgtatttttagtagagacagggtttctccacgttggtcaggctggtctcgaactcctgacctcagatgatctgcccaccttggcttcccaaagtgctgggattacaggcgtgagccaccatgcccggccttatccccatcttaatgatgatggaattgaagctcaaaaaatttaagtaactaacttgccccagatcatttgtctagtaaccagtggagctgagctatgaacccagaacccaggattgactaactccaaaaaatgtgctttcaaccatgaggacaatcctaagagtcacctgagctatttaattaaatgtggattctcactctcttgaccccagggattctgattttgcttctgtgggtttagggtacaggtgattcatgatcatatgttgagatgcattgagatatactacattgcttttagggtttcacatctgtatagggaggcatagggataaaattcattgaacgtttttttaactgtgtactgtgtgccagtccccttgatatgtataagcaagtgagatggagtccctaccctcaagacttggtctaatgggaccttggaaccctgccttgactctgtcagactacctcacttgagcaagccacttactctttaagccttagtttctctatctgtaaaatggagatagtcaattacttacttcagagcaaaaggcctgatctatgatcctgtgattcccaaggctcttttaagttgtgaagtcacagggtggactaacttccaatgctgagaacaatgatggggtggtgatgggtcagatagacaaataaatcaataattcaaccaccaataaatagtggaatatgtaaaagcatgcgctttggaatctggcagatccatgattcaaagctcgaatgtgcttgcctcttgctagttacgtaactgggcaaattacttcactgccctgtgtctgcaagtaaaatgaggacagtacttaccctataggactgctgcgagacattcaatgagagtaatgatgcacagcactcagtacagcagcttaaaaacaggtaacaccatgaagcactacagaagcagtgatcaataaatggtttagagacagtaaacatccaaagacgcagaagagttttacagttttacagcctactattttatagtttaaatttggttacattttttgttgtttttaatataacttacatggaaatctttttaaaatgtatatgatacgtatacagtggccttccctgccatcttatgtaatttaactcctctaggcatctaagcatcatctttgtcatcataaattattttactctgctggaaaagatcattgccttcaggacccactgaaatgtaccctaaatgtatccagattatatttaaaatatatttttctgcctctctgttaggtcatgtagttaatgcctaattatagttctttttcctctccttgtttaccctgtctaatctgtattgggcttagaaactagtggccaagcttgttaaaactgcgagtataatcagagtatgtcttggaaccctgtaagttagccacacgagcttttgtatgtggacttcatgaaatcttcttgcctacttggagacttattgacatttagatatttggcattgcctattagttaagttttaaattgactagatattactgtgtaaggtacagatacctgaaaaaaaattccattattctcagctttggaagttgatccaatctatgacttcacaacttaaaagagccttgggaatcatgggctcataggtctggccttttactctcaagtaaatagcaattgattattatctcttttttacagacaaagaaattgatccctaagtgtaagtagcttgttcaagtgaggtagtctggcaaagtcaaggcagagtttcaagtctcccaagcctgcccttccgctctgccacactgttcccaggaggaaacaatcatcttaggctgtagaaaggaaggaaaactatcaataaatatggttaaagattagaaaaatggcccagcacgatggctaatgcctataatcccaacactttgggaggattgcatgagcccaggagtttgaaaccagcctgggcaacatagtaaacacagtgacatccctacaaaaaaaaaattgctgagcatagtgatatgtgcttgtactctcagctactctggagactgaagcagaaggatcacttcagcccaggaattcgagggtgcaataagctatgatcacaccactgtactctagcctgacaacagagcaagaccctgtctcaaaaaaaaaaaaaaaaaaaaaaatatatatatatatatatatatatatattagaaaaatgagatctatggaggatattgtaactattcagttctatgcccttattttgatagatgtttttcctgtcactcctgccctcatttgaaggggtttataaccttagtatgccatcagtgagcctgaacatctctataagggaggaccaaggggcattataataagatccaaaaacatagaattataaaagatgatgatcttttcatcatggatgaaacaaggtgtagggaaggaactaaatggcattcaggtgacttagagggggaagaaagagccactgagaacgagggacatggaaacaggtttctgaaggaagatacatacttgaccatctctgtggatggtttcctgcctgccggcctgccatccttccttccacagctttgttaagatacaatttatataccataaatcaaaatggctttttaaaaaataaatcttcttaaataattcttttttattttttattttttttgaggcagagtcttgctctgtcacccaggctggagtgcagtggcatgatctcagctcactgcaacctccgcctcccaggttcaagcagttctgcctcagcctccctaatagctgggattacaggtgtgcaccactgtgcctggctaatttttgtatttttagtagaaacgtggtttgccatgtcggccaggctggtctcgaactcctgacctcaagtgatccaccggcctcggcctcccaaagtgctgggattacaggcatgagccactgcagccaaccaaaaaataaatcttattcttctgattgcaagaaagcacatatcatccacggtccccaaacactgagttaactactatttttaactctgttgatgtatcccattcttttccctatgcaaatttttattcttttttttgttgttattttaaagcaaacatggaaccatactctatatgacaatttttattttgctctttcctcttaatatcatgaggtcatgtactttgttttcatcttaaactcatttcatcagatgaattaaatctttattgtaaaagcttccaaagagaaattcctcatctggggttgaaaattcagatgccaacactggccaggcaggtcatataagaagcatacgtgttattcggtggtaaactggcaacagcatcctcttccccagctccagctgattgtggtcatgcaggaatgctggcccatcattaccaggtcttctgatttttttctaaaaaagagagctatctgaaatctagattgtgttgtgggaaatatcttaatgttttgcctcaaaatttaaaaagtacacttcaagccaaacaaaacctggctgccagctatattctctgtcccagacagtgagtgctaagagtttcacaagcattatctcatgtattcttcacagcagtcttgctcctctaatggttatttattaggaaccaacaatgaataaaaaatcaaaatccttgctctcttggagcttctgttggggagacagttactgctctggagaaaaaataaagcaggaaaacaagatgggggtagagggagagttcacagcattcccactctgctagcaagttatgtgctagatggtcagattatgactgggcaccgtggctcacgcccgtaatcccaacactttgagaggccgaggtgggtggatcacctgaggtcaggaattcaagaccagcctggccaatgtggtgaaatcccacctctactaaaaatacaaaaattagccagtgtggtggcttgaacccgggaggcggacgttgcagtgagccgagatcatgccattgcacttcagcctgggtgacaagagtgactctgtctcaaaaaacaaacaaacaaattatgcgctacccagtctttgtgctacttcctcaaccacagagaatgacaatgaaagaatcctagaatgttaaacccaaaagcaaccgtcacaattattgagattaaaaggtttgtacattttcaaatagttcttaatggtcttactttttttttttttttttttttttttttgagacagaggctcgttccgtcacccaggctggagtgcagtggtgcgatctcggctcactgcaacctccacctcccaggttcaagcaattcttctgcctcagcctcctgagtagctgggattacaggcacgtgccaccacgcctggctagtttttgtatatttagtagagacggggtttcaccatgttggtcaggctggtctcgaactcctgacctcgtgatctgcccacctcagactcccaaagtgctggggcataagccaccgcacccggccttaatggtcttacttttaaaaaatcctttgatgtcttctcattgctcatacttttgtttactttcttaattttaaaaataggttatacatgaaaatgacaaaattcaaaagggtatacaatcttatatactttaaaatatactttacttagtctatcctatatactttaaaatgtattttacttagtctaatcagccgtgatcatttatttatacgtgaggcatgacaggaagaaattgaggcacagagttggtatccaatggaaggccacccattgatggagaaaccaaaccccagtgagtaaaaccagactttgtctttcagaattcttgtgcataaatgaagttgggtagattcatcctgatgccactggatatttttcattttttttctttactttttgtatgcctgccagtctcagtgaaagataaggatcagggttcagaaagcctaactattgtgtcgtttcccaggatggagagcactatcatttggttcacatttttattaaaataagatgagtgattcactcacattacaggcaaaggatcctttaccaggaaaccatactttgaaaaacaaagctgatggctttaaggaacagtaactactaacatcaatttcctttcccatcaagtcccaaaagagtcagacactcttctttctctagctgcctcattctcttcccgatacatatccatataattatagatagggtacattacatatacccataaaagacaaaacagcaggaaagacaaaggtagattcatctgaagagatgtgtgtgtttatctatatccagtcttctttctggttcttgctgtttctgttccttacgtctgtttttttagttgataggtagccgtaaatccatcatcattggtggaagctagtggattctgacgagaaaacaggctgtggtcttcataagcacgcctacatgctggccaccaccctcccctgctcgcacacccatcaagaactggagaacttagattgttgcttttttatttttagtctgtcttggttccactcaccctcagtgagtaaccccgttagccactgcttctgtttatatttatttagaaaagaaggaaaatgcattttaagaaaatcaaatgcataatctgttccacttcttatttattctgtggctgctttggacagtggaaagctcagaggaagtataataacttttattcatttttgttttctgtggcttgctctcttaagttctcatcagacagctttgctaataacataaaatttcatcctaatgataagcctgattttaaattgcaaagaaaaaggtagtggggccaggagcagtggctcacgcctgtaatcccagcactttgggaggccaaggctggcagatcacttgaggtcaagagttcaagaccagcctggctaagatggcaaaaccccgtctctactaaaaatacaaaaattagccgggcacggtggcacgtgcctgtaatcccagctacatgggaggctgaggcatgagaattgcttgaacccaggaggcagaggttgtagtgagctaagattgtaccgctgtattccatcccgggtgacagagcaagactctgtctcaaaaaaaaaaaaaagtgggaagtattttttatatatataaatgaaatatacttttctcttcctaatctgtgtctagtcctgttaaaattgcagatacaggcttataatggctttaactgtttattacttttgttgtctcttctctattttcttataggcatcagtagcaagtcacttaaaatagaaagggcctgtcagtttgaggggaagcaagttacaagccagacagactacatctgaccctggagccaccctaggacaaaaagtgatagaaagagatggaatagctagtgggagatttaaatgttcacagtaatagtcactggccaggtgcggtagctcacacctataatcccaatacttcgggaggccaaggcagaaggatcatttgaggccaggatttccagagcaacctgggcaacatatcaagactctgtctctagaaaaaataaaaatgaaaaaattagccaggcatgatggtgcatgcctgtagtctaactacttcccgcctaggctaaggcaggaagagctcttgaacccaaggaattccaggctgcagcgagctatgatcataccactgcactccagcctgggtaacagagcgagaccctatctctaaaaaaattaaaataatggccagcacggtggcttatgcctgtaatcccagcactttgggagaccgaggcaggtggattacttgagctcaggagtttgagaccagcctgagcaatatggcgaaaccttgtctctacaaaatatacaaaaattagccaggcgtggtggtgtgtgactgtggtcacagctatttggggagctgaggtgggggggattgcttgagcccaggaggtggaggttgcagtgagccaacatgacgccaccgcactccagcctgggcaacagagcaagatcctatctcaaaaaaaaaaaagaataaaattaaataataaacaaaataataatagccagttgcagctaacatttactgggttctcactgtgggaattcactgtgccaggtgtttttcatccatagacgaaggaaaagcaggttgggttcccagagacttacagcaaaaagaaaaggacatcatagggagccagtctgtgtagcagagaaaggccagcctttgaatgagaaggcttgatctgatccaggaactaccacttatgcggcaattttgtcccttgcttgagcctcattttccatgtctataaaaatgggaattaataccattttcttttccctgccccacaaaattcttatggggatcaaaagtgataatgcatatgaaaatggtttgcataattctacactgtctgcaaatatgagccatcagcactattaaaagtgaggcaatagaggattggcagtgcactgacagtctgggaaagtggcgcacctgccttcaggcaggaactctgttattcattcatcaataaagaacaaaggcttgacaaaataatcatgagataagaaataagatcgtttcagccacccactggctggagctgaaggagaactgtgataaattgtgccttttgttatgcaggtgccatcccacctgtgtctgtgtgccttaaatgaaggaaagtaataaaagtaataacaagagcaggtactgttgattggatgcttatctatgccatgtaccagcaccttaatttaccatctcttcctttaaaaaaaaaaagattttttaatcctctcaaaaattcatgattagcattatcattattcataccattattactattattcactgtcattttcaattggctcgcctaatgtcacatggctagttagcagaagaaccaggatttggacccagatcggctgattcaggagccttgattattattattattttttttttgagatggagtctcgctgtgtcatgttgcccagactggagtgcagtggtgtgatcttggctcactgcaacctccacctcccaggttcaagcagttctcctgcttcagcctcctaagtagctgggattacaggcatgcgccaccaggcccagctactttttgtatttttagtatagacgaggtttcaccatgttggccaggctggtcttgaactcctgaccaagtgatctgcccgcctctggctcccaaagtgctgggattacaggtgtgagccaccatgcccagccttagcctgtactcttaaccattgcactatgtaagacccacttaggttttagggcctaactgccctttgtagagctctagagttttaaggtagcacctcaggccttctttcctcgacttctcgtctgggtgagagctgttgaagagaaagttggctaaaaaaggctttgtttttataaatattaaatattgagattccttacaagattttcatttgttatctctttgagacagggtctcactcagtcacccaggctggggcgcagtggtgcaatcatggctcattgcagccttaacatcctaggttcaagccatcctcccatctcagtctcttgagtagctgggactacaggcgtgtgccaccatgcacagctaattttttcatttttattttttgtggagatgaggtctcactatgttgcccaggctggtcttgaactcctgggttcaagcgattctcccgtcttggcctcccaaagtgccgggattacaagcatgagccattgcgccagacctagatttctattttttaaaatgtatatatattaaaacatttttttcaggccgggagcagtggctcacaacatccttattttacaggtgagaaaactgaggcctagaaaaattgtgcccagataggtataatcctttgccgaagtcagaccaagttcttttctctatcatgatgtgtctctgtagtaaacttttgcccccctaaaacaacataaaaaccttcattctggctttaaacaccccccagaaataaatttaaaattctgcctctttttcaaaggttgagtgaggtatatcaccattgggagggtgtgatgttttctcttgcctttagtcaccattaggagggattaaggtttattctccagtttagctcttgtgcctgtttaaccatttctgttcaattaagaacaggaatgggttgcaggagtttgtaacaacacctgcttcttggaggagaattataacttggccctgagttgtccgtttcaaagggcccaccctgtcctcctgtttccaaagaaaaactggaagtggtaacacctggtggagctgcatgagcacgtgagtggtggtgcaaattctaggctggagtcacttctttgatgggctgccggagcctttgagagcttatggtgccaagatcctgctctacattctagtgtccaaaactgccttccatttcctcaataatgggtaggaaactgtgtccatgccagagtagctagccccgttgctactagagaggctttcttttctcctagcactggtgcctccttccacaatgcatacggctgcccaccctcgccatatgcagcctgtgtttcatatcctcacactttctaagacaggacctcccccagaacaaagccttgccttggtcctccaatccctaatggccccatcgtgatgaacagacccccaagggttcgacacagtataggggattcttatcagaccaggcctgtggtttaagccaccagtggtggttcaggatggccatggttagcctaaaaacctgatcagattgccatggtatgtcctacatgaccctgggtagaatgttgagatcctggttagaaatgcctgcatttctttaaatctttacctgctgtatataaacagttcctggagagttgtttttgttcattttaaacgttgccataaaattgttactgtgtctgatttaatactttgcctagaacaaagatactgccaaatagaaatagactaaatacatttctagcttggtgtctggcttagtcataataaaatataaaactaaaggggcagccgggtgcggtggctcacgcctataatcccagcactttgggaggccgaggcgggcggaccacgaggtcaagagatggagaccatcctggccaacatggtgaaaccccatctctactaaaagtacaaaaattagccaggcatggtggcagacacctgtagtcccaggtactcgggaggctgaggtaggagactcgcttgaactcgggaggcagcgtttgcagtgagccgagatagcgccactgctcttcagcctggcgacagagcaagactctgtctcaaaaaaaaaaaaaccaaaaaaaaactaaaggggctttctgcccccattggaacacactgaagatgctctggggagtaatgagctggcaaagggtagtgttcataatggcccaaatactttaccccacaggtgtcattcgaggccattgcctcttattccttttgtaaggtcatttcccattcagtcaactaattatcatttccctccatttataatataaaacaacagtgctgccagaggagataaaattgaataacacagccttctcttcttctggggctttgcttgacaggaacatggccctagtagggtagcaatctttctgtgacatgtgataccaactgctacatggggagtgaagtcgtcagatgtcttgcctccttcttcccttcccccacactgtccctcactcccttccccctcctcacagagtagcactgagaagtatttactcagctgtggcctggtaacaaagccttggtgccccagggattggaaggggtggtgtggtcatgccccgaactatccatgtccttccgagcatctcttggcagagcagcctggctgaggatgagtgtcatttagagtgagccttcacaacccctgcataaaagaacataaaaacaattgcagctgaaaattggagagtccacacatgggctgtggtattctctggcctctgtggtagtactattgagatcatgcagccaacaaactagaggctgttcagtcctctgggactcccatggcttgtagcatttcattatctttagctcttgtccagcactagctcactcaaccaacatataggcactcacacaaatgaatttagactgagccccatttcatcccccataaatttagagctaaaagtctttgacttcaggctttagggaaggttttctctgaaggaatgaatatatggccccacttccttccatctggcactcctccatgggtattctttagtgacaccactgtgatcctggcaaaggtaccatttcccaggaagaggagaggtatccgatctacagctatattccaccacagttctgagcaaatgtggacacgcatggtggtctgcaaggaggatgtagaaatgactaagctgctcccacagagcttcagaagcaggacttgccacagcaagaaggcagaccagatgtcaaaaagacatccttttcctacaaatgagaatgagttagcccttgaatatattgggaatcaataatttctgactaattttcttagctaaagtaaattcatctaacactctctaggattagagtggatataaccaacagaagaatattttgagtcagggcagtgcttatcttgaaagcagtagtattcatgctagagttgtaacagcaataaagtgaatttctgtgaagtgaaccctaggcttcctttggttttcatggaaaaatcagtgacatggcctggcgcagtagctcatgcctgtaatcccagcactttgggaggctgaggcgggtggatcacctgaggtcaggagttcgagaccagcctggccaacatggtgaaacctcacctctactaaaaatacaaaaattagcctggcgtagtgatgcatgtctgtaatcccagctactcgggaggctgaggcaggagaatcgcttgaacccagtaagcagaggttgccatgagccgagattgtgccactgcactccagcctgggtgacagagtgagactctgttaaaaaaaaaaaaggaaaatcagtgatacattcttatgaaaagaaatattcaagctgattgaactgagcacttggtgcaaaggccaacaagcccatgaagtgtagtacactggtcatggtttatcatgtttactgacagttatagtacctagcacgtaggggattttccttttttcacactttacaactcctggtttctcctcatacccctgtaattttgcagaaatgcctcctgtgcctggagaccccctatctttgtgttcacacagtaaccagaactttttccctatgaatttttatttgggtcactgtgtgaggcatgtttttatttattcattccttcaacaggtgtttactgcaatgcaccaggcattgtgctgattgctttagctaagttcaaagattccttaatttcaggacttcaagttttaatcagttaataattataaaataatgctaccacttattgagcactttgctaacttttttcagaaaagtgtatatgttacctcttttgatcttttacaacaattccattaggtaggtactgtagttcttacacttttaagacaaggaaaccaaggttcagggaagttgtacagcttgtctaagtcatgctggtggcaagtagtggagccaggtttttgaagccaggtcatctgattgcaaagtcagagttctgcactaatacaactgccctgcccaactaccctgtgctgtttaaagtggcctgcctgaagggtacctgtatgtttaacttagatagaaaatctgtcagtcacctggtgtgaataatcctaacatcagaagtccttcacaaaccagctggatcccacctgctagggtggaacttgcaggaccttcagagcctgtgctaggcctaggtctgaatctcagccctcttcctagctgtttccttgagaaaatgattacacctcactgagccctagtttctttatttctaaaataataatagcaagtactaacagatggcccttacgatgggtcagacactgttctaagcactttacattaactcataacaactctgcaatgttcatactgtcatttcatagatggggaaactgaggcatggagagcttaaaagtcaagtaacttgaagtcagtggcaaagctaggatttggacccgaacaatctaactccaaagtccatgctattaaccacaatgctatgctgtgctgcctctggagaagataggatcaagggtgtaaaacacctctggtctggagccagccacataattggtgagactagtgcaaggcttagaagaagaaagtttagcagtctgaccacccacaaaaggagacacacaaatttgtggagagtgttctgattttgatcttacaccaaagccttattatgtctttgcctttgaacttgcaggacctactggctgacactcttctaattgtggggggatctagagaaggtgtctactgatacacaatacttacctcccctgcacctgccaggtagaagagtggctggcaggtgggtggggatgagagaccacggtgtggccaccagcacagtggtcccccagcccatgccctctggcctgaggctgctgtgctggagcctcagtcttccctgttgacagtaattagaacttttcagactcggtttcttacatggaaaatctcaattcacttgaattgtctccttgatccagttcaactggagctatttagttcctgcagttagtttggaggggaaaacaagctcttaagcctcacacattatagctgataagatcaaggtgctgacagtgttagctgggtaggctttggagccagactgcctgggtttgaattccagttctacctcttaagtgtgcacaatctgagtttttgtgtctgtgaaatgaggataatagtcgtgaagattagtgaggtgacatatgtaaaccccttagaacagtgcctccccaagaccaagtgctcaataaatgttagctgtgttattgttaagcccctcctgccatcagcctcccttctctccctcccaccctgagatcttgctcagggaagacaggtccccttcctctcccctaccctggaccctcctctctttccttgctcaccagcttatttcatccctctaaactttctcatcctcatctgtgaaatgggactggaaataatggagtctacttcataaggtagtatgctgtgaaggctaagtgagttaatttttttttattttttatttttttgaggggggaaggagtctcactctgtcacccaggctggagtgcagtggcatgacctcagctcactgcaacctctgccttctaggttcaagagattctcctgccccccaagtagctggattacaggcacctgccaccatgcttggataatttttgtatttttagtaaagatgggtttttgccacgttggccaggctggtctcgaactcctgacctcaggtgaactcttgccttggcctcgcaaagtgctgggattacaggcgtgagccactgcgcctggcctaagtgagttaattcaagagctgagcacagatctccatggctactcactctctttacagttattgctggagcacaaagggctgtgagaagggcctttgagatcttggacagttctaagagccaaagggcccaaaatagacaggagcattagggtgaactggtgcccaaatgcaggctgcagaagctagggggactgctaccttgttcatcataatggggagcctggaacagagcaggcacatgggaataggaagtgagtggccactgcaggagagtgttcaaaacggatttggctcaggcaacccaacagagaactttcaaggcagaaaacttttaggtgtttaagtgtccaaactcagcaacagccaggctcatgcctgtaatcccaacactttgggaagctgaggcgggaagttcaagactagcctgggtgacggcacgagaccccgtctctacaaaaattttttaaatgcgcagggtgtggtggcatatgcttgtagtcccagctacttgggaggctgagatgggaggatcacttgagctcaggagttcgagactgcagtgagctatgccactgcactccagcctgggtaacagagtgaggcccccatctcaaaactaattaattaattaattaattaaaatttaaaataaaaaaaactcagcaacaaataccttcctcctctcttcttctcacctccagaatttgaaaacagaaccaaaacaaactcccattgtttgatgttactaagttctagacattctgctaagcactttatagacatcatctctcttacacttgactttaaccctgagaagtgtcagtgtcacttgcattttacagatgagaaactgagacttagagagattaagcaatttgcccaagattacatacctggtgaatcgcagagccaaaatttgaatcctagcctatggagcagaaagggaacaagctcccatatgcctatcagtgttctgattttgaaataagtcttaccacttatagttctctcaatacccactgtacaacagctgaggagtgtctcgaagtagcagaaatcatctgcccttgacattatctggtcactacttcagtagaattagaactcctctctccacatcccaacacagagtctgcatggaagaataataataacaactaatagaactactctctccacaattaaaagttgtttatttgcttgcattttcattaatctctttatctgactactgtcctcacttaacatttagaagagtcaagttccagaagtggtgagcaggatgtattctgtttttcatatttttaagagcttttgttgtgttagagaagcacgcagtgatttttgtaaatcattcttctgtccttggaagcaagtacttgaagtacatgagttagaataatatcaaaaacctgaagagggcctagggtctagaaaccaggaagctaatgttgactcctagcattgtctttcttaattaagtaactctctctctctctctctctcattttttcattttccttcattctgttatcttcccaaggatattttgtaggtaatttgggggataaatgtaagttcctatgaaacactctgactctccctaagaatgctatcagatatatccaccaaagtttagcctagaaaagcacgatgattcaaagatagaactttcctttatttactccctgccctgccagaaatcactcttctcttttctctacatggggagttctggagtgagaataaagtgggaacacattagactcagtggattttctcccttcccttcgcctttttcctcaccccaagcctgagaccacgagtggcaatgactccctcccttgaagaacaagacctcctgccaggctgtgcccgaggtcaggcaagtgggaagaggagagtgccacaaaaccatcttgatcctttgacctatattgacgctgagtctgttcctttggtgtttctgactttggcagtgtggttagtcaaactctctgtccccaccttgaattaagctttgatgaaaaagtactaggaacccaggcctttccctggagatttggggtttttgtcttggaaaagcatcaaccaaactaacgggggcaggagatctggattcctgtggcttgggctaacttaggtccaaagaaaccaagtgcctgtgatcatcatcttcattccccaaatgtagccatgccctctggattccctcctctcactcatcctcctcccaattaggcaggcttccgggtggattgctctcactttagcattaccaggcccttccatattcgaaatgctttgatatatgataatacttacacattcttactccttggctgatctaaaatcttttgccttcagtacatgcagcaacaaaataacttaagcatcagtgtatttcttctccctcaggatcctataaatttctctgagattcacctctctgggttctctgctggaccacagagcctcatcctggctcacctctcccaaagcacaaagcattgcttctgtatatcaggaatcatttggttgccttgactgtatatcttggacctttgtcttggcttcctataataggatgaccagatttgtgttcagccattcaaaagaagccagcctgctgcagtactggatgacagagtaatgaggtctgtgggtttctatgctgtactcttctccctacacagcaagactgtttgcgttagtactgcttccagatattctgtggatggtctttgggcatgtggtgggaaacgttaccatgccagagaatttcagcaaatttaaccggctttgaaatgacttgttcttccagatttttatatacaaggaaaaccaaactaaagaagactgatgaaggtgcctctcttgtttgctctcttcacccgaccaattttcataccagtgaagctcctttggtcaaaatggtgtaactggatgcctcccaccctggaaaagctttgtagaaatactgatcttaaaatctcacacctggaggttagagactagcatacccttcacactgacttgcttttaaaagaacagctctaccaagaccaggtctgaaactcatgaaatgaacaaaaagagggcagtgacttgaaatgcagagacctaatgtgttcctctccatttccacttcagatttgctgaccatgaaagaatatcactgtttgctgcaattactgtgtcctgatttcccgctggagctcactcagaaagcagccaggtacgtctcctggactcttgaaaccaactcagctctctgtgggccactgcttcctagagaaacctggagtgtatacaaatgaaaaaaaggagcatttagggaagaaactggcagtgggagaggggtctatttgggatgtgccccaaaacataatacattctgcatttccaaagggaagcgaaatgatcctttgtggtttctgtggggagcctcagggtctgaagatagagttggagggtggtgagatgaagaggcagaaaaagcccagacccctccaatacccccacacacacacaccctagaggatattctgagaaaagaggggctgcatttgtgtgttttcacgctactgtaaagatactacccaagactgggtaatttatgaagaaaagaggattaattgactcacagttccgcgtggcctcaggaaacttacaatcgtggtggaaggcaaaggggaagcaaggacctttttcacatggtggtaggagagagaagtacagacaggggaaatgtcagacgcttataaaaccatcaaatgtcttcagaactcactcactatcacaagaacagcatgggggaaactgcccatgtgatccaatcaccttccaccaggtctccctctcaacacctggggattacaattcgggttgagatttaggtgggaacacaaagcctaaccatatcagggggcaagggttggcagtgacttgtgatgaagagagttgaggttggggactggaagggcataaaggtgataaagccccagttgaaggaaaggcacattatattatttatgccagaagaaggttttcaagatcagtccagaaccaggacttggcagaaatagttagaagcccctaatttctgtgttgggtttcaccatcattcacaatttttaaccacatgaggtaattggactatgcctcagttaacttttacttacttaactcaaaacctgagctaggccagacacggtggctcacgcctgtaatcccagcagtttgggaggccaaggcaggcagatcccctgaagccaggtattcaagaccagcctggcctacatggcgaaactccatctctactaaaaatacaaaaaattaaccaggcacggttgcgcttgcctgtagtcccagctattcgggaggtggaggcaagagaattcgcttgaacctgggaggcggaggttgcagtgagcagagatcgtgccattgcactccagcctgggcgacagagcaagactccgtctcaaaaaaaaaaaaaaaaaaaaaaaaaaaaaaaaacctgagctagggttgcaaatggacgtacagcaaaaatcatgtttatcgaagaatgcctaccttccctatatcatactgaatgcatttaccttcattgttctatttaaatttgtttaccttaactatctcacctaatccttgtaaaaactgttacttccctttaaaatgatcctttgtggtttctgtggggagcctccggctctgaagacagagttggagggtggtgagagtattaggcaaacaacaaaacacacacacaaatacatacccacactcccacacacacccctagaggatattctgagaaaagaggaggcaagggttggcagtgacttgtgatgaagagggttgcggttggagaccagaagggcctgaaagcagctgggcgtggtagctcatgcctgtaatcccagcactttgggaggccgaggtggatggatcacctgaggtcaggagttcgagaccaacctgaccaacatggtgaaaccctgtctctgctaaaaatacaacaattagcctggcgtggtggcaggcacctgtaatcccagctacttgggaggctgaggcaggagaatcacttgaacctgggaggcagaggttgcagtgagccgattgtgccactgcactccagcatgggggacagagtgagactgaacgtcaaaaaaaaaaaaaaagggagcatgaaagtgatgaaccccagttgagggaagggtactgttactgctcacttcactgaagtgggaactgaggctcagacgggtgacaatgttgtgcgaatatactgatagcttgtaagtagcagtggcagaactggaaccgcagtcagcctgaatccagagatgggggatcgggagcacaaggagtctcttcatgctcccacctccctgtgtcatggcatcatttctgctttgtggtttgacccactgaaaacaaagctgcattggctgcactgcaccaagaatcacctcgctccttttgaaatgtgccaaccagctcctctattgacttggaagatgggaactccattgctcccagtgacagacaccagcctcacggtggggcacggtgttttgcagctaacagctcatgacctacttttgctggtcatgtgcaaaacctgtttagtgatcacacatgcaaaattttgtaggtttttttctccctcattattcagtggataattttctttcctgatggcaactggccactggtaaaagccgcagttcaggttttataattttaatttatctgctatccaaaggagatttggatattttttttcttcactgaaaaaaaaaaagtatgggagattatctcttgtaatttaaaagcagccaaatggagttagctttaaatttccatgatcgttcccctttgggcagaaatcattttattaaaaacatttttgtttgtttgtttgttttctttgagacagaatctcactctgtagcccaggctggagggcagtggtgcaatcttggctgactgcagccttcaccccgcctctccctgggttcaagtgattctcctgcctcagcctcctgagtagctgggattataggtgtgcacaccatgcccggctaattttttttttttttgtatttttggtagagacggggtttcaccatgttgcccaggctggtctcaaattcctgacctcaaaagatctgcccacctaggccttctaaagtgcctgggattacaggcatgagccaccacagccagcctgggcccagattgttttaaggaatattcagccccaaaatctggggagataaactcagcatccttaaagaccgaacttaaggccgggcacggtggctcacgcctgtaatcccagcactttgggaggccaaggcaggcggatcacgaggtcaggagatggagaccatcctggctatcatggtgaaaccccatctctactaaaaatacaaaaaaattagccgggcgtgttggcgggtgcctgtagtaccagctactcaggaggctgaggcaggagaatggtgtgaacctgcaacaactatatcctatattcatttgttcatttgtttattcatcaaatgtttctttttaacagctttttgggatacaattcacataccatacacttcactcatttaaagtataaaattcaattgcttttaatatatttccagagttgtgcatccattaccacagtccattgtagaatgttttcattaccctaaaaagaaatcctacaccccttagccattactcttcagtccccactccaccgtcttccccaaccctaggcaacccctaatctactttctggctctgtagatttatccactgggcatttcaaataagtagaattgaggccaggcacagtggctcatgcctgtaatcccaacacttggggaggctaagtggggaggattgctcaacatggtgaaaccccatctctaacaaaaatacaaaaacttagccaggcgtggtggtgtgcgtctgtggtcccaattacttgggaggctgaggtgggagaattgcttgagcctggggggcagaggttgtagtaagctgagattgtgccactgcactccagcctgggcaactgagtgagactctgtctttaaaaaaaaaaaaaatcaaataagtagaattgtatatgtggtcttggccaggcatagtggctcacgcctgtaatcccagcactttggaaggctgaagcaggaggatcatttgaggtcaggagttcaaacccagcctggccaacatggtgaaacctgtctctactaaaaatacaaaacttagctgggcatggtggtgcacatctataatcccagctactcaggaggctaaggcaggagaatcacttgaacccgggaggtggaggttgcagtgagccgagatcatgctgctgcactccagcctgggcaacagagctagactctgtctcaaaaaaaaaaaaaaaaaaaaaaaaaaccacgaccaggtgcagtggcttacgcctgtaatcccagcagtttgggaggccaaggtgggtggatcacgaggtcaagagatcgagaccatcctggtcaacatggtgaaaccccatctctactaaaaatacaaaaattagctgggcgtggtgatgcacgccagtagtcccagctacttgggagcctgaggcaggaaaatcgcttgaacccaggaggcagaggttgcagtgagccgagatcgcgccactgcactccaggctggtgacagagtgagactccatctcaaaaaaaaaaaaaaaagtgttttttttgtgactagtttcatgttttaggttggtgtaaaagtaattgtggttttgccattattttcaatggcaaagactgcaattacttttgcaccaacctaatagcacaatgttttcatggttcatccatcttgctgtatgtatcagtacttcatttcgccaaatgtttcttgagtgcatattttgtgccgggagctattctgcaaatggggatacagtcatgaataagatatagttcctgcccctcaaagaacttgatatagaaggggactgcttaggtactggtcattggctgccaccactctgtgacgtatgaccttggttttgatcaatcactccagaatactgacctcttttccctttcccatgatgtgagggagcttatgagagtgaggcttcaaaatgcatcttagccccccgcagccacagctttgcatttgccccagctgtctcctcagacccttccaaacaatctgatacatgaaagcaccacaagatttgagtgtaggtggtagaatcctgtaagaaccaaaaattctcgataccaaggtagaattgtacagttattgataccaaggggcttctggaatggtattcctctatttgcggctggaaacttacccactcctcacctagaggcctgctgtttgacagacacctcagacctttctgtctgagcaggaggaagcatcgtagccagtccatatcaatagcagtctgagggaattatgggaatggcagtaacaacagaagggccaagggtaacccacatggcactggctgcagttagagatgaattcagaattaggataagtttgttttctccccgagtatgagcatcaagcttctgtgtcaacttctcctcccaatgccatgctttccccactgtactgcagctggtgcatatgtagaaaaattgtatgtatcccagaaagcatcccctgattttgtaaactattctcattttgtcctgaagatcagggtcccagcttccccacacacatacctatgcatctgatcagaactgcaaatggaggtggtagagacttcaaggcagttactattgctagaagaggaactgccctctcccatttcactgccaggcttactttattcaggacactgaagtctggggacaggctgcagaagcaggctccagtctgtgatgatgtgtgcgtaaaagaatgtaatccacatgcagctggaagccggagcctgttcaggggcatggtgtctccacatgcgcctgccttatgtgctacaagcatcatggccaggccctggggcagcaggtgtgagctggaaaaacaggaaaagaaaaagcaaacagactccatgacagcagccaagccagagatcccctccacctcacatattcctgcagcaactggagtagttcttttatccccagatgatcaccacagcatctcccactccccatcctccatggactggaagctttctggatggttaagagcatgcagttggaaccagacttcttgagttcaaatcctggttccacaatatactagctgtgcccttgagaaaggtatttaatttgagcctgtttcctcacttgtaaaatgggaataataatagttgtaatgattgaaggagaagtatatgatgtgcttaaaatggtggctggcacagagtaaacttgtcataatcgttagaaatggtaatattaaccttgacctagaagaacacaggccccatggcattagaaagatctactgtacatcccacctgtgccccattaactggatgaccttgaggatatctcttaacttctctgagccctgtttttatatctgtaaaatggggatgataataataatagtaactaactcatagggtgtttgtaagatttcagtaacaccaacaaaaccatgaacactgcttaccacattgtagacattaaatcagtaataattttttttttagatgaagtcttgctctgttgcccaggctggagtgcagtggcgtgatcttagctcgctgcaacctccgcctcctgggttcaagtgattcttgtgcctcagcctcccaagtagctaggattatagatgcccgccaccacgccttgctaattttttgtatttgtagtagagacggggtttcaccatgttggccaggctggtctcgaactcctgacctcaagcgatctgcctacctcagcctcccaaaatactgggattacaggcatgagccaccacgcctggccagtagtaatttcttgctgttacaattatgttggtattattaatagtaccagattaaaagaaaaatgagatgttcctgggtttccaaaggcaatgcttcctggcctttttgcacttcacagcaatcagaaaataatatataacaaaaatctccagtaaagacaagacttcttgtgattggcctgcaggctctggcctcctcccagctgggccaaggggaccatcacatctgtaagtcatttgaggccgaagtgacaaagggttgggaagctctgctccaagggtgaagatttaaagcactggttctcaaacttgagcatgcatcagagtcacctgcagggcttgttaaaccacacatggccggaccacatccccagagttcagtaggtttagggcggggctcaataatttatatttctaaaaaattcccaggtgatactgatggtctgggaaacacacgttgagaaccactgatttaaagtattgcctgccattttttttttttttttttttttttttgagatagagtcttgctctgtcaccaggctggagtgcagtggcatgatctgagctcactgcaacctccgcctcccaggttcaagcgattctctcgcctcagcctcccaagtagctaggactacaggcacgcaccaccatgcctggctaatttttgtattcttagtagagactgggtttcacactgttggccaggatggtcccaatctcttgaccttatgatctgcctgcctcggcctcccaaaatgctggcattacaggcgtgggccaccgcacccggctgtattgcctgcattcttattctggctgggcatggtggcacacgcctgtaatcccagcactttgggaggcaaaggcaggtggatcacttgaggtcaggagttcgagaccagcctggccaacatggtgaaaccccgtctctactaaaaagaaaccccatctctactaaatacaaaaattagtcgggtggggtggcacgcacctatggaatcccagctactcaggaggctgaggcaggagaactgcttgaacccgggaggcagaggttgcagtgagctgagatcgcaccattgcactccagcctgggtgacatagcaagactctgtccctcccaaaaaaaattatttaaaaaatgttattattttttgaaatgaggtcttgttctgtcacacaggctggagtgcagtggtgcattcatagctcactacagcctcaaactcctgtgctcaagtgattttcccacctcagcctcctgagtagctaggaccataggcacgttctacaaagcccagctaattttttattttgtagagatgggggcagtgatcttgctgtgttgctcaggctggtctcgaactcctggcctcaggcattcctcctgcctcagctttccgtaaattattttattttattttattttattttattttaagatggggtcttgctgtgttgctggggctagactcaagctcccaggctcaggcagttttcctgcctcagcctcccaagtagctgggactacaggtgcacaccaccacacccagctaagaactttttaataaagaattcctacaaattggctgggcacagtggctcacgcctgtaatcccagcactttgggaggccgaggcgggtggatcacctgaagtcaggagttcaagaccagcctggtcaacatagtgaaacctcctctctactaaaaatacaaaaaaattagccgggcatggtggcgggcgcctgtaattccagctacttgggaggttgaggcaggagaatcacttgaacccgggaggtggagattgcagtgagccgaaaccgtgccactgcactccagcctgggcaacaagaatgaaactctgtctcaaaaaaaaaaaaaaaaaaaagaattcctacaaatcaataagaaaaagattaaggatctcagtagaaaaatagtccaaagatataaacaggcaatgcacagaagaacattagtaataaacctttgggcatattttcatgcccacactcactagtaatcaggaaactcccaactaaattgagataccacttcatacctatcaaattggcaaaaattttaaagtctcataatacaaatattggtgaggatgtgaaatagtgggaactctcataaactgtgtgtgggagtgtaaattgttacaattactttcagacaatttaggcaaatttttaaagttcaagagctactcctgggaataaggaaacatgcagtattgtttgtaatggccgccattggaacaatctgcacgtccctctgctgaaggaaagaataaagtgtggcatattcataccatagttgtggaattctttccagcagctaaaatgaatagctatatatgcatcaatcctgatgaatctcaaaatatcaaagttacagaatgacacagagtttgagaaaaagcaaaacaaagctatataatgttttaagaacacagacatttgcatgagttaattatagtataaagacatgcagaggaatgctagactcccaagttttagtaaatcatggtgatccccccaggaagaaaggtagaggataggatgagggaggggtgcacaggtggctgaaatggtatctgtaatgctgcattttacaaagcttttaaaaactgaagcaaagatagtaagacgttatggtctgataaaattggctagtggggacacaagtgtttgttatgttattctctgtagttttctgaggttctaaacatttcctttaaataaaaaatgatggggggattaggtagagagcaatgagagcaaaaagcatttcagggaaagtaagcagcatggaaaagaagctaggctctcaccaatgatggcctggaggaaccaagagaagccagtaggtctggaatttgaggcatttgagggcagagggagggaaagtggggctttacaggccatacattgggtttgggtctttattctaaggtctgtggaccagttcacccctagctctcaggcttcttgggaagttccagagtaatgacaccttcaggctgtctacagggaagcagcagcacccaggccaaatcttccagtccttctgcgggcagctgctctaacaaacactcaggctgggagaagggaaaggggcagcaggaaggcttcattaccacgagacagcacagagtccactctttcttaccagaagtggctgcaggtggtctcggaactgtgactagcgtcagagaggcctgtatttgaattatagcttttttgctcctagtttgtaacctgagtcaggtttcttaattcctctgaatgtctgcgttctccataaagatactcactgaactgacctcataggattaatacgagcagaaaatgaacttatgggtgtgtagtgctgacagagtaagcccttggtgaatattcactattattatcatcatcatcatattgtttcccacaccctctggatcaagcgtcttaggcatttcagggcaagtagggtttgggataccctggaggtgcgggctggagctagggcagagcaatgacctggacaccccacgccacttcaaggccctaggctagaggcagcttgtgcagcacgagtgtgcctccaacacagtccagaagaggagcaaccctcaggaaatggcccaggacaccttcatagcggcctttttcctcccacctggagaaggtaaccagacatcgtgtcatcgctgcttctctcatggccctgacattcaaacaaaaaccctagaggtgcactgtgagcccaaacagacatggggacacccttcagccaccccatgactgccaccttgacctggggacacccttcagccaccccatgactgacaccttgacctgaggacaccctccagccaccccatgactgacaccttgacttgcggacacccttcagccaccccatgactgacaccttgatttggggacaccctccagccaccacatgactgacactagtcatgtgacctcctcaaagaagtccagtcatggaaagtggctcttctttctggccgtggctgagggctggcttcccccaaaagtaaactggaaactagatcgctggcttctgcctgagacctctgcctggtggatgctggcagcacgcatttcctctgggctctatttttatttgctcttttgggctctcccagcactttaaaccagatagaatatacttactgattacagccggcgctcattctgagcacctgttagacactagcatatataacatcatcatgctgactctccacaagaatcctgggaaacaggaactatgattatatcctcttcacagatgaggaaactgaggctcagagggaaattgtcacttggccagtgagtagtggaactaggacttaatcctggggtcaactaatccagaacttcaggaaaaccggtgcagcccgtgccactagaccagggaaactgaccctaattaggggtgaataggaagttggcaagtcagtaggttcaggctggaagctgttgcttccttggcacccttagaactcccagccagactgcctatcccagctgctggaagtcagcaggggagggagaaagtggccagtctctcagaccagccacgtgctctttctccactccagttgcctgtcctaggctccaccccacacatggttctgctcagcacagcctgaaccaaagtgcctctacttctccccaagagtccctctctctagcccggaggcatggtccgcaagggtccctccatgatccaatagatttgtgcagactctcactggcagcagctccctgttggctccacttcaaagcaggggcggccgggcacctccaggtgtcagaagcagctggcacgttagcagaaggcctctggcaggaaggggtgttgagccaactgccagcaactggaaaacagcacatggggatgacctcgtctccaagaagattctttcccgagccctctgggagtggcaatgagcttgagttcagaaggaaggagctgtctgtggggatagaagggttgcaggcaaaggcaaagaggcaaagacagaccaggagcttcctgcttgccttttcccatagttctgctgagattccaaagcaagatgcagatgcccacagccagaaagatcccataggtgggttaaagacacagatgcctagaactttcatggtctcagcattcatttggagacagacagcacagcatatgatgtgattaaaagcacctttcagtaagtcttctgcagccatagacctctgaacatcaaactgtccccccactagatttaacactaacaggaggagctgttagttctgtccacccttgggacaacactgtcagagctggaagaagccctttgggaagtatgagccttcaaacttctgcttgaacatttctggcaatacacatctcattcctttacaaatcagccacaatcctagaactaagcagcttgaaaatgtctctagagccaaactctagatccccgtggcatctccccaagaggcagtcctttgagagttgggtctcagccttcacttcctccctagtcttcacttctaagcaaaagatctaaatgcagccatttatccagtatcctggtttttagactgtccatcagcctgaccctcttctccaggactctagtttactccccttaaacggactgtccagacctgaaggtagtagtatttgaatgacagctcttttgctcctagcttgtaaccttcgccaagtttcttaatccctctgaatgtctgcattctccataaagattgtaagtatctttatgagagggattaagaaactgctccaggtgccacctggccagaggaaaaggggaccgtggcttctctcactcatttgttcatgcatttcttcattcaacagacgttgactgagtgcctactatgtgccagacaccataccagagtcaagccacaagcagggagacagaggtgtcacttggtagatcttatgttcccaggacaaagacaacagtgtgaggaggtttccgagaactgcagaagccagtagcaggggggcctattctaggctgggttagaaaaggtgctttcctctttcatcttccccaagagatgctgtggaggcttcagcctgaagaatatggagatatccggtaggtgaggaggaggcatggagggcagggagcatcatgggtagaagggacagggagcattatggctagagggacagacttgtctggagggcatgagtaaggacagcttcagggaggatggaaggactagtgtggccagaatgcagtgggggagtcgagggaggcagggggcagatggagcgggctcacaggccagatccaaatgggggaacgtgtcctaagggcaatgggaagactgtgaaggtttttttttttttttttttttgacatggagtcttgctctgtcatccaggctggagtgcagtggcacaagcttggctcactgacatggccacctcccaggttcaagcgattctccagcctcagcctcttgagtagctgggattacaggcatgagccactgtgcccggcctctgtgaagggtttccaacacaatggtaaaatggtcacattcacattttaggaaaatctttctgcccacaggatggatactcaattagaagaaggctcacgcctgtaatcccaacactttgggaggcctaggtgggcagctcatgaggtcaagagatcaagaccatcctggccaacatggtgaaaccccgtctctactaaaatacaaaaattagctggacatgctggcgcacgcctgtagtcccagtactactcgggaggctgaggcaggagaatcgcttgaacctagggggcggaggttgcagtgagccactgcacttcagcctggtgacagagtgagactccatctcaaaaaaaaaaaagcaagaggagtagttgcagggaaactgggtaggaggtcatgccatcatcaagaaaagagaggtgaaggctgggggtaggatggtggctgtggacgtggaaagaagtagatggattcaagagaaatttcagcaatagcattgataggacttggtgactggttgattggcttggagcagagggtggcggggggaagtttccaggatgtctagtatgcccagcgtttctggttgaggagagtcatagccggtgttgctgttaacacaagctcggatccatttggctttttaaaaggtagccagtcttacttcttgcagttgaaaaaaaaccctcagtcctttatacatgtgctgctgggatccagccacatgtcccccagaaagaaagccctcgcctctgtctgcacccgcttcactcgccccctactccctcctgctcggcatatgtttcagctccccagtctctgagactcagactcttcacctgtagaatggaaataacaataagacccacccgtaggactgttgtagaataaaatttaattaatgtagtcaaatgccttaatagcctgccatgaggtagggtactcaggaaagatacctgcctctataggcggatcacttgaggtcaagagttcgagaccagcctggccaacatggtgaaaccctgtctctactaaaaatacaaaaattagccgggcatggtgacaggcacctgtaatcccagctgctagggaggctgaggcaggagaatcacctgaacctaggaggcggaggttgcagtgagccgatctgcaccactgcactccagcctgggcaacagagcaagactcaaaaaaaaaaaaaatgcctctattgttacccgtattaagggcacctgcagggctgccctgctctgacggacactcctaccctcccacggtgtgcgccccctcttctgcaacggcccatctccaaagggactgctgatgtttgaggtcaagatggcccctagcagaaagctgcagaccacttctgaggctggaagggtgtgccctgtttatagcttctagtcccatctgtggctgaaagaggaagatgctagtggcactcagcattaaggcttccgcgaggctgcgaggcaggggtagccctttgggaagtacgagctcaagcttctgctccgaggcaggctctggaatgggcctattggtgagaattgcaaatggaggtaacttctgtaattagacagtggtgatggtggcgctactttgtgaatatactaaaaaactgaattgtacgcttttaaagggtgacttttatggtgtgtcattatatcacaatgtaaataaatagcaagtggaagttgctgctatgggagtgctgtgttccaactgatgatcaacagaagccatggaacacggggaaagccttgggctccctggtggtttcctgcttggggatattcacagcccagtgctgttctgtcgtaattcactttagactattggggctccagctgtcctgagaacagggcagtaaaggaaagtcagtggcttctcatgtccagagcctttgcctgccctgctgagcctgccaaggaaaagctttgaggtgctggtggcccttgctccctgagcgctcccgggggagctcactcttcctctgcagtttggaggtctttgctaaccccagtcctctctagctgcccgctctctgctgtctccctgctccctcaatccagatgtcaaaacagattctgccatctgggtggggagggagctgttctgctgcctgggttttccttgggttatgagatggggtaaccacttggcctttggcactgcacttagtcctgtgaactactgacagagggaccagggcaccctcttgtggccctcagcggcactgcttcttcccgccctccagccttgaatttcttccagctggaattctagtgttgaactctggtggtggaggcagctgtcgttctccccaggagatgcctaacatatcagtaacaagaaagaaaataaatcagccacagaaactaggaggtaaaatgttagtgtttttgctctgcagctttattttcaaagaggcagtgtgctctcatggaagatgtgtggcctgtggagtccagcaagctccccagctgtgtgtgtgactttggcaggctgacctctgagcctcagactcttcacgtgtagaatggaaataataagacccacctgtaggattgttgtgggataaaatttaacgaatgcagttaaatacctcaatagcctgccacgcagtagggcactcaggaaatggcacctgcttctattgttatctgtattacaataaagactaggcaggaaccactgtctctcttcaggaagatcgcagcaaagggagtggcaccacaatatcgtagtctctgtgaagccctttccccagcagtgagcaatcctggctttctctggggctgatccagttgccagtctgggaaacctctgactcagggaagtggagagagatttagaaaaatatgagagagcaaaagaaaactttttttgttttttttttgacagggtctctctctgtctcacgggctggagtgcagtggtgtgatctccgctcactgcaacctccgcctcccaggttcaagcgcttctcctgcttcagcctcctgagtagctgggactacaggtgcccaccatgcccagctaatttttctatttttagtagaagtggggtttcaccatgttggccaggctggtctcgaactcctgacctcaaatgattcacccatctcggcctcccaaagtgctgggattacaggcatgagccaccgcgcctggccaaaaacaactgaaaaaagaaaaaaagaaagataaagccagaaggacctgatcagaaacagattgggggcccgccccaccccatctgatagcttggcgcctgcctggcatgtgatggagcccagcaaacgctcgtttccttctcttcttgtcctggctcagatgaggtgctgagcagaggatgaacatagccttggtcggatccctttatgagtcagacggttttcttcctgtgaggtgggtcctcagtgggagggactagagacaggaaaaccgttgggtgggcaacctgtgaacatggatgcaaggaggagcagggcggcagcacaagatgagtgtgggttttgaccctcacaagtgcagattccccaatagctctttgccctctccccttgtctgccatctgtgccccagggtggcggtgtctgtcgctgttctggccctttggtagcttattaaatctcagtaccacttgccaagaccctttaaaccccttagctgttctttttgccttttctgatcagctgtatttattctgaactaaatggtcctcacggcagaatgaaaggatttactgcttaagtatatgaaaagaaaccttggctgcattacagttgcaccctctcctcgccaccccctgcccatgctccatccgctagctggtgccactgagactgaaccgggagcccgctctgggtacagtgtggtcagttcagtttggtggcagagtccaattgatggagcagtgaggtgactgggaggagcttgcttttgggagccctctcctaaatgtcctgctgccccaggggagactggcggcccaggaacagctctctctctccctctcccccgcacttttcccttcctccctctccctctctccctcccctccttaaacctctcccccattctctctctcagattctctctttccccttcaggattgtgctcatggacgatgccatggactgcttgatgtctttttcagatttcctctttgccttccagatccagttttactactcaggtgagtgttccggggctccatctggctccgcacaggaccctgtctccctgtcctgccctgctgccctgcccatctgtgtgcctggcacacacgtttctcttccccacttcctttgggggtgtgcttcactgcgggtcgctaacaggatgtctagtgttcagtggtggtcacaagattcagtctgcagagccgacttcctcagcctcctgaagacactgaacaccgcagtgttttcagtcagcaacgcaacaaatcagtttaagtgataatgacaataacaacatccatagcatccacagcattcactgcttactgaaaacttactatgtcccaggcacagcactgactttaatcttgacaacagccttgagagagagtcctttcagagacaagctcacagaagtagtagccagtcatgcagctcataagtggtggagaccagacctgaaggctgactccaaagccagcgttcccaacctcgctgctattttactgccttcaagggtctctcccttggcaactgatcgtgcgtttgggtgcacattctcctccaccccacagctttaaaaaagcatacaccagtcctttgtcacactcccactctgctccccaattcacacagctgcacccttaagtctctctggaatcagatggaataaatatagacaaataaatataaatatacaccagctcacgcacagagacatcaaatggagtgccgggtttacaaattgctgactgtgttcataaacaaacttgcttaaaacaggctcttccagtaaatagaaggctgtccttagatcctagaggtggccttcctgccaactggtgtccccagccagccctggcctcatttgggcgccacattctgtttacttgatggcagcccaagggctgtacagttaggggctggagcctggggtctcgccacctgctcttagcagcaccagtcatttcccatttctctgaagctcttgggccctagagaaggagcagccatgtctgggagaacatttttccctcactgtctccccagccctcttctcacagcacccccagagggatgggacagccaccacattgggctgggagcattactgacactgcccagcggtgtgtgtagagacgagatgggccataagtcagcagttctaacaatggctcaactacgaaatttgaaaaccatttcaaatgactgactcatcagcagctttcaggctttctctgttcctcgctggtattccaacacgctttcttgaggtagagaggcaggtggccacacaccatggggcttaccagtgggagcatactcatgttcactcctccaaaaaatatttatggccttaatatgtgccaagcacagtgctaggcaggagaggccaacaaggcatgaccccgcctttgtgcattccagcaaggagacagattagacaattaatgacacagaaagctcctcactggctaagtgccagaaaaaaaaaagcctatggtgctatgaaagtgtgcaatggcaggtctcacctggtccaggaacaactgagccaaggatgggacatttgagcaaaaacacagattagtgtcatctctcatcaatgtgttgtcaaacaaggttgagaacttctgctctcaggacaccatgccctgagcactgaggctggtgtggaactgggctgacagagaagggaagacatagtgaacagacaaaacatgtcctccctgcctgagccgtccacacccacacccccacccccacggttccagaattcctggacagtgtggctgccatctatgaggacctgctgtcaggcaagaaccccaacacagtgattgtgccgacgtcgtccagtgggcagcaccgccaacgacctgccttgggcggggccggcacgctggagggcgtggaggcgtcgctgttctaccagtgtctggaaaacctgtgtgatcggcacaagtacaggtgaggaacgggcatgcagcccccagccccccagccccagggggtcggactgctggctgcggaacagagctccgcaggatgttctgcgcggcccaggcattctagggcccttgctggtcataatgtaacagtgccatttgcccccaaaccagttgttgactgaaaggctctcaattagctcacttcaaaaggactgctttcactcaggcaagaccactgtagttgaccaatttactgggtgacagactggccttaacattttagagagaaggaaagagtactccttgtataaaacttttctacacaaagagaggggtaagctgtcctgtgtggcacaagtacccttagggactgagcaacaggtttggtttcccgtagccatttcccacccccactccccaccccggtgaaagcaccagttagtgaacatgccagcccctcctgaccatagtgaaggcctgatcccccagggccttggggctcccaaggcaggtccctggcttggctgtgggtatcctcatgaacctgaaagtatggatgcagaggtggccctgaggctggctaggctctgaatgtggcatctctccttcttagctgcccacccccagcacttgtcaaagaggccctcagcaatgttcagagactgaccttctatggattcctcatggctctctcaaagcaccgtggaatcaaccaagccctcggtaagtcagagctaagcagccgtcagcctctcctgccgcacaacacagggagcagctggcctctgttagcaacacggctccagaggggaaggggcatcaccatctctgccttgacttcccagggccggactcaatcccagggagcaggaatatggcgacaaaacatggctcttacacattcccatggtaggggacagccctccctgcctgcagccctgccccaacatgaaaccacctccccatagcagaagcgcccagcccctcctcagagaaccccagctctgctttggggagcagcctgcaggtcgggcagacacaggactatttactcagtgacgctagagattatatatcaaagagacctgaatcccatttataaacaaggcacaggtgtgtctgcggagaccttttttccaagctgaaaaaaaaaatctgattaatctgaaagggagaaaaacaaaagtaggggaagtctgcagtggcccagtttttcctgcctgctgttttttttcactgagccttctccacccaccccactgttcctcctcccacagccactgctctcctaagagaagagccagtaagcctccattctactacagtttaaggttttttgttttttgttttattttgggacagagtctcgctctgttgcccaggctggagtgctgtgtacaatctcagctcactgcagcctcgacctcccgggctcaagtgatgctctcacctcagcctccctagtagctgggactacaggcatgcgccaccatcctggaaaatttttgtgttttttgtacagactgggtttcaccatgttgcccaggctggtttcaaactcctgggctcaagggatcccctcaccttgctctcccaaagtactgggattacagttgtgagccactacgcccagcaaggagttcttttttgtgtctcgagagatcctcctgctgtgcttgggatcccaggtgcctgagtctcaaggaaaagacacacagcatcccccttccttttgccagttgagggaatgggattaagggaaggaaagttaacattcactaaatgccaaccacagcaggctaagtactgtgctggatgctttatattttttatcttacacaatatacagttagccagggatgctctgggatacacaagcacaaaccccagcaggctgaactgcatgccacccacagcctggttattctgagtcagtgcttggggcatgcacaggtctggggagccctcaactgaagttggtagccaaggttacccactggactaagactagaaaggaggcaattgacaggccaggcgtggtgcctcacgcctgtaatcccagcactttgggaggctgaggcaggtggatcacctaaggtcaggagttcaagaccagcctgaccaacatggtgaaaccccatcactactgaaaatacaaaaattagctgggtatagtggcccgcacctgtaatcccagctactcgggaggctgaggcatgagaatcggttgagcccagaaggcggaggttgcggtgagccgagatcacgccattgcacgccagcctgtgcgacagagcaagacagtctcaaaaaagaaaaaaaaaacaaaaacaggcgagagtcaggaatcaagagtaagggggaggcgggtgggatctgccctggtgttctttcatactcctcgttatgaccactctttcttcccaccagtagcagccactaggaaggagaagccaattagcaactgggtcacagcctgaagtaacctcatcccccttttctaagggcctttaaaaaggacactggctgggtgtggtggctcacgcctgtaatcccaacactttgggaggccgaggcggcggatcacctgaggtcaggagttcgagaccagcctggccaacatggagaaaccccgtctctactgaaaatacaaaattagccagttgtggtggcacatgcctgtaattcctgctactggggaggctgagacagaagaatcacttgaaccagggaggcggaggttgcagtgagccaagatcgcatcattgcatttcagcctggacaacaagagcgaaactccatcaaataaataaacactaatagccagacatggtggctccacctgtaatcccagcatttggggaggctaaagcaagaggattgcttgagcccaggagttaatgaccagcctgggcaatatagggagaaccccgtctctttagaaaaaaaacaaaaattagctgggtgtggtggcatgtaccattggtctcagctacgcaggaggctgaggtgggaagatcgcttgggcatgggaggtcgaggctgcagtgagccatgatcactgcactccagcctgggtgacaaagcaaaactctgtctcaaaaaaaaaaaaaaaaaaaaagtcactctcattcaaccacttttactgcacactaacattgggtggttggatggaatgggagacagaaagaagcatgtggtctcaggcctcacctgcatctccagcgtatgaaatagaaatccggagatacactggttgacgcgtcacggaggtcagccctgttcccttagtccccagggcaccccacaaatgagagggttctatgagatgtactttgaaaaccactaacttagggcaagaggggccaggaggcatcatctgaaaaagatttggaaaaaggggaaatctgcctgtgccgggttaattctggccctgacccagccttctcctcttgcccctgggatcctccttggagaagcagaggcagcattttttttttaaccatctgtctccaaagtggggtcatcctgatttagggacacaaaattaggtaatgtctgacctttgggcttagcctggaccatatccttttcagcccagtacctgaggcctcaagaaggaactcaactcccagcaccaggtcacaaccaccacctggtgttggaaggggatcaccacactccttggctgtggtgtctgccccaggcagggaaagtaggcagtgggattcaataaatgtatcaagcaacagcgagcaccttcctgctccgtgactgttcttggcccctctagcagtcctcagatctttagatcggccctcgcagggtcagcagaacaggcagccgtgaaggtgaggggcatggaggaatctgttgcctggctgaagggccctcagattaactactgtgcccccaatgatctcctaggagctttgcctgacaagggggatctgatgcacgacccagcaatggatgaagagctggaacggctgtaagtgtcaagtgggaggatactgcccccttgtgggggccagacgggtcggacacggctgtgccccatctggggccaacaccacttgtctgtaacatcccacatctgccagggaagggtctgggggccagtggaggcctgaggtgtccctccctctgagtcctttgggggctgcagcccaggggtttaccctagtgttaagagtgggcatggaggccctgctctctgtacaggaggcctctcgctgccctccaggcttcttcccttcttcaggctggcccaggtcccaggcctggtcaactcggtcacagccagtccagaggccagttgcctgccttcccggacccctccccgggttggctctccctggagacctctccatcattcccgaaaagtggatggagagagtgatggctccactgaagagacagacgagtcggagacttgaggagtccaaagggtcctgcccacagcgccctgtacctgctcccacccagcccttggtgtgcccacccagcctcctctccagcaccttgctgtgctgccctctgctgctgacaaggtgaataacagccccaagaccagccagaggggctctgatgatcagcccagccagtggccccggaaggtgaatggcctgctctccctggccctatcagcctgtgaacttcacttaggccccaagctgacagactgtgctgaggccaccttgtcacgccgtagcctgttagtcctcctaacctcttaagagcagtctcttctgagccagcctctgcgggtcccccaataaggttcatctcctcacagcaactccattaagggggagaacccgaatagccacgcagggccttgcaccatcaagggtgacacctgcgacgcaagtaccaggaggacataaccgctgtggcctgttggagaacagccagtagccttggtaatatgaagggtgggccagaagatgatttcacttgcaaaaactgcttcaagtcttgacccctttgtgtctaatagctaaacaaacatgtgaaacgaataaaaagtccctcatgtctggtaactggtgagtctaaagctcctaggctgaggggagaagggagagggggagtttgggttttcggtgcttttctggtaggactaggaggtaggccagtggcccactcagacctggggacctgcctcagacaacgagcagaggggcctagcttcgcacaagagcaaccttccagaggaaaagtgctcacagctggaacggccttcaggaaacaggttcagagggttcaaggccaggttcccataactttaaagaccgtggccataaagggttaatactgcacagccttccagccagggtttcagtcaacatttgccaagcacctgcttggggttagaacagtgggatgcagctgtgaaagacagacagacacagcctggggcagacacatcccagccaagactggaggcaggtaaggacgagtgtcttcaacttctttggattgagggctgaaggggcggggtcccccagaaagcaaaacccacccagaagcccaagcagaacaggactgcctcctctgaaggtggatgtcaccactactaggcatacacatttccttgggctcatccctacccagaacggatcattacaggaactgcctcccaaacccctgcagagctgaggccaagactaggcattccagccccgaagctgctccaggatgcagtggctcattgcctgtaatcccagcactttgggaggccaaggtgggccaactgcttgagcccaggagttcaggaccaccctgggaaacatagtaggaccctatctctacaaaataaccttagccaggcatggtagcttgcacctgtagtcccagctacttgggagacccgaggtagatcacttgaacccaggaggttgaggctgcagtgagccatgatcgtgccactgcactcccgtctgagtgactgacagaatgagaccatcttaaaaaaaaaaaaaaaaaaaagctcaggctgcgtgatgagctctgtaggcccacaatgatgcacagcccataagagacatggttctcaaatcctggtgtcctcagaatcacaggaaagcctactgacgatgcaaattaccaagctccagagagtctaactctatcaacttgggatggagtccagaaattccagatgatcccaaagctgaatgagtcccaaacctacactctgcaaatccctggcttacagccccctggctccctctgcccatcctttctaatcatccacttcccagaccagtggtctgtaactaccgtgaggactcctaaggtggcacagagatgtttcagaagcccccaagagaaaggggtggccaagctaaggatttacacacaaacacacaccttttcttccctaaatttaaagggtcccattaacgtctaagagtatgtgtgtgtatgtatatatatgtaattttttcttttttgagacagggtctcactttatcacccaagctggggtgcagtggcgcgatctagtctcactgcaacctctgcctcccgggttcaagtgacttctgcttcagcctcctgagtagctaggattacaggcatgcaccacaccgcccccaccccgctaattttgtatttttagtagaaatggggtctcaccatgttggccaggctggtttcaaactcctagcctcaagtgatccacccgcctcagcctcccaaagtgctgggatgacagccatgagccactgtacccggcgttaaatatttcttaaactccactgaaacccatccccagtcaagcctactgccgtgacaaggggcaggactgctgaggttgctcgctcgccctcagccagcgagttaaagggccaactaatgccagctctttcctctgcgtgccacagggtggtgaggtcgaagctgcaccggacctcacggcagcacagagccaaggagccaggggcctttggctttcagagaagagagaagcaggaggccctggagagagtgtcctcagcttcggtaccgacgccctaccattaccggtgggagcccagagagtgaggccaggggccggcactgggcagggaggcaggatccagaggacactgcttcactcagaccaacagggagccaggccctgcaggggctttattttgacaccactttgtttcaatacaaacagtccagaa

SEQ ID NO: 2432 - DNA, 225549 bp, Homo sapiens; identical to SEQ ID NO: 2430

SEQ ID NO: 2433 - DNA, 225549 bp, Homo sapiens; identical to SEQ ID NO: 2430
